United States Patent 9,012,723 (ISOLATED NOVEL ACID AND PROTEIN MOLECULES FROM SOY AND METHODS OF USING THOSE MOLECULES TO GENERATE TRANSGENE PLANTS WITH ENHANCED AGRONOMIC TRAITS) - sequence listing, part 5

SEQ ID NO: 19912 - DNA, 954 bp, Glycine max
  Peptide Sequence Number=SeqID_111597
atgctagctatcatcgccaagtaccaagaagagttaagtctagccacggcccacgagcatagggtcgcggacgagtatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcaatggcggacacctactccgcccccgaagaaattcatgggcttctcggctattggaaaaacaccataactaaacgcgccacaaggcatccctatcgcaccagatccaaatctagaacgatgggtgatcaagaggagacacaggaacagatgaaagccgacatgtcggctctaaaagaacaaatggcctccatgatggaggccatgttaggtatgaggcagctcaaggaaaagaacgcggccactgctgccactgtcagttcggctgccgaagcagacccaactctcttggcaactgcgcaccatcctccctcaaacatagtaggacggggaagggacacactggggcacgatggcagccctcacctgggatacaaccgagcggtttacccttatggattgccggccaactactcaccacccgtcttgcaagacgatgcgggccatattgcttctcccgtccttgaaagagagcctcctcaacagcccgaagaagtccacaaagaccctcaagactatgctcgaagggatgtcgagttctatcccccgatccccgaagggccggcacccagcacgttgcctcagcctaacatcgcaacacaaccaatagttttatccacggaaggaccgtccccggcaactgaagaaaggaggaagctcgatctccttgaggaaagattgagggccgtggaaggatttggggactatccgttcgcagacatgacggatctttgctta

SEQ ID NO: 19913 - DNA, 299 bp, Glycine max
  Peptide Sequence Number=SeqID_111598
gtgctggtgcagtcacttcatttggttactgtaaggatcgtaatggtcaatggctgaagaaagatgcccttcctccacaagatgagcgtactccttctcctcctcctcaacgagatgattcagcccttatgactgaagttctttcagagttacggggtcttcacacttatgttggtgaacgttttgattctttggataatcgctttgcaggaatggatatccgtctcacacaacttgaagaagatgtgggttatattcgtcagagctttaatcttccaccaccaccaccaccttcttag

SEQ ID NO: 19914 - DNA, 249 bp, Glycine max
  Peptide Sequence Number=SeqID_111599
atggtgcagcgcctatttatcgttctcgctcgggagccaaaacacgcctgctacctactgtactggaccttcgaccaggcattctacccttgtcgaatcggaaccaaccaccactgtattgcgctcgaacagttgagcggccgccggccagcaacttccgtaccgtacacagatatagattcattcttcgtacctggtccaacttcacaacccttcgcgggttggtcagaagtcagtcttgtttggtaa

SEQ ID NO: 19915 - DNA, 183 bp, Glycine max
  Peptide Sequence Number=SeqID_111600
atgactctacaacttgctgactgcttcattactagaccatatggagtaattgaagatgtgctggtcagagtaaaacattttatcttctcagcagactttgtggtaatgggtatctgtgaagataatgacattcatgtaatggaagtgggtaaggaggttctggaagtaagaacgaaaatgtga

SEQ ID NO: 19916 - DNA, 564 bp, Glycine max
  Peptide Sequence Number=SeqID_111601
atggagggggagcggccctacaaaagggaggtgtcattccccacggtgggcataaagaggattcttgtttgttgcatccccgacgagctacatagcatggaaacatgtttggcagtagaggaattgttgcagcgaatgatagatcaaggccgactggaattcgtggatgagagaagttttggaaggcctaaacctttggtgatatatttcaccaagggcgcagcttcgcaaaagccccgacaccccttggcagctaaacctgtccctttcccatgccaaaacagtcacgcagtcccatggaggtacacacctccgaacaaaaaggaagaagaagccaccgacatcagttcgttgtcggccaaggtaaccaatatcacggggctgagcggtgtgacccgcagcggtcgcgtgttcgcgccccccgacctaccaattcagcccacaaacgtcaaggggaaagaaaaggtagtggaagaacaagatgataaaacgcccctcactccgaatgaggatatcccagtgaaaggccttccggagaaaagggatggttatggcaagaagaag

SEQ ID NO: 19917 - DNA, 526 bp, Glycine max
  Peptide Sequence Number=SeqID_111602
tggactgagtcctttgatcacttgtttcctagatacgggcgatcggggactaatgtatgcttttgtggaacgctggcataaggaaactagcagtttccatttgcctgtcgaagaggtgattatcaccttggatgacgttgcgtcattgctacatttgcctgttgtaggggcattccatagctttgagctacttcatgtcgatgacgctggcgaaatgttggtggagttactcgaggtcagtgctgcagaagcgagagctgagacgattcagtgtcatgactcttatgttcgactattgtggctgcgcgacgtgtatgagctaaagatcgaggcatgtgactggatcatagcagttcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 19918 - DNA, 780 bp, Glycine max
  Peptide Sequence Number=SeqID_111603
atgtcaaatcacaaaagcactgagtcagcactgaagaaccttaaggtccaggtgggacaactggccaagcagatagctgacaagtcatccaacatttttgtggcaaatatagaaaagaatcccatggaggaatgtgaagctatgttgacaaggactaaaaggtttgtggaggataaggatgaggagagtgttgtgcacaagaagaaagttgctgaaaagaaaggtactgatggcaagaaaaataatgtgagaggtgaaagcaatcaagaaaaagagaaacaaataatggtcaagaaaaaagaatttaatgaccaagaaaaagaaaacgaagtagaaaaagaaaaagaaaataaaaaaattgaaaaagatgaaaaaaatgaaaaggaagagaaaagtagaagtgataaagtttatcacaatggtcacatagtagacaacccagttcagggattggtgtacacatgtgcgaagccaatatttatttacggtcgggcacgttatattttagcacaactactcgacaatgacgatcttagaggcacgatggaaataattctccagaatccacaattgaattctgccaaattctatgctattattgaacttattcctcagccacaaccatcatctccacaaccctcatgtccacaactacagctaccgcttccacaacaattaccatacaacaaccaagacctcaataaaccagtatcttcatacaaaaaccttgaaaaacaagacccctttgacatttatagttcatacatgatgcaatcctaa

SEQ ID NO: 19919 - DNA, 387 bp, Glycine max
  Peptide Sequence Number=SeqID_111604
atgggctcaaaaatctaccctaaggttcatgagaaccctaaggccttctttatcaactctagcccaatcctcttggagcctcttactcatggctctggtaactggtcctttcctaaggaggattgcatcacatttgatatgggagaagaggcagaggagacacaggtgagacaggtagctgctgccattcctgagcgatcccttgaggctactttagaaccttctgcaccagtggtaaacctaccctcacctcagcctgcagcagacccctccactcctcttctacagataccagaggacccgactacaccagtcctagctgtggacacttctcctccaactactccagtgcttcagttgacagatgaggaggatggtcagacatag

SEQ ID NO: 19920 - DNA, 207 bp, Glycine max
  Peptide Sequence Number=SeqID_111605
atgcattatcgagcagataggggagtggattttgtggccgatttaggggtgacctttgtggatgattgggcattcttggctagtagggtggctaatgggaaattcggccatgcaagaatggcagccacaacatgggtttctccctccttcttattccctccattttccccgggcctcatatcaccagaattcatcaaagcagcataa

SEQ ID NO: 19921 - DNA, 546 bp, Glycine max
  Peptide Sequence Number=SeqID_111606
atgaccatgattacgaattcgagctcggtaccatacacatctttgattaaacagaaggagaaaaagacgaactttaagtccaagatgagatcttttccactattccacaacaactacaacataagggtaagacctgatgcaatcctatccccaagggcattggatagaagactccaagaagattgggtcaaagatgcaagagaaggtcctagggttctcatgagccttagggtagacttcaggcccatggactatggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 19922 - DNA, 144 bp, Glycine max
  Peptide Sequence Number=SeqID_111607
tggtgtctccaatcatctttcttccttatccattccaatgccattgatcttcaagaagcaaaggactccattgatgaagaagatccaaggcctacaagctccacatggagctacaccatgtggtatcagagcatcttcatctag

SEQ ID NO: 19923 - DNA, 357 bp, Glycine max
  Peptide Sequence Number=SeqID_111608
atgagggatctgcggatgaagcttagaagatctactgcaagtgatttgatccccattgatttggaaattaacgccacttgtagaaggcataattcagagagaatcagaatttttttgcaggatttagaaacagcagcaactccagaagaagaacctcgatcttccaaggcatcttctagttttcctattgcagggcattctcatatagaacctgttgaagacccaatcatggctgaagagccaagaagagtaaccctggaggattattcaagttctactgtgccacaatttttcaccagtattgcacagccagaagttcaagctcaaacaatcacttattctccctctttgatatag

SEQ ID NO: 19924 - DNA, 405 bp, Glycine max
  Peptide Sequence Number=SeqID_111609
atggatttgtgttcactcgctaagtgtgtggtagccacacgcttagcgcataagtcatttttcctaaggcacgttaagcgagtcacttgcgctaagcgcctaatggcttcccgtatgaggaaagccataactttagtgtctcagaccggttatgatagatcaagatttgtatcacaggaggcctgggaccgttactcagataatgtgtttgccaggaacattctgccaaaaggaaatgtcaagctgtatatcgctgagtttgatgattttagaagagaatggattagaagaaactggcataaacaactgaccatcttgactgagggaagcattgatgtggcaattgtgaaggaaatctatgcaaatctatatgtccctgaggacaagtttcccaagcaagttagg

SEQ ID NO: 19925 - DNA, 312 bp, Glycine max
  Peptide Sequence Number=SeqID_111610
atggaaaccatatccaagcgatttaaagagtttgatgtttgtggcaaagttattctaaaaagtaaactccgggaaattgcctaccctgatctaaactctatgtgtcatcctctagaaaaggtcaacaccaaagtcaaacgtagtacaacatcatcatctgaccaggcaattccaagaaggactatgccgatgttggatcaatttcatccatacattcacgattccattgaaaacattgttgatgtcaaaactaacgataactgtggatatcgtgcaattgttgccttagtaggtatgggtgaagattcatga

SEQ ID NO: 19926 - DNA, 189 bp, Glycine max
  Peptide Sequence Number=SeqID_111611
atgaaccacaaaggaatcccctcctttgtgttcagtgattacaaccaagaagttattcccacttcttgcaatgaaccccaaggaagtgtttgcaaccaagaagaccttctcttgaaaatagtcaccaagagtaggtctcttgaaaaactttttgtaagaatggaggaggagaggaagaaaatagaatag

SEQ ID NO: 19927 - DNA, 234 bp, Glycine max
  Peptide Sequence Number=SeqID_111612
atggtgttaagacaaagttctcaggcggttagtcctttgaaactttggggcaaacaaaagaattctcaggcggagaagggaatgaaaaagatgaatagcacaagttttgttttcaaggtttggaaaaccagaaaacttaagaaagcttttgcaaaggaagaagaagaagaagatgttcaaagagattcaaaggttgtaaaggattgtaacaattgttatgaatcaattgaatga

SEQ ID NO: 19928 - DNA, 597 bp, Glycine max
  Peptide Sequence Number=SeqID_111613
atggaagccaatgcggttatagttgccgctactagcgctgtcgctaaggtgaacctgatgctcccatctggcctcaagcaaatgaatcatccaacctcaaatatggtaggcaaatatttgggaagtacggatgaccccatgatgtgcaaattcaaaacaagcacgccttcccgccatatggcttgcctcccaaactatacaccacccaatgtggcgtacattcccaatgaggatgtcaataactccacacccatactcattaagagccaacaacctcaatctgatcatgcacatgtctctcgacccatggaggagacacatggaatgccccaccacaatctagccgacttcgagccttacctcggatatgccactgaagggcaagcagttggtgaggaaaggctcagggccattgaaggaggtaaagattatgcctttgctaacctagaagagttgttcctagtacccaatatcgtcacccctcccaagttcaaggtgctggactttgacaagtacaaggggactacttgccccaagaaccatccaaagatgtattgtcggaagataagggcatacgcaaagatgaggaactgctaa

SEQ ID NO: 19929 - DNA, 432 bp, Glycine max
  Peptide Sequence Number=SeqID_111614
atggttaaggaggagtgtaaggaggtaagtgtctcctccaagaggttagctaagaaggaaagccattttgaaataaagacaaatattaaagaaacttcccctcttagacaacctccacatcttctcctttgtaaaaagacacttgttagcactgtcacacctcttgggcttgaggttattcctcaagtaaagaagtttttggatgagggtttggttcgtaagagcttaaatcctatgtgctttgttggtgcccaaaatagtgatcaaggagttcccacagaccctaagagaataaaggtcattcctgattggcccactccaccaagtattgagggaaggagcccagagtatcaagaacctcggggtttgaggtcaaatcctttccaagggggaggggataatgcaatcctaccccccaagggtattggatag

SEQ ID NO: 19930 - DNA, 1324 bp, Glycine max
  Peptide Sequence Number=SeqID_111615
atggaacggcgcatgacccttgcgattctggtgcttggagaagctgcggttcccaccgcgcaacggatcgcaatggcgttggagcacgccgaaatacggggccttcagagccgcgttgcatcggttgacgacaccttcgtgcatttcggcgatgcaataaggtcgctctatgaggaaggccgtccgatcatcgcgctttgcgccgcgggtatcgtcatccgggcgctcgccccgctacttgagaacaagcgtatcgaaccgccagttctcgccgtggctgaggatggaagcgcggtcgtgccgctgttgggtgggctctcgggtgtcaacgacatggcgcggcaggttgcggcagcgcttgaggtcgcgcccgcgataaccacgtccggcgaactacgcttcggaatcaatctgctgcacccgcctgccgaattgacacttgccaatccagacgacgcgaaaagtttcatgtcgaacctgctcgcgggacaaaagttgcggcttgaaggacaatcgcgctggcttgcgcaatcgaaactgcctttcgccgacgacggcgcgttgacgatcagcataacgccccacaatcgcgtaccgcgtcccgacgagttgatttatcatccgcgcagcgtggcgattgctgttgatatggtccgcgaaaaccctcaggccaacgttgagcatgcgcttgcccgggcggggatagcccggcagtcactggccttgcttctcgccaaggaaaaagactgcgctgcgtcggaacttcacgaagcggcacggatgcttggtattccgctgcgttttgtggcggatgcgccccatgcccgcgaactcgtccttcgttcggtcgagcagccgattgaactgatagaagatgacggactcgccatcgccgttgcgctaaccccggcagatgtgctgtttgtcggtcgaaagcgcggcaagctggtcgttatcggacttgggcccggatcgcgcagcctgatgacgcctgccgtccagcatgaactgcaacaggctgaagacattctcggctatgagacctatgtgcgaatggccgaggagaaccttcgtcctttccgcccggaccaaaccattcacatgaccgacaatcgtgaggaaatgcagcgcgcccgtcatgcattcgaactcgcggcttccgggcggcatgtcgtcatggtttcgtcgggcgatcccggtgtcttcgccatggctgcggcggttgtcgaggcgctgcacgaaacggacaaccccgcatggcacggtgtggagcttgtcatccagcccggaatttcagcggcaatggctgccgcatcgcgcattg

SEQ ID NO: 19931 - DNA, 666 bp, Glycine max
  Peptide Sequence Number=SeqID_111616
gcgaaagtgccgttgcaggatttcctgcgttatgaccagttgctggcttcgggggcggcccatgccgaggccgagttgcgcggcggaccggccgagacggcgcgccagcttgtgcaggttgctggaatcgatgtcgagcgcccgcgcggcgccggcccaactgccctggtgcgcgtccagggcgcgccggatcgcctggcgctggcaggcatcgaccgcggcccgcagggtctgggcggcgccggccggcaaggcgggcgcttcgggcgggggcgcgggcatggcgacatcgtccaggtccagcaggccggggcccagcgtgacgatctcgttgcgatgggcgccgtggctcacggccttgatggcggcgcggctgatgacatgttccagttcgcgcacgttgccgggccagcggtagcggctgagcatctcctcggcctcgggcgacaggcgcaggctgcgcagccccagccgcgcgcggttcagttccaggtagcggccggccagcagcagcacgtcgcggccgcgctcgcgcagcggcgggatcggcaccggatagaccgagagccggtgatacaggtcggcgcggaaatcgccctggcgcacgcgatcgcgcaggtcgcggttggtggccgcgacgatgcgcacgtcgaccgtgcgcgggcg

SEQ ID NO: 19932 - DNA, 330 bp, Glycine max
  Peptide Sequence Number=SeqID_111617
atgaccggccctctcaatgagtcaatctcatgctttctcataagggtggacccttgggtactagaacctatcgcctttagagggctacacgccctcgccttcagagggctgcacgccctcaccttcagaggactacacgtcgtcaccttcagagggctacacaccctcgccttcagaggactacaagtccttacctttagaggactacacgtcctcgccttcagacggctacacgtcctcacctttagagggctacacaccctcaccttcagaggactacacgtcctcaccttcagagggctacacgccctcgccttcagaggactacac

SEQ ID NO: 19933 - DNA, 526 bp, Glycine max
  Peptide Sequence Number=SeqID_111618
atggggacaaatcaaatcgaaaaaagattctatcaagtcaagattaagggcctagatgtcaccaaccttaaggagttgggacggttgatgggacccctccaaaggcaagccttccgcaaagtgtaccgaaagattttagatttgaccacagcggaggtatttacggaagccgttgtatccctcgcccaatactttgaccagccattgagatgcttcacgtttggggacttccaaatagtaccgactgttgaagaattagaggagattctaggatgccctcttgggggaagaaaaccgtatcttttctccgggtttcttccctccttgagcaagattgcagctatggtcggagattcggcgagagagttggatcgtatgaagcaaactcgaaacggcgtagtgggcgtaccgcggaaatacttggaaggcaaggcaagggatatggcgaatcaagaggagtgggtctcgtttgcggatatactagctttgctaatctttggggttgtcctctttctaaacgtggacg

SEQ ID NO: 19934 - DNA, 519 bp, Glycine max
  Peptide Sequence Number=SeqID_111619
atgggaggtgtgtacaaaagaaggacaaagagctcagaggcagatgggcccattggtggctatcgtaagtggttgaaagcccacgtgcaaggtttggattggcttccaagtttgagaaccgctaaaagggaggaagttgaggcaccgaaggaagacgaagaggtgcaggctcttaggacagaactcgagcaagctcaaacagtcaaagaaaggttcaaatcaatggctcttaggatccgaaaggagaatgccgaactgagggatgtaaatgtagctatcaccaaggcattggaacaagagaccaagagggctcgtagggaagagcacagccggaacaaattccgaggggctctatggggtccaagagaagtttgtcttaagcgtttatacgagacagagaccaacatgttagacatcatcagcaagtatcaagaagaactaagcctagccacagcccacaagcatagggtggcagatgagtatgcccaagtgtacgcagaaaaggaggctagaggaagg

SEQ ID NO: 19935 - DNA, 777 bp, Glycine max
  Peptide Sequence Number=SeqID_111620
atgaaaagagaaaagcatgcctcctatagtagtcataactcttgcaagaacctaagtgaagaacttcgtgactattatgaaggaaggcatagatcacatcatagacctcactcccataggagagaaaaggaaagaaagcctcaagaggctaacattaacctcccatacttctatgagaaggacaatgtagaggctaacttagattttgaaataagggtagagcaacaacttaaagagaagtctacttcaaaatcttatggctctcactcttatccaaagaaagaccaaggtcaaggaatcttaggggtgataccttctaagcccaaagatgataaggtgaagataatagaaaagcaagcccctaaggctagtatgcaagagaagactagctctataaagtgctttaaatgtcttggaagaggacacattacttctcaatgccgcaccacgaaaaccatgattatgaggggccaagacatttatagtagccaagatgaggctactacttcaccttcctctaatgaaaatgaagaagcaataggggaagaatctagggaagaaatctatccccaagaagaaagacaaccgttaatggttaaggaggagtgtaaggaggtaagtgtctcctccaagaggttagctaagaaggaaagtcattttgaaataaagacaaatattaaagaaacttcccctcttagacaacctccacatcttctcctttgtaaaaagacacttgttagcactgccacacctcttgggcttcaggttattccctaa

SEQ ID NO: 19936 - DNA, 343 bp, Glycine max
  Peptide Sequence Number=SeqID_111621
atgggctacgtgggagtacgcgagctcagttggaggtgggcaacaggggatggtgggtttatgcgcgcattgtggatgtggaaaaacttgttgtgcaccatcgcccgaccgccacctagtaccacatgtgatggagtggtacctggagatatgtcgcgggggtcaggagaccttggggacgtcaggcgagctcctggcagtcaacagataaaaggaaaacaagaccacaaagcaaggaggcttgtggtggctggccagctgcttgaaaacgaagtcaggaaacttagggagcctctggtaatcgattaccaggcctgtgtaatcgattacacaggaggaatgg

SEQ ID NO: 19937 - DNA, 177 bp, Glycine max
  Peptide Sequence Number=SeqID_111622
atggtttccgtgaagaagatccaaaccgaggcgcttccgaaacgttttcgtgaggaatttcgcgaactttcgaccattcttcgacgttcttcattcgttcttcatcgttcttcgatcttcaacggtgaaactaaggctaaaatcaactcacctagtcaagctcgtccacaaaaatag

SEQ ID NO: 19938 - DNA, 210 bp, Glycine max
  Peptide Sequence Number=SeqID_111623
atgcctttcaaaatatgtatatttgtggataggcagcataaggagcctttcaaaaaatgtacccatgaaatggctatgagaaagctttccgcgaaaagatctaggagtgacgccgcggctgaagggactagtgctgcccccgagtttgatagccaccgtttcaggagtgctggacgtcgctggtcacccccatggctaagtttgacctag

SEQ ID NO: 19939 - DNA, 333 bp, Glycine max
  Peptide Sequence Number=SeqID_111624
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaggcgacgcgagacttgatggtgcatcttccaaggaaggaaaatgcgcagagtcgccaccaatgtttatttga

SEQ ID NO: 19940 - DNA, 231 bp, Glycine max
  Peptide Sequence Number=SeqID_111625
atggcagcggaatggagaaggaagagagagaggagacgccacttcaaggagaagatgagtctagaagaagctcaccaccataggagaccatggataagagcttggaggaagaaggagatgaatgaagagagagggagagaagagcacgaaattttgtgctctaagagagctctgaaatctgaacccactaatccaagatcaagtccaagattctccactaagtgtgtttag

SEQ ID NO: 19941 - DNA, 489 bp, Glycine max
  Peptide Sequence Number=SeqID_111626
atggttactatgatggtggataccttgccagtattctactatgagaaattagtgggctacatgccctctagcttcgcggacttggttttcgccagagaaaggattgaggtgggtttgaagaggggaaagtttgattacgtctcctcggtaggtgccagcggtaggaggaccggaacagctggggccaaaaagaaagagggagatgcccataccgttacttcaacacctgcgtggcccaagccaccacaaaccccccacggtacccaccaatacgcacaacatcacccgagttttttggcttgcaccgggggctcttccgacacagtgctcgcccagccaagggcgcccacgcccccacaatgggggctcttcaggctccggctccaacccggcctcacccggccaacaatgcccaccttggctcgggctccaacacggcaaggaacttctcgccaaggcaggctcagattttcaccccgatcccaatga

SEQ ID NO: 19942 - DNA, 562 bp, Glycine max
  Peptide Sequence Number=SeqID_111627
gtctctttgtatgtgttgtctggaaagaggaggactcaatgattattcgttcaccggaaccagaagtgaaaattttggtagatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttcccgaaaagtttttagtgcccatttcggccaactctctatcatctttctttggctgagtggcatgtattttcatggtgctcgtttttccaattatgaggcatggttaagtgatcctactcacattaggcctagtgctcaggtgatttggagagcatctggaataactagtgaattacaactctattgtaccgcaattggtgcattggtctttgcagccttaatgctttttgctggttggtttcattatcacaaagctgctccaaaattggcttggttccaagatgtagaatctatgttgaatcaccatttgacagggctcctggg

SEQ ID NO: 19943 - DNA, 273 bp, Glycine max
  Peptide Sequence Number=SeqID_111628
atggcggcgcagctaatccatgatcgagtagagatggagtgcctagagggagcctgggagaccctcgaaggcaacacgaggtgccgatttcggggcaccattcgattcacggctacttctttggtgcatccagatgaacctgcacggacgcttcagcgcacggtggagtggacagctccttggattcgttttgcatttgacgattgtatacatgtggctgaagccaccactatggacacctttgctctggatgacactgttgtcataccctaa

SEQ ID NO: 19944 - DNA, 263 bp, Glycine max
  Peptide Sequence Number=SeqID_111629
agcttctattctgtatttcgagcgtctcgatatactacgggacacaattggacatccgagtaaaaggcaccctagacccagataagtctaacagggccctgggttttccagcattgatcacgggtctctgccagtcgttcagggttcccgtcacacctaacgcatcgccgccacctcatcaggctgatccagctgggtcatttgacacggagcggtatttacggcatttggtttgccagcaggcggccaaccacagggggcag

SEQ ID NO: 19945 - DNA, 771 bp, Glycine max
  Peptide Sequence Number=SeqID_111630
atgggcaagagcgaccgcgccttcgtgatcggtgcgctgggcctgctgctggcgtttgagtgggttggcgcgatgacggtcacgggcgtggccgcggccatggcggtgctgtgcgtgctgacgatgatcaaccgggaacgggaattccacagcttcgaccaggtaccgctgttctaccggtactgggcgggcaccaccgccaccccggccacccgggccatcgtgctgctgcaccgcgggcacgagcactccgggcgtgtcacccatctggtcgatgagctggacctgcctgacaccgccttcttcgcctgggatgcgcgcggcaatggccgttcgccgggcgcgcgtggcgatgcaccgggctttccggcgctggtgcgcgacctggacagcttcatcgcccacatcggcgccgagcatgggatcgcggtggaagacatcgtggtgatcgcgcagagcgtgggcgccgtggtcgccgccacctgggtgcacgactacgcgccacgcctgcgcgcgctggtgatggcctccccggcgttcaaggtgaagctgtacgtgccattcgcacgcccgggcctggcattgatgcagaagctgcgcggcaacttcttcgtcaacagttacgtcaagccgcaatggctgacccacgatccggcgcgggtggagagctaccgcaccgatccgctgatcactcggccaatctcggtgcgggtgctgctgggcctgtacgaggcggccgatcgcatcgtcgccgatgcgcaggcgatcagc

SEQ ID NO: 19946 - DNA, 267 bp, Glycine max
  Peptide Sequence Number=SeqID_111631
atggtttctttggaaaacagtatgtctgattttgagcatgagaatccctccttgcctagtcctaaagatttatcttcaagtgttcctattacatatgctttctcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 19947 - DNA, 153 bp, Glycine max
  Peptide Sequence Number=SeqID_111632
atggagaaatttgaaaacaagaacattggagaaaagaaggcaaagaaggcctacatcacaagggatgataacgacttagaatcgtctgatgattctgaaaaagaagtgattaatctatgtctaatgggaaaaaactatgaaagtgacaaagag

SEQ ID NO: 19948 - DNA, 429 bp, Glycine max
  Peptide Sequence Number=SeqID_111633
atgccgatctccccctacgaaagtattagttggtctatgtcatcccgacataggggtcgcacccacaagacacccagtggactcggagaagtccaacagggccctggggtttccagctctggttacgaggctctggatcgtgcccgcaagacacccagtggacccggtgaagtccaacagggtcttggggtttccaactctgattacgggcctcattcagtcctacaaagtgcctgtcccccccagcaagggatcgcacccgcaagacacccagtggacccggagaagtccaatagggtcttggggtttccagctttgattacgggcctctgtcagttctacggagtgtctgtcaccccaaacaaggtcattaggccccttactaaccgagctttcatcaagaagtactacgtccccaggcaggcgtag

SEQ ID NO: 19949 - DNA, 837 bp, Glycine max
  Peptide Sequence Number=SeqID_111634
atgccgtcgtatagggagcgcctggaccgactccggattccggatgtctgttggatcccatatggggagcatcgggaggtccaggacttccacgtcagatcatgctactccggtctcttgtgctgggggcctgttgttgtgtattaccgatcggagagggtcgtgcgacagtttggttacacgcagaccattcctgcttcaactgtcgattcatgggtctcgtatgatgatatacacgacaggtggatgcactacgaggatcatatcgtacctgcaggtgaggtgtgcgtggtgccaggggcgtgttccagtgactacatcgactggttctttcgcacctctcatcctttcatgacaccaggccacgcagtagatcctctacctcatggtcacgccccgcagccccgagtcgtccctcaggccccgcagacggatatcccttgcgtgtcggagccaggaacatcgtcgacatctacggaggagcccagacatgcagtggaagtttgtgatgacattgctaagcggttggagcgtcatctgagtctaggggtggtcacacctggctcatcgacacatgagatgatcgaagaatgcctcaaattggccaggagtgtcacacaggaccatctaatattgtacatgaactcatttcatgcagtgaaagtttgtgataacattgctgagcggttggagcgtcatctgagtctaggggtggtcacacctggctcatcgacacatgagatgatcgaagaatgcctcaaattggccaggagtgtcacacaggaccatctagtatacgttaggtgtagacgcaggcggtgcactgatcaggcttag

SEQ ID NO: 19950 - DNA, 114 bp, Glycine max
  Peptide Sequence Number=SeqID_111635
atggatgtgaagacaacattgttgtatggagagcttgatgaggtgatattgatgaaggaacttgaagggtctgaagccagagatgatggaactcacaaatcaagaggggggtga

SEQ ID NO: 19951 - DNA, 222 bp, Glycine max
  Peptide Sequence Number=SeqID_111636
atggctgaaaagggaaagttggatcatatagaggaaaggctcaaggacattgaaggaggcgaagattatgcctttgctaacctagaagagttgttcctagtacccgaacgtggtcattcccaagatgcaactatagaacatgtgcaaaaatggggcatgaatctttcaaagaatacacccaaaggtggagggatcaggcagcccaagtggttccctcaatga

SEQ ID NO: 19952 - DNA, 636 bp, Glycine max
  misc_feature (629)..(629): n is a, c, g, or t
  Peptide Sequence Number=SeqID_111637
atggatagagctaggttaatctttggcctagttactcagctggacatgaatgtcggagatctcatctctggacagatcacttcaatggcccagtctaactcctctagactcgggttccctacttttatcacagctttatgtaggggggccagaagaccatcggcaaggccagctgaggttcttgctacatcagcagctcctcctccagcacgtatgacagcaactccttctaccctacctcctgtagattttcaacgtttcgaggccatgcttcagaacatacatcaggggcagattattttactgcaaagcctacagctggtagcgcctccagactccatcccgacggtagagcaatttaatgaatgggtagcctggccagggactcaacctcctcttcacagggaagacgaagatcctgccgctcaggtatcccatcagccggaggatgagtcatcagagtcttccactcctgagcccttgatcaggaaaaggagggtagttataacccatgaagctgcagccacctctaaaaagtctcttgaagccactccagagcctctagcaccagtggcagataccacttctccacagcaggcagcagatccttccacgcctgaggatcaaancacccta

SEQ ID NO: 19953 - DNA, 252 bp, Glycine max
  Peptide Sequence Number=SeqID_111638
atggcctcctatggtgtggcgtctcctctctctcttcctttctccattccgctgccattcatcttccaagaagcaaaggaatccattgatgaagaagatcctaggcctacaagctccaatggtgcttgcatcaccttgcttcttgactcaaattcttcaagggatggcaccaatcctcatttccaatttcctatatggcaactcacaaacaatgaaacaaagagacaagcaataaccaaagacaaaaaatga

SEQ ID NO: 19954 - DNA, 242 bp, Glycine max
  Peptide Sequence Number=SeqID_111639
atgaagaacaaggaattaaagagaattcaccgaacaaaaagatagaggaagcaaaagaacatcacctagatgaagatgctctgataccacatgatgtaagctccattggagcttgtaggcctaggatcttcttcatcaatggattcctttgcttcttggaagatgaaaggcagcggaatggagaaggaagagagagaggagacgccactgaattcaagatcaagtccaagattctccactaa

SEQ ID NO: 19955 - DNA, 153 bp, Glycine max
  Peptide Sequence Number=SeqID_111640
atgccctcccggtttccaactagggaattggcgggtggaggaatgcccggagatccgacgacgagtcctgtgaaggtgctaatatcggggacccgaccgtcgatttcgagcaagaagcgagtcagacggaggatgaagaagacgaagatgtag

SEQ ID NO: 19956 - DNA, 519 bp, Glycine max
  Peptide Sequence Number=SeqID_111641
atggtagccataaccccagccaaggttcgtcaacctccatttctccgagaatacgactcgaacgcaacgtgtgcttgtcacggagaagccccggggcattccattgagcattgtaggggcctgaagcgtaaggtgcaagttacaatgttaaatgaaatggataaagttgatatctttgtccctcatcctctcacaaacgcatctttgcttattcaactttcaccggaatgtgggtgcaagccattggtccatttgctcaagcgacctgtgctcctgagtttggacttccaagaccattcaatcagagattactcgtcttacacgttgggggggggggctgccgtaaaacaacgtggacaacccttcccttgtgttcaagaatcccctacaacaagagagccacggtctcttaatcccttttcagaaataagaagaagagaagaagagatctctcttaaaagagatagattgtacagtgaagatcaatcaaaattccttattgaatatgcaagtggttga

SEQ ID NO: 19957 - DNA, 204 bp, Glycine max
  Peptide Sequence Number=SeqID_111642
atgcaagcttggcactggccgtcgttttacaacgtcgtgactgggaaaaccctggcgttacccaacttaatcgccttgcagcacatccccctttcgccagctggccctgaatggcgaatggcgcctgatgcggtattttctccttacgcatctgtgcggtatttcacaccgcatatggtgcactctcagtacaatctgctctga

SEQ ID NO: 19958 - DNA, 312 bp, Glycine max
  Peptide Sequence Number=SeqID_111643
atggttgacttttcccaagtgtcaactcctttaccggaactaggcttatcatttgacctcaacctagctgttgcgctatggaaagtggtacttaggatctggatcctcatgctcccaagaaatccattgtggggtgttgttggaattactcctcaggctagtttgccagtactgagttggtttgtggaactcatgctcgctgcaaggatttggtgtgtggaactcgtggtgattgctagggctgtttggggtgctgactttgcaaaccgttcggggtggtcactcgtgctggcaaggtgtcattttgagtga

SEQ ID NO: 19959 - DNA, 441 bp, Glycine max
  Peptide Sequence Number=SeqID_111644
atgaagttgaattttgatagcaattttgcatttagtatttccaataaacctgttcaacatgaccagacaagcacggttcggtttcattatggtcattctgatatatttgacagaatcttccacataacaagaggtggcataagcaaagcatcaaaagttataaacttaaatcaggatatatttgcagggttcaacacaactctgcgtcaaggatttatcacacatcatgaatatatacaagtaggtaagggacatgatacgggcatgaatcagatatcactctatgaggctaaggatgccattggaaatggagaacaaacacttagccgtgatgtttatcgacttggacaacgatttgacttctacagaatgttgtcattctacttcacaacagttggtttctacttcagtagcatggatatgggaaagatatgtggatag

SEQ ID NO: 19960 - DNA, 801 bp, Glycine max
  Peptide Sequence Number=SeqID_111645
atggcctctgctggtcctgtattttctttctctggaactcccaccatcacgactgcaaaactcaactggaagaactacctatcttggtttgcttcagtggagttgtggtttctcggccaaggatatcatgaccacttggaaaagggagttggtactgtcccaaacgacaagaaatcggagtgggaaaaacttgattttcaattgtctgctgtgctgtggcaatcggttgagctgaatttttggaaatccttagattgtaaagctcgagcggcagtggaagagctcaaaaggtttcttgtgactgactcattggaggaagtagataagaagctggacaagttttacatggtcctcattttgagaagcctacattcagattttgatcatgtgcgtgatcaagttcttgttggagaccaaattccgtcaatggactctctcattactagactttttcgtgtgcctcatgtgttgaaggatgaaaacctagccgaagttgtggaaacatcagctatggttgcatctcgtggaagaggaggaggtcgtaacaataggggaggccgcagtggaaggagtggacgtcctcaatgcacctattgcaagaggatggatcacactcaagaaaattgttactccttacatggttttcctaacaaagcagcacatgtatctagatcagaaaaatcagaatctaagttctctgatgaggagtaccaagagtatttgaagctcaaatctgaaaaatccaacaaccaagcacaatcttcctctgtaccatgtatttcaacagcatgtatctcttaa

SEQ ID NO: 19961 - DNA, 96 bp, Glycine max
  Peptide Sequence Number=SeqID_111646
atggcggtgggtggtgacgccgctgctgaaggcaatggagtggtcgttggaaataattgtaaaaaagtggtgcgcaatgctagaactgttctttaa

SEQ ID NO: 19962 - DNA, 342 bp, Glycine max
  Peptide Sequence Number=SeqID_111647
atggcgatcctcatggtgctagttttagatgtttatgtccggactggcagggaaatatatgttgtttggttattaagagcaagtagatcatgtggatatatatgtggagaacacaaccttgctgagaggtctccaattgtgttgggattcggggctttcatctttatagtaatcaagtattataaagaagctaaggagaaggaatggttttgcactttggaatatatgctccatgaggctaaccaaagtgttgatttctttgccaagatgggaatcacagtagtaggtcctatggtcatagtgtcaggaggtaccctaacaggtccaaggttgtgtttgtag

SEQ ID NO: 19963 - DNA, 426 bp, Glycine max
  Peptide Sequence Number=SeqID_111648
atgcacacaaagcgatgcagtgttaaaagggtccagaagttagaagctgagcttaacaagcttgaatctgaagctgaactatcgggtctgaaaatcaattttgctaagagtagattcggagctttcgggatttctgatcaatggaagcatgatgcagcaaaagttttgaattccaaatatggtggatggaggaaccttgatataaaagacatcaaaactttcaacactgctttgttaggaaaatggagatgggagttgttccagcagcccgatgaaccatgggccagggttctattctcgaagtatgctggttggaggtccttggaagaagggaaaacaggtggccatgactcattttggtggaaggacttgatcagcatccacaatctgcaagaaaacagggcacttaggagggaaattgaatga

SEQ ID NO: 19964 - DNA, 213 bp, Glycine max
  Peptide Sequence Number=SeqID_111649
atgatcgcggggcttgctaagtgtggggaggttgataaatctaggaggaataaaaggctcatggaggcattggagcttttccgcaagatgcagagacaaagggttcagccaagtcaatttacaatagtgagtctgttaggtgcttgtgctcacttaggagcacttcaacatggggattgggttcatgattatgtagaaaggggtcagatttaa

SEQ ID NO: 19965 - DNA, 105 bp, Glycine max
  Peptide Sequence Number=SeqID_111650
atgcggagagaagaggaagctgcagttgctggaattggaagaaatgaggttgagactattcccgagaaagctgaagtcaaagtggtcaggaccgttcattactaa

SEQ ID NO: 19966 - DNA, 565 bp, Glycine max
  Peptide Sequence Number=SeqID_111651
ggctcttccaccaccaccgccgcggctggccatcgatgccatggaccatttgaagcacccacagcaccaaatcgtattagaccctaagtacctagacatagctttctttgatgatgagacatttgactgctatcaagtatttcaaaactctggcttagttgattttatgtctttaaagttgcctcattatcctgaactagttagagtcttttacaataacttaagaattcaggatcgtacactttactctaaggtgcatggtattcctcttgtcattgatcaatctttgtttttctcattgactaaattacccaatcaaggtgttccttttgaaggcactattattgatgactggaagttcgattatttgagtcatgatgctcgtcgtatggtctgtaatgaccaggctgatatgatcggcaaatttcttgtcgggtcattaacctttgaaggtatctatgtcttgatccctttgtcttcttacggcattgttacgccgacaggaaagaatggggaaagaggagtaccgatagaaagaatggccaagagaatggccaagggatag

SEQ ID NO: 19967 - DNA, 357 bp, Glycine max
  Peptide Sequence Number=SeqID_111652
atgcagtcccaatttcaatcgcagatgcaatcacatggactcgcactgcctcctgagagtgaggttagtcctttggttgctcgtgtcagcacaaaggaaagttgtgttgatgcctcagggaacgacccaaacacaggtgagtcagagaaatatgaattgtacgttgaagaaaatcctccccgtctggttgccattggaagactttatgaggggtcaaccaccgttcacaacatccctttggccaatgatcaagtcaagattggtgttgaggaagttcgagatgcagatgctcgcatttttgtaccaactcaagaggttcaattagtagggctgacacttaacacctttgttgcttag

SEQ ID NO: 19968 - DNA, 423 bp, Glycine max
  Peptide Sequence Number=SeqID_111653
atggcgataggagagagtttcaatggcaacaacaggagaaaccttcgatggccatggctaacaggaatgagagcacaagagggaatggaagtgagaggcacaaagggaagttgttttggtactactgctaatccctcaggggaggagcttgacactgatatgatgaaagtgcaggggttgtactatgaggataagcattttacttgcctggtggcctttggaaaggtatatgggggggtgtcaatcgtacactatgtgcatttgactaatgatgtggtcaaggtatgtgttgaagaagttcgagatgccaattatgaagtctctgttcccactttagaggttcagttagtgagacaggtcatcgattccttcattgcatggttgagacttgtgaagcctatttcacatgaggtatttacttaa

SEQ ID NO: 19969 - DNA, 396 bp, Glycine max
  Peptide Sequence Number=SeqID_111654
atgactaatgcaaactgtccgcaagaagcattgcattcagtctcaaacgggaatctaaggcttttggattggagagggacggtcttgaagcaacaatcttgtttggcaattattgattcaatggagtttgttgagttgaaccctctcttccaaaaccccaaatccatgtcttattctatgcttctcctccaacatggtgtgggattggtgtttggagggctggaggtggtggtggatagtggtaatagtatggttttttctttggtgggagtggtggtgagtggtagacatagggagggtgtgcgtgtgggtgtgcgtgtgggtgtggatgaggatgggggtaagggtgagggtacactggaggtgggggagatgggtacttgtagggattcttag

SEQ ID NO: 19970 - DNA, 516 bp, Glycine max
  Peptide Sequence Number=SeqID_111655
atggcatcgttcagccagatgcagtcccagtttcagtcccagatgcaatctcagggacttgcactgcctccagagcctctagttggtccctcaggtcctcgagtaagcacaaaggagaattgtgttgatccctcaggaaacgatcctgagacgagtgactcagacatgtgcggcttgtacatcgaagcaaatcctgcccgcctggttgccctgggaatagtttatgagggatgcactattgttcataacactcctttgttgcctagtcaagtaaaggtgggtgtggaggaggttaaagatccaaatgctcccgttcctgtacccactgatgaggtttccttagtggggcaggcaattcacaccttccttgcttggctgacacatctgatcaagcctttatcacagcaggcagctgtgtctccgacaaaaccacctcaaaagctggatccggaggtcgatgatctgctttatctgatgacattgaccatcctagagcttttcttgaggccttactag

SEQ ID NO: 19971 - DNA, 183 bp, Glycine max
  Peptide Sequence Number=SeqID_111656
atgatccggaaagtagccttccggtcatatccgcttggttggtgcaaaccaaccggcgggcatcatgcacagagaaatcaaatttccaatcatcattcagtgtaccttcaaatgggaggaagaggaaatggaggagggaatctgtgtttcctaagcctcggaatgtcgttggcttcgacttga

SEQ ID NO: 19972 - DNA, 234 bp, Glycine max
  Peptide Sequence Number=SeqID_111657
atgcagaaccacatagagaaggctttttacagtggacatgcttcgtatagagtttctcattcgactagatatcttgatatatgggagccagccacattggccattacgagggaaggttacagtatcaaatgcagtggacaaagtggagttgtaatcacagaaaaattttcaccgtccaccactgcaaatcttcggagaaactttctggcagtgtggcctgatgtttcagaataa

SEQ ID NO: 19973 - DNA, 138 bp, Glycine max
  Peptide Sequence Number=SeqID_111658
atggtagctttgcttccacaaaaagggcttcctgatctcaacgtcacgcttagcaccaatctcgcgcttagcgcgacatatgtctttccagattcccctttactcgctaagcacgctgatgctgggcttagccgttga

SEQ ID NO: 19974 - DNA, 315 bp, Glycine max
  Peptide Sequence Number=SeqID_111659
atggctttgctgtacatttactttcattggcagaatttcttagagaccgggttaattgttggtggatgggataaatatgaaggtggacaaatttatggagttcctctgggtggaacaatagtacaacaaccttttgctatcggaggatctggctccagttacttgtatggtttctttgaccaagcctggaaagagggaatgaccaaggatgaagctgaggcatgggacacggcagcacgaaagctagataacagtggggatgagggagctaggttgggacgaaagaaaatgagggaggtagctaggttcgcatga

SEQ ID NO: 19975 - DNA, 1311 bp, Glycine max
  Peptide Sequence Number=SeqID_111660
atgggaggtgtttcaccattgaggatggcgacattcatgtgtttcgccaatggtgatggtgaaacctatggtggactcgctggcaggaatgatgacatgcatggacatatcttgactcttcccgcttcatgggttgttgagccgaatgtgccatcggctttgacgccactgacccacaaccctggcatatttgtgtccaatgatgttgttgttgcatctgatggtgaagtcaaagccggtaatgacaatgtcgatgctagtagggaatgtgttatgagattttcctattttgggggtatggatgatttgcctgatggagaggttgaagtgaatggtgaggaaaatagcggaaacacggttccgatgctacctgttgtagggatcagtggttctgatcttcttttgaggcaaagacatgcaactccaattaaggcaaggtcgtttttaccctctttgtcaagagaaaagggtcaaggatctcttgtttcagttcaaaagccactccacattggtgcttctcttggtgttggaaattttgtgtcagtgaagagtgatgctaaaaggggtgatttggtgaagtgtgaggcctatgaggcagacagatcagaggttgagggtgcaagcacaccgtcagaggctgcaaagaaggtaaaaattgggatatattttgcaacctggtgggctctgaatgtggtgttcaatatttataacaagaaggttctgaatgcctacccttacccttggcttacttcaactctctcacttgcatgtgggtctcttatgatgttgatctcttgggccactgggattgcagaagcccccaagactgatcctgagttttggaagtctttgttccctgttgctgttgcacatacaataggacatgtagcggcaacagttagtatgtcaaaagttgcggtatcgtttacacatattatcaagagtggtgaacctgcttttagtgttctggtttcaagatttcttttgggtgagagcttccctgtgcctgtctatctgtctttaattccaatcattggtggatgtgcacttgctgctgtgactgagctcaatttcaatatgatcggttttatgggagctatgatatcgaatttggcatttgtattccgtaatatcttttccaaaaagggcatgaagggaaagtctgtcagtggaatgaattactatgcttgtttatctattttgtcccttgcaattctcacacccttcgcaattgctgtggaaggaccacagatgtgggctgctggatggcaaacagctatgtctcaaattggaccccaattcatatggtaa

SEQ ID NO: 19976 - DNA, 94 bp, Glycine max
  Peptide Sequence Number=SeqID_111661
atggctgtgaatgagaattttcttgaaacagctgataagtctgttgctgggacattaatgagtacattgaccaccatgaaatttgatggttcac

SEQ ID NO: 19977 - DNA, 362 bp, Glycine max
  Peptide Sequence Number=SeqID_111662
atggcacgttctccagacaagataaaaagtatcgatggctcaaaagaaactcttaaacttagtgtgaggatcagtgatctatggtttattggcacgcctaacaaatctgagcaagctgagatggtgtttgtggactccgacggtgatgagatccacgctgtttgtaaacaagaccaattgaaggagtgtgttctagaggacatcccttttagaaaatacaggtttgctggatttgcggatgttgtggctggccagtttgaacctaggctattggttgatgttattggtgttgtggaggaggttgtctttcgtcaagtttcaggaaaaggtagaagggtagtctttaaactaaaggacttgag

SEQ ID NO: 19978 - DNA, 273 bp, Glycine max
  Peptide Sequence Number=SeqID_111663
atggcaatcaccaagcaagctgatcttgaggttgaccaaatcagagtcagagtcacagggggagggggtggtggtggtgaaggggtatccatgcatggaggcgccaccgtggacggtggcctgcggtggcgggtcacggaggggcagcctgaggtaagaaggccttccaagagagcagagaagcatcctgtcccaaatgaaccggccaagaaaggacaccctatggaacaggttgcagtggacgttgacatggtgaaccattctgtggcatag

SEQ ID NO: 19979 - DNA, 108 bp, Glycine max
  Peptide Sequence Number=SeqID_111664
atgacttccgcttcatcgactgcctcaagcaagatttttcatcgatatcccgaaccaaaattcaacatcttgacatctgtatttgtgacttttccaattgcaatttag

SEQ ID NO: 19980 - DNA, 213 bp, Glycine max
  Peptide Sequence Number=SeqID_111665
atgaaatggatagatagattcgctttcactctgaatgggagtcaagagcttccaaggttgttagccagagccaaggcaatggcggatgtatacccggctcccgataaagttcatgggcttttcgattattaccaacacatgatcgagttgatgtcccagataattaggaaccaccgaggcgtttgtatttatgctttggctttggcaagataa

SEQ ID NO: 19981 - DNA, 1830 bp, Glycine max
  Peptide Sequence Number=SeqID_111666
atgtcgcctagtttcgtcttcgacccgcctagcgacgaagaaatcgaacactctgaacacgaagaagaagaagaatccgaagaagaaccagagtcaggatcaggaacaggatcagaatcagagtcagaaggagaaggagaagaagaagaagggcacgaagaagcgcgggttccgaagaagaagaagaagaaaacgcagtctccatgggactttgctaaatacacggaatcagtggcggaggaacacgctcgcaggagcacaacctcggtcgacgagaaaatctccaaagcactcaaacaacgttccacgccgctcgttgctgagcttgaccacagctccgagtccgaacctgatgaacaagaagattatagaccagaggaagaagatgaagaagagggtaatgatggtgatagcaaatccttttttgctccttctgatggaacctctttccatgccgattccttcttgcagctcaatctgtctcgccctttgctccgggcttgtgaggccttggggtattctaaaccaacgccaattcaggcagcttgtattccattggcattgagtggtcgtgatatatgtggtagtgccattactgggtcagggaagacagctgcatttgcactacctactttagagaggttgttgttccgtccaaagcgcatgcgtgcaataagggtcctcattcttactccaaccagagagttggcagtccaagttcacagtatgatagagaagcttgctcagtttactgatataaggtgttgcctggttgttgggggtctgtcaacaaaggtgcaagaggctgctttgagaacaatgccagacattgttgtggctactccaggacgcatgatagaccatttacgcaatgctatgtccgtggatttggatgatcttgctgttctaatccttgatgaggctgatcgtcttttggagcttggatttagtgctgaaattcaagaacttgttcgcttgtgtcccaaaaaaaggcagactatgttgttttcagcaacaatgactgaggaggttgacgaacttattaaactttccctgtcaaagcccttgcgtctttctgctgacccatctacaaaacggccagcaaccttgactgaggaagttgttagaatacgaagaatgcgtgaagtaaatcaggaagcagttcttcttgcaatgtgctccaaaacttttacttccaaagtcatcatcttcagtggaacaaagcaagctgcgcatagattgaagattatatttggattagctggctcaaaagctgctgagcttcatggaaatcttactcaagcccagcgccttgaggctttggaacagttcaggaagcagcaagtggattttttggttgcaacagatgtggctgcccgtggccttgacattattggtgttcaaacagttatcaactttgcatgtccacgcgatcttactagctatgttcatcgagttggtcgtactgcaagagctggaagagaaggatatgcagtcacttttgtgactgacaatgaccgatcacttttaaaagccattgcaaagagggcaggttcaaagctgaaaagccgcattgttgccgagcaatctatacataagtggtctcatataattgagcaaatggaagaccaaatttctgaagtacttcaagaagagagagaagaaagagttctaagaaaagccgaaatggaggccacaaaggctgaaaacatgattgcacatagggaagagatcttttcccgccccaaaagaacctggtttgtcacagagaaggagaaaaagcttgcttcaaaagcatccaaggtttttaagaaagttttgggaaaatga

SEQ ID NO: 19982 - DNA, 324 bp, Glycine max
  Peptide Sequence Number=SeqID_111667
atggcttcaagtggaataacatcattgttgttacctagagggcgaactgcacactctaaattcaagattcttgttcctacttttgatgactcaattttcaatattcaccaaggtagtgaattagctgagcttttgaaagtgacaaagttgattatatgggatgaagcacctatggcccataaatttttctttgaaacattggataaaagcctaagagacatcatgggacttggtaatgaatcatctacaatatttggaggaaatgccattgtttttagtggagattttcgtcaaatcttatcggtcgtgccaagaggaagttga

SEQ ID NO: 19983 - DNA, 822 bp, Glycine max
  Peptide Sequence Number=SeqID_111668
atggtggagctgaagcagaagatcctaacttctctgtcgaagctctccgaccgcgacacgcaccagatcgcggtggaggacttggagaagaccatctcggggctctcgccggacgccattccgatgattctcaattgtctctacgacgccgccaccgaccccaagcccgccgtcaagcgggacgccctgcgcctcctcgccgccgtctgcggcgcgcactccgacgccgcggccgcccaccttaccaagatcatcgcccacgtcgtccgccgcctcaaggacgccgactccgccgtccgcgacgcctgccgtgacaccgtgggcgccctcgccgcgcagtatttgaagggagacggcggcggtggtggcggtggagtcgggacggtggtggggctgttcgtgaagccgcttttcgaggcgatgggggagcagaacaagggggtgcaggcgggggcggcggtgtgcatggccaagatggtagagtgtgccggtggcagcggaggggaggcggtgccggttgcggcgttccagaagctatgtccgaggatctacaagctgctcaacagtcccaatttcatggccaaggcggcgattttgccggtggttgccagcttgtcccaggtgagagtagctttggcatctgcagaggctaattctaatgaaggttgcagttgtagtggaagatttgggataattttagtcagatttggatggatgcaagaagcccagaatgagaggcccaagaggaagattactcctcctcaatgtttccacgactacgtccagctgttggtgcttaggaatattgctagatgttgttag

SEQ ID NO: 19984 - DNA, 1956 bp, Glycine max
  Peptide Sequence Number=SeqID_111669
atggaggtgagagaagatttcatggatgaatcaacgttgagcatgatggaggtgagggaagatttcatggtttcacctattggtgacagtgaaccatctttgagaactgcctattttctgaaaccccttgcaaagtcccttgatggatcagtttctgaggttctatcatcttccaagactatgcaactgccacctgtgtttgaaccaaaggagtggcctttggtggtccatttcaaagggtggcccaagctaaagcggaaatgggttgaatgggtggatgcacttcaagtaagatatggatcagtgtggaagaaagttggtatctttgatgccataatgagtaccaagtgttccatagtgaaagacgaaaacttgtgttttggggttgctgagaagtggtgtcctaagacaaataccttcttgtttccatggggggaggcaacaatcaccttggaagatgtgatggtgttgggggcttaccctcttgttggtgatcctatcttcactccacttcaaagccaggaaatgatagaggtggagaagaaattgattcatgcaagacagcaacccttgaggaagaacggagctaaggttacgacatcattatggatgaatctttttctcaatagtgggagtgaaattgagcatgaagcattccttgcaacttggttgacaatggttggtttttctcacaatggcttgatgagtaagtttgttttccccattgctattcatcttgctagagggaattccattgctttgggaccagcagttttagccagcatatataaggatttgagtctgttaaagaaaacaatagtagatttcactaatgataaattggaattggaggttactcttctgtcacccttttacctggtccaaatttgggtgtgggagaggttcatgaatttgcaaccacagcccatgttgataaaccaagaagaccctatgttgtttaggtggcacaaggttaataccttgaaaattgacaatgtgagattggcactggactcggctatggagcatttccgttggcgcccttatgttcaatatgctggtaagttcaaggtgttttatccagaaaatgaaactttggtactaattgatacaaatttggataaagaacctacgggactactagtgtcttttgttacatgcttgagagtttctgtgcttgttggaattcagtctactataaagaagtatctgccacatagagttgctatgcaatttggaatggatcaagatgttcctggtcgtgtgcctacatttcatgggactgaagccattgcatggaaaaattactgcaggaccatatctgataggagtttgtattttcctgctaggctttttgagggagatgttaccacacgttatgcaatgtggtggaagcaatcagtactatgtcgtcatcatgattttgcaaagaatattgtgcagcgaaagagaagtctgaggcctcctcctcatgggccacatgtattgaaagcaaataaaaagggttatgatgctgatgttccacctggtttttctcatttgaaaactgctccatctggaaattctggtgaagacaacggtgagccattgatggggggtctggaggaagattttggggatgcaaatgggagaaaagaatcaaggctgtctagtgaaagctgtagctgtgcatctggaataaaagtgaaaatgtacaaggcaaagttgcaagagctgtgccaccagagaaagtggggtctgcctaggcactttgccatgaaagatggtccagatcacataccaagctttaagcttctgattatgtcaatcgtgtccccttcacttctggtgccattagttcccttaaagaagctaataacgaagctgccatgcttgctttcctcagcttctcttctgtgttttcttcttgctggggatgatggtcttgaggttgggaattacggttttgtgaagtga

SEQ ID NO: 19985 - DNA, 312 bp, Glycine max
  Peptide Sequence Number=SeqID_111670
atgtcaccctttaaagacggtcctccaaccgatgtcgatattcaacgacactgtgttaccaccatgcgtcataaccgatacctcaaattagagtttgaaccctcttctactccttcctttaagattgaaggaaactttaggatgtttatacctttacccgctactgccctttggcgtaagcttgtagccaattgtactattaccgatatgctagtgcaccccaaagggataaccagtaggaatcctattgctacgccaagtaaactcgaggaagaccatagcatggatgttctagatcggtctagaaattag

SEQ ID NO: 19986 - DNA, 504 bp, Glycine max
  Peptide Sequence Number=SeqID_111671
atggcagaaatcttcaaagcgactggttccaccccctatccggaaaccatgtggccaagcctcaagagaggggctatagatcaaaatatcctcgaagaagacgataatgaactgtcggagatatggtctgaaaagcgtgttcatggtgacttggaacaaagagggcgcattgcacagtccaaacaacattactttaaactcgtaatggccgtgatgtgtcctgaatgcgcatggagtccacctgagcttctatctcctgcttctgatagtggggatattgatatgggcggatgttcaccgacaatgagtggggcagaagatgaatatggtggtccgtcgttctcgccggaggcaaggtttgaggttgatggaagaggagctcaaacttatgaagaaggtgctgaatctccggtgggcttgacaaagggtcagtcaacatcgttatatggaagtacgatgtgtttgactgatgatggcaaatccgacgaagttgattgtgggtga

SEQ ID NO: 19987 - DNA, 162 bp, Glycine max
  Peptide Sequence Number=SeqID_111672
atggcgaagaatccagttcatcacagtagaacaaaacacatagcaatcaaaacagaagatcaaattgcagacatattcaaaaaggcgttgccgagaccaagatttgaagaattacgagctatgctcggagtcacaaaaatttgcatcaaggaggagtgttga

SEQ ID NO: 19988 - DNA, 84 bp, Glycine max
  Peptide Sequence Number=SeqID_111673
atggcggaactagaaaccggtcaaggaaccaatgcaacaacttatacggtggtctacaaaattcctgagtccaaatcctgttaa

SEQ ID NO: 19989 - DNA, 441 bp, Glycine max
  Peptide Sequence Number=SeqID_111674
atgaaggcacaactgatgttaagagatctcactaatatgtctcttgccagtctctttggaaaacttcaagaacatgaaatggaacttatgagactccatcaacttgaagagaatgatataaagaggaaaggaatagcactcatagcctcatcatcttctattcaagaagaaagtgacaaagaggacttcactaaaatagaagaagatgatgatgatttcagattctttgtgaaaaggttcaataaatttctaagaaacaaaagaaataaaagggaattaaacttcaatacaaataagaaagaagaagattcctccttagccccaatatgctatgaaagcaatcaacctgggcacatgagattcaattgtcttgtctttaaaagaagaatggaaaaatccaacaagaggaatctcaaagaaaagaaagaaaagaaagcataa

SEQ ID NO: 19990 - DNA, 105 bp, Glycine max
  Peptide Sequence Number=SeqID_111675
atggatacaaataaccaggttgaagatgtcgctctttccagttacaaagcaaaagaagaagcatttaaggagcagagaactggttctacaagacagaatttgtaa

SEQ ID NO: 19991 - DNA, 1784 bp, Glycine max
  Peptide Sequence Number=SeqID_111676
ttgacaatgtgaatcgggactcgttgttccgacggtgcgtgttgcaaggggcatgggaagaatacgtcattccggcatataaaaacaacagcgacttccacaaaataaaaatcaacgaaagcagaggcactgcacttcacgtggcagtgaatgatggcagaatggaacttgttaataaacttgttggtgcaatcttggagcacgaaggtagggaagtggtgagcgatgaaagtgcactgaaatcaaccaatgagagaggggacactcctttgcaccttgcagcatcaagagggttcattgatatgtgcaagtgcatcatagggaaacatggggaaaggaaggaattgatcaaggtaaagaacaacaagggtgagacacctctcttccgtgctgtggccacataccacaaaaagacctttgtgtacctctatcatgcttccaaggatttagatgtttcacttacaaacaatgagggtgataccatccttcaccgtgccatttggggtgaattattcgatttggcaattataataactcattgctatcctggtcgacttgttgacacacgaaacaaagacggagccactcctctcaaagttcttgccagcaagccttcggccttcaagagtggaaggagtctcccatggtggaagcaaattctatattatttcacaatacaggttgaaagtgcagcccagaaagcacgtactatgagaagagcacaaacttttgtcggacaaaagtatgccacttctgttcggtgtgcaaagaacgttgttcgactagcatttgaaggccttagcctatcaggtttgggtgtcaccccacgggaagtcaaagaagaatttccaaaggaggcagcagattgctcatcagagatgatgccaaaacaagaacatgatactaacaaaaaggagactgcatttatggccgcagcgaaaaacggcatagtcgaaattgtgtttgctcttcaaactgcaataccaagtgccatacatgaaactaactgtaacaatgaaaacgtattgcttgtggcagtgaagaataggcaaactgaggttgttgaggagttgcggaagagtttgaataagaaactctttgttagcctaattttagtagtggataacaaggagaacactgtgttacacttggcggcaggtacaacaagcaacagccaaatgacttggcagattgctggtactgccatgcaaatgatgtggcatataaagtggtatgaggatggcgaaaccccatgggaaatcttcgagcaaaaacacaaggacctgataaaagacagttcggagtggctaaaggagacatcaaattcttgctcggttgtggcagctctcattgctggggtttcctttgcaacatcaagcactgtccctggaggcaccgaccaaggtaaacctacattggaaggccaaccggcgtttgatgcatttgccattgcttcgctaattgggctttccttctccgtcacggctctcataatgttcctcgccatactcacttctcgtaaacaagctgaagactttcgcaagagcttgccattaaagcttctctttggcctaacttctcttttcgtgtccattgcttcaatgctagtttctttttgcgctgctcatttctttgtgcttaaggataagtacaagaacatcttattccccatttatggtgccacttgcttgcccgtgaccttctatgcagtgattcaatttccgttgtatgttgatctacttaaagctatttttaagaaggtgccacaacgcgccaaaagataa

SEQ ID NO: 19992 - DNA, 60 bp, Glycine max
  Peptide Sequence Number=SeqID_111677
atggatttgtcttcaatccctacacctgagtgtcttgatggtacaagttatcctgaatga

SEQ ID NO: 19993 - DNA, 477 bp, Glycine max
  Peptide Sequence Number=SeqID_111678
atgggtaacatgcctacagatgaagatgctataaatttggcgatggaagaccctctccttaatgattgtcctatgattatgctaattaatggagcgtttcatccatctaaggttgcggcaaaggctgtcactttgtccattaggcaacaatttgaggaacttggtcgatctgtatatgtagatgaggtctttcagcaaagtcatttacgaaaggatactggtcaatttgtcgatgatagatctagacggacacatgaaaaatttgaggctagactatctcaagctaggtctgatgttgcatcaagtgttggtgaatcccaactcactcccttagaccctgttgaagaacaaagacttaggagtcggtgttggattgcagctgcaggaccaaagcataagggacacatatatggtactggagatcttgctcatacttacaaatgcagaaatgacagcttcatgcagcatacacaatga

SEQ ID NO: 19994 - DNA, 1731 bp, Glycine max
  Peptide Sequence Number=SeqID_111679
atggcagatgttgttgttgatgcaatgatagctgaggcatctgtgattaagtacttgccgtgttggtcagggcatcatttgcaggagatctccagtcgatatcttggtcttctatggctttgggaggaatatgtgggagaaaaatctgaaaataccaaagctgaaccagaggattcaattgtaagggattcacatatgaatggtagtaccctagatgaagatagtcctttaagcaaaaagtcccacagtagcacaagaagaagaaagaagggcaaaaagaacgcaaaaggtagagcagtaaatagcagcaaatcaaagatttataagaaaggagactccctggcattaaagtggttccattctttgaaagaagcaatttatgatttatgccgtgcatttagacagccaatgatttggagacctatgtcttggtttttccttgcccatgttacgattccaaatctttcaaccgtcatcttctattacgaaaccgaggttttaaagctagaagcatctttccttgggacttcacgggttgttggttggttgggacttatgatgggcaccttcatttataatcgtcacctaaagtatatgaccctacgaaaaatcctcatgtgtgcccatattggtttggcattcttgaatcttctgcagattgctgtagtgtcaaggaaaaatattgcctttggcatctcagacaagattatggtcctttttggctcggctcttgctgatggaatcaatcaattcaagtttatgcctttcctgatcttgtctgggcaactatgtcctccaggaattgaagggactttatttgcacttttcatgtcaataaacaacttgggatccacactggggtcttttgtgggtgctggcttggcatccatattgaacattgattcaggatcatttgacaatcttctcttgggcatcattgttcatgccttgtgcaatttcatcccaattgcttttctgtttctgataccaaaggaagccacaggtttgcagacgcatgccgctgcaagggatcaattccggttgctgggtgaaaatgtcgcaaagatcagaaccgatttgatgaaggagcagcttgccacctttcgctctcagctcgaagatttcgctcgcaaacacaagaatgacatccgcaagaatcctgcattcagatcacagtttcatgaaatgtgtgctaaagttggagtagaccccttggcctcaaacaagggtttctggtcagagctgttaggacttggtgacttctattatgaactcggtgttcagattgtggatatttgcttggctactagagtccacaatggaggactgatcgacctgcaggaactctgccatctccttcgccatagacgaaaaactgatcgtgaagttgtttctgaggatgattgcctgcgtgctattaagaaactgaaggtgctgggtagtggttttgaagttatttctgttggaaagaaaaaacttgttcgttcagttccaactgagttgaacaaagaccacaatgagattctagaacttgcccaggctcaaggatttgtgactgtcgatgaagtagaaaggcggttatcttggagttctggccgtgccatcgatgcccttgatacattacttgatgaaggacttgcaatgattgatgatggcgataaagatggcagacggcggtactggtttccttgtgtgtctcccatctcgtcttctatcggagttgattcctaa

SEQ ID NO: 19995 - DNA, 1293 bp, Glycine max
  Peptide Sequence Number=SeqID_111680
atgagcacgcaaaccgcaaccccagtgatcaaaggggaagaagaaaaggaaggaacaaaggaagtggttcaagaagaagaagaagaagcagaagaagcgtctcacccttacgcctttcatgtttctggtcctcgcaatttggccaaccttaactggagagaccttatcagttctagctgtgctttgatccgttttgaagttgttaagtgtgatgggggttgggatttgagcatgagtatgcgaagtttaagaaatgggaaggatgcaacttacaaaagaactgtcattgcttgttttatacaagcagtttacctgcttgaactagatagacaggagaaccgaatgcaagaaaacgctctagctccaaattggtggagtcccttcaagtacaagctcacacaaacattgattgatgaaagagatggatccatttttggtgcaattcttgaatgggacagatctgcagcaatggccgacttagtactaattagaccaagtggtgcccccaaagctgttttagctctaaggggaacgctactcaaaagccctacaatgcggagagacattgaagatgaccttcgttttcttgcctgggaatgcctgaagggctctgtcaggtttaaagtagctctggaggtactaaaatcggtttctgacacatacggaagcagcaatgtttgcattgcagggcattcattgggagccggtttcgctcttcaagtgggaaaggcattggcaaaagaaggcatttatgtggagacacatttgttcaatccaccttctgtttcactaggcatgagtctcagaaacattggagaaaaggctgagttggtttggaagagacttaagtctatgtttccttcttcgagtagtgaagaagctcaagccggcaacgatggagacaagactttgagcatgggactgaagagttggatacctcggttttctagcttcaagaatgccggtttcggggtcggaaaatgggttcctcatctgtatgtaaacaacagtgactacatatgttgctcttatacagaccccgaatgctcgggaggagaaaagaatgatgctgacaaggagaatattggtccaacaaatggacaagttgaggcaaaactgtttgttgtcaccaaggaaaagcagaagtttcatgaagctcatgccctggaacaatggtggtccagtgatgcacaacttcagcaggctaatagtaaactcataagcaggcagcttaaatctttgtatacaagtggtacttcttcacaagtaatgcaaggaaaattacctaggtaa

SEQ ID NO: 19996 - DNA, 249 bp, Glycine max
  Peptide Sequence Number=SeqID_111681
atgaagatgttaaaggggtataccaaaaatctacgctgtcctgaagcatccgttgttgaaagggacattgctgaagaagctattgagttttgttcagggtacattgaaaaggtgaaacctattgggcttctcgagtctcgtcttgacaagagagtgggagttcatgacaaagccttagtgaatgaaagcaatctaaaaatgaccaagaatagggtgttgaaaaagcataacaagactttcctaaattga

SEQ ID NO: 19997 - DNA, 1095 bp, Glycine max
  Peptide Sequence Number=SeqID_111682
atgaaagcaattcctctggtgctgaagcgcctgagggcgaccaggatcaccacgaaactagatgcatcatctgctgccaagttggaagagttgatgtctctgctggacaaaaaaaaggacttgttcaagacagtgaagagcaatggagatgaattcctcgacatattaacactcctagatggccatcttcgctacttaaacaaggacaacttagacaatgccaagtttgagaaagacatggaagctattctccaaagaatcaaggactcagctgaaaagttgctgccaaagggtgctactaatgaaggtgaaacacaagcacttggctcatcatcaaaagtaagacctctggataaccagatgaaaaagttgcactcagatccctcttcaagccaaaacaagaatgagttgctggatcatgacttgtatcagaagattgaggtcagttatgaagaacttaaagattctctaaatatttgcttgttgtctctcttagtattccctgaaggtgctgttataaggaaaagacatacaatttattggtggattggagagggttttgttacaagtaatggagagaaaacagcagaggaagtaggcgagggtgtaattgatgagcttttgaaatgtaaaatgattgtagcttatggtaatggattaaatccagttgtgaaaaaatttaaagttaatcctcacatctgtggtcagttggtgtcatttgtgtcaagagaaaagctacagcatcttggattttcttttcaaataatctctcatcatgaacagccttcatggttagtagttgagcgacaaaaagttaaccttggtgataagggtcatttgaaatctgaccattggaaaactatttttaatcttcgtgcaagttatctgaattttgtttctcaatggttggctaaaatgaagaatttagcggtgcttcaacttggtcgttggcaagatccccctttccatcacattgaagtggcgagtgaagacttcctgaaagagctgaaggatcagaagcaactgaagtatcttagtcttcgcgggatttcaagaatgagccagaaaaattataaagtctgggcaaaaatttaa

SEQ ID NO: 19998 - DNA, 864 bp, Glycine max
  Peptide Sequence Number=SeqID_111683
atgggagatcacaaagttactggctgggaatgggatttccattggaggcgacacttattcgattgtgaggtatctatggctgataatttcattaatgagatgacaggagtgagggtccagctgaactgcagggatgactgggtttggaaaccagaaccctctggccaatactcagcaaaatctgattatgacatgctaaggggagttgtagtgcagggggcagacgttgcagattttgagcaattatggaagctgcggattccatcaaaagctgcaattttcgtttcgagaagcacagcggaagatacaccacatcttttcttccaaagcagcaaaatcttgcctctctggtgggaaaccacatcttgggtgaacatctccactgtttttccaaagcaccaaaggcaacattttgcccaacatatgattgatggggtgaaaggtatttgtattagtaggtggaaggatgccacatttctgttttggacatggttaagaaactatgagaaggatttcgtaactaattttaatcattggtcatctaacctcacagagtctgcccttgggaaccatcctactggtctctatgtatcggtacctctgcctcatttgaaggataccatgaggtggttagcagatccttcgggcctctactcatctaagtcagcctatagtctgttgaccaatgtcaatagaaatctccctcaccctaatatctacaagtcgttttggaaacttaacatacccccaagagctgcgatctcatcaagaggaggctggccacttgtttttcaactgcaaggccactattgctttatggtgggaatccatgagctggaacaggatggtcggtcccctggctga

SEQ ID NO: 19999 - DNA, 417 bp, Glycine max
  Peptide Sequence Number=SeqID_111684
atgtcctcgcttttggttatcagggaaaactcgaacccgaacccgaacccctacccgatcaactcaagtattccctgtcaaagtcaggacgggtatccacaggtaaagtatcagttagaggattactctagtttggagaacaatatactgaatgatgtcaacatcaaaggcatcgtcaaagggaaggaaatagtgatcttgctagcaaccatcgctgttgtgtttggatgtgttgaagaagatgataagaagacgatgatcaattttcttagaactgctaatctgacctacatgtgcagactgattcacaatttcttgtttaacatggccttcaaggacaagttcaaccccaaggtgaagaagaaccttattccctttagaatgttattcgctcaaattatgagtttgctagagtga

SEQ ID NO: 20000 - DNA, 180 bp, Glycine max
  Peptide Sequence Number=SeqID_111685
atgtaccctccaatgtgttgggacaaagaattctcaagcggggaagggaagaatcaaaagaattctcaggcgattagtcctttgaattctcttggaaagagagaagagagacacaaaagaattcaggcggttagtccttctattctttttgcaaagggagaagtgaatgaagaagaatag

SEQ ID NO: 20001 - DNA, 1332 bp, Glycine max
  Peptide Sequence Number=SeqID_111686
atggaccaacaaaaccaaaataacactccagatggttcaggagaggtgcctttgaagcgcaaacgtggtcgtccacggaaatacccaaagccagattcagaggagagttcctatatcctagttagtcaaaataaaaggcagaatcctgttcgtgcggaacaagctccagtacctcctggatttgaaggggttaatggaaatcaacagcttcaaaggggtcaagataatcattcaaataatgaattggtgggccaggtagtttctggtgtaatcgaggctgtatttgatgctggatatttgctcagcgttagagttggtgattctgatactactttgagggggctagtcttcaagcctggacgatacgttcctatttcacctgataatgatgttgctccaagtgttccaatgatccaaagaaatgaagtttccttcccctcaagagctgctcaggttcagactcctctcccaaaggaaaggaatgaacagcctgtgaatgttcatagagttgaaactctcgcaatgaatggctcaccatctgtccctcaggtacctagaggagctgtcagttctagtaacttagttgcctctaccggaaagagtgtgccttctgtgacgggccagatcactcatcaactacccagaggtaatgtggtgcctgttctgctccagcctaataatttttcaaatggagtgccagtttctaatcaaccatcacaagtcaagacccaagtttctctagggagcggagtgattgctgccaaagaaattcctgtagatggaagccatgcactcgtctctctcactcaaaccagccagaatttattgccaagcagtgtgcaaagtgaaggtgtttcaccacataatcaatcttcatccaatgtgttgaatgaagatcaagctaaatctatgagaatgcctggcatgccttttgagcaactggttactgaagttgttaagaggatccaagctccgtcagatgcaatggataccgagactgacaacagtaagtcaggtgacaatacagtagtgaagtatccaagctgtaggcaggaagacaaagttaatgagatggatcaacccatcttgattaagcctcttcaagctgtacagtctctacctcaggaaagctccacatctgctcccaaacctgcagactatactgaaactggcagagtgaatgagcttttgcagcataacaaaacagagaaccaggcatccaccatagcagcagagctaggatctggaaacaagttggatgatataaggaatttaggaactggacttgaagatggtggaacgttcaatcaacaaagcctttctgagcattga

SEQ ID NO: 20002 - DNA, 333 bp, Glycine max
  Peptide Sequence Number=SeqID_111687
atggccctcttgcagggatccaaagaaagttctggacaagttgacgaggatgcagaggtggtttttgtggagagcaacttataccctaatgtcacatcctatcagagcattgtgtcccgacgtcctttagcacaaggttccttaaaacaattcatcaaatcatctgctcccccgaacacaaagttcaagatcatcacaggatccaaacacaaacaacagagggacacaggcttaaaggaacactcaaaccgggtgacccccaaggcctacactccgaagagtccgtcaaggcctctccctcctgattcaggtccaacccagaaaacattttag

SEQ ID NO: 20003 - DNA, 450 bp, Glycine max
  Peptide Sequence Number=SeqID_111688
atgttgccaacaagctcgggtcgcgccactcgcgtgtcacgctctgcgaggtgtgcgagcagctgccacgagcgcatccctgtcacgccgttctttgagttcgtacactcattcaaggcctccttgccgatcaacttccaccaccgcttcttctccaacaccgatgctgacgctgacgctgacgtcagcaccgaggaggctgaggccgcgtcctggctgctagctaatctgaagacggatctaaatttgtctcagtacttgttctccgaaaccaaaccggttccttacatagatctggattacgcggccatcgatccgaagacggaggagaaaagttctgccatcgccgacgacatcgttccagtgcagagcaacttcgagtcgttcacctacgagcaccgtacttctttcttcacggctacttttctcaatttacaaccttcggagtga

SEQ ID NO: 20004 - DNA, 834 bp, Glycine max
  Peptide Sequence Number=SeqID_111689
atggatgaagtcggtgaacccgaccttaaacctgtcgtcttccgggacggccacagcgggcttgaagacggcgaggcccctcggggtgacgaagccatagtagacggcaccgtcggggccgtggaagctatcggtgaagtggaagaagaagcaggagagggcacaaaccaagaggaggaagtggatcatgagggtgtgaatgtgggtgcactggccgttcttgtatatggaggggaggaccatctcaaaagtgaggagggttcctgtggggaggaagttaccgaggagggagggtttgaagaggggttcggtgtttcatgttcgggtgctggagttgcattgttgttgtacactttgatgccgatttgttgttcatttagatccatattcatgtgtgtaaggaattggaatggtggatttggatggaaggaagctcttctctccctaccaagctgcacaaaggaacgagttgagagtagtcctgcaaattccttagatagacaaccttcaactgcacatcgggacatcgatcaacacaatagactattttgtctactggtttccatacagtcatctgctgcattccctgtaacttttgcccatgtcattggattaaagagctttggtagtgcactttgcatgacttcaatatcactaggaaactctgttagtagcttgcttgttgcaattgtgatgaagatttctgccactgatgagatgccaggatggatcccaggaaacttgaacaaaggacatttggatatgttttacttcctcttagccgcactcactgcagcagaccttgtaatttatgtactaatggctaggtggtaa

SEQ ID NO: 20005 - DNA, 507 bp, Glycine max
  Peptide Sequence Number=SeqID_111690
atgagcatctgcagagtcattagtactggtcatttgactaccagtagctctaattttcttttgtccaatttcatccggaagttcaggcttgtcatcttcttctggaagttcaggcttgacatctccatcatcagcctttatataaacttgctcatcattgtgaagacaaggacgaaaatcagggaaaaagaacaaagaaaagaaagtcaaattttgaactcctcatgtgatgaacataaaacaagctttagaataatatacgactttctatctattttgttaagaagtgtccccactactaaaaaaaaggtcttctacatcggttctaacggcctttctacatcggttatgacgcgtggtggtaacccggggtcattgacttacaacatcggttttatgaccgtctttgaaggccggcttttctacatcggttgtctagctacaaccgatgtagaatggatagctttctacagcggttctaaggctgaaacgatgttgaatgggtag

SEQ ID NO: 20006 - DNA, 891 bp, Glycine max
  Peptide Sequence Number=SeqID_111691
atgtcagaagaactttcctgcaaatcatccttggatgttcctttactaccacagtggaatcaccttgatgagaaagccaatatagcctctcatcattctaccaaaaatactattgtatccctctttgcacctgccttaatggactcaatgcaatatcaggtttccttttctacaaacacatgcacttcattaacacgtgtggctttggctttggtttccaggtgttgggattctctcagttccatatgctcttgcatcaggagggtggttaagcttgggtcttttgtttgctattgccaccataacattttacacaagcacgttgatgaaagatgcatggacaagaattcaaatataaaaacctaccctaatataggtgaacttgcatttggaaagacaggaaggctaataatatcagtgtccatgtacatggagctctacttagtttcaacagggttcttgattctggagggcgataacttgagtaacttattccctattggggagattcaaatagctggcttagcaattggtgggaagcaactatttgtgatattggttacccttatcatcttgccaacagtttggtgggataatttgagtttgctctcttatgtatctacaagtggagtttttgcttctgctttcattatcctatcaatatcatggactgcaacatttgatggagttggttttcatcaaaagggaactcttgttaattggaatggtatccccacagctgttagcttatatgccttttgctatcgtgcacatccagtcttccctactttgtataatcccatgaaaaacaaacaccagttctcttatgtaagtgctttaaacaattttacatattttggaagtgttgtgcttttaatctttgcaatctaa

SEQ ID NO: 20007 - DNA, 279 bp, Glycine max
  Peptide Sequence Number=SeqID_111692
atggtgaagtttgacatgccaaaggaactaacatttgggtttcatgtaaaagtttctaggttgttaaggaaaggttttcatggacaccttgcaatgataaaagatgttgatgtgttagaagtggagttaaagaaagtcataatggtatatgaatactcggatgtcataatgcatggaaagatggttgcttatacttctagacaacataagaggcatgaaaagaactatccaacacatgacttagaaatggcaacaatggtttttactcttaagatttag

SEQ ID NO: 20008 - DNA, 282 bp, Glycine max
  Peptide Sequence Number=SeqID_111693
atggatcaggccaataaggagaatgatgaggtttatacacaggttactttgcttccctgggctgagggaaaagagcttgaggaattgggaacagatgaagagggaaatgaaaccacacctacaaagtcaacccctcacatgtttcgcaaaactcttacagccagataccagcactcatggggggattataagcagcaaagaccttctcaagagcttgttgccaaagatttgcatggtgtggagtggaattttcgacatatttacagaggtcagccaaggtga

SEQ ID NO: 20009 - DNA, 585 bp, Glycine max
  Peptide Sequence Number=SeqID_111694
atgtcaattctggaattgtacatagaaaaggatgtggctggtggatcaatgtttcattctgcaaattcgcttatatcatgtgaaaattatttatctaatgatgagacacaactgtcaacaaatatgagcaatttacatgttgacgaagatgatgatgattattattattttgtgtctaactcatacgttgaagagtctttagacgaagatgacagtgttgacggtatatctgatacagatgatgaagtcaccgacatgattcaaccagtaagaattgttcacccagcagaaggtgcacaaggaattgaaaatccattttggaatcatgctttgcattataacaatatcaactggagttatcctgatgaggaggacatttgcggtttggagatgccgttgacctttaatgttggccaagaattatatgttggcatggaatttgatagtaaagatgaggtcaaaaatgcagtcaaagaatatgttatgaaggtgcatcaaagcttcaaagttgttgaaagcaaatcgaacaaacatgatcagagaagatccatcaataaaagtttctttgattcaagagaggattaa

SEQ ID NO: 20010 - DNA, 126 bp, Glycine max
  Peptide Sequence Number=SeqID_111695
atgatgacacaactaagggcaaggaccatgaagcaccatgaagcacttgaagggcccatgaccagaggagcaagagcaggtggtggtggtggtggtgatgagtatcatcagttggacggagcttag

SEQ ID NO: 20011 - DNA, 162 bp, Glycine max
  Peptide Sequence Number=SeqID_111696
atggctcttgagatgagaagaatcatccaacctaaagaggcggtcaccatcctaagtgagaaagaggttatgaaatgcaatcctaccctccaagggtattggatagatgactccaagaagattgggccaaagatgcaggagaaggtcctagggttctcatga

SEQ ID NO: 20012 - DNA, 912 bp, Glycine max
  Peptide Sequence Number=SeqID_111697
atggtgatgactttgttatctaacaaagattgtttgcatggtttatctctgttattggcttttgtgagtgttaaggatttatttaatgttacttcaactacaaggaaagtgctaaagattgatggatatgattgtacaagatatcaaatatatttcccgcgtgatgataaagcagcatttatcacatcaaaagatttggagcagctagaagagaataaatgcaacccatggtgtctatccaccgtgacacaagtagaagaagtgaagtgcatactaagactactctcaatttggctatgcaccatattgtactcagttgtttttgctcaaatagcgtcactctttgtggtgcaaggcgatgctatggccactggaatttcaagtttcaaaatccctccagcaagcatgtccatattcgacattttgggcgtggcattcttcatcttcatctataggcacgcccccgacccttttgtggccaaagtaacgaaatccaaactcacagagcttcaaaggatgggaattggtctagtccttgcaatcatggccatggtctcaacagggttgttcactttccattttctggcaagtgccaccttcaatgcacaaacacctgatgaattgaaaagctttggcagtgcactctacatgacatcaatatcactaggaaactatgtgagtagttttcttattgcaattgtgatgaaaatctccacaaaaggtgacatacttgggtggataccagggaacctaaacttgggacatttggataggttttacttcctcttagcagcactaacaacagctaatcttgtggtttatgttgcattggctaagtggtataagtatatcaattttgaaggaaacaatgaagaagatatcaaaaaggaaaatcatgaggttatggtgtag

SEQ ID NO: 20013 - DNA, 479 bp, Glycine max
  Peptide Sequence Number=SeqID_111698
gtggcgaacgagaagaagcacagacttctgacgatgctggagtgcgacgaacacgatgctcgaccttagacaaaatgatggtcagatggagaacatacaacttcaaggtagatggagaacaaatagagcaagaaagcatggatggagaagaagacagagagaaggagaagacaacacgaaggagacaaaacatacctaggtatggtggcgaaggagaagaagcagagacttgtgacgatgctcgagtgcgacaaagacgatgctcgagtgcgacgaacacgatgctcagatgcagacagggacggtctctggatctgttgatgatggggaagcatgttactattcttatacctcaccctgacacccttaaatgctcccttcgcattgtcattctggatctgttaatgtggtggtggtgcgatgtaaatgatgggtttggtgttaagggtgatgatggtgcaagtcgcgaggaggtttga

SEQ ID NO: 20014 - DNA, 729 bp, Glycine max
  Peptide Sequence Number=SeqID_111699
atggagaaagcgataaaaaacaaagttgctaaagcggtggtacctgcaatagatgttatgtttcaagctttaagatctgagcaagataaggaacctgaacaggaagctgtgttagaggttgtgggtcctggcccttctgaagaatctgggaatgatgctaccaaatggtctgaacggaaggaggctgttgttgatctaacaaagcttgcatcaactaaaagaatttctcctggcgatttctctgaagtttgtcggaccttaaaaaaggttgatcagagtttgggtgagaatatgatgaactacaagcatttaccacctgctggtgaaattcttaggcttttgttctatgtcttggcttcgcctattgctgccctgctctattacttcatctttgccctattccaccctcctgacgaagaacttgttgcttactaccttaaaagacagattaatggccgaaagattgagttggagatcatatctgaagttgatctctataagtgtgaaccgtgggacttgccagttaaagcaagagctccacctcgtcgagtgataaagcaagaagttaaagcgtatggattatttggtttgacaatagttcgtcccccaagatttgattgcagagaagctgcagaacgtgtggctacccctgaggctacagctatagttgggaagggtgaactgcatctcactggacaacttggtgatgtaataaaagaatcagcttag

SEQ ID NO: 20015 - DNA, 1971 bp, Glycine max
  Peptide Sequence Number=SeqID_111700
atgaagatctccggcgactccacccgccctctgcgtccattcccgccggccattgcagccccctcgccggactccgatctccagccgctccggagggccacccgccgccatccccgaactccgtccacccgcctgaggcgcgccggaggacacaccggaaaacggagcaggcccgaaacccccttgttcaagtggaagatccacgacggcgtcagggagaggagcgtcggcggcgatccgctcgaggaggtcggccggaagaaggaggcgccgccccatgcctccgtgtcggcgaggaagctcgccgccgggatgtggcggatgcagctgccggaagaggcggcgggtgatagtggaaggcgaaggggttcgagaaagatcggtgaagaccgtttgggagttcagctcaagccttctttccagttatcgagtactgcaatggagggggcgacaaagtgggatcctgtttgtttaaaaacatcagacgaggtgcagcatatctacagccaaatgaaacttcttgaccaaaaggttagcactgtttctgctgtttcagctcttgaagccgaactagagcaggctcgtgtgcagattcaggagcttgagactgaacgcttctcttccaaaaagaaaattgaacatttcttgaagaaagttagtgaggaaagggcctcatggagaagcaaagagcatgagaaaattcgcgcttacgttgatgacattaaatcagagatgagtcgtgaaaggaaaagtctccagaggattggaattgtcaattccaggttggtaaatgagttggcagatgtcaagttattagcaaaacgctacatgcaggattatgagaaggaaaggaaggccagagaattgattgaagaaatttgtgatgagcttgctaaggaaattggagaagacaaggctgaaattgaagcactgaagagggaatctatgaaacttagggaagaagtggaagaggagaggaggatgttacagatggctgaagtatggcgtgaagaacgtgttcatatgaaattgattgatgcaaaagttgctcttgatgagaagtactcacagatgaataaacttgtagcggatttggaaacctttctcaaatcaataaatgtgaacccaaatgcaaaggagatgaaagaagcacggtcacttcaacaggctgcagctgctgtagacattcaagacatcaagggattttcgtacgagccagctaatccagatgatatttttgccattttcgaagatttaaattttggcgaatccaacgagagggagattgaaccatgtgttgctcactctccagtgagtcatgcctcaaagattcacacagtgagtcctgaagccaaattgattagtaaggataactttcaaagatgttctgatgtatttatggatgacaatggggatatagaagaagatgaaagtggatgggaaactgtgagccatgttgaggatcaaggatcaagttgttcgcctgaagggagtgccctattggtgaacaagaatcgtcgagagagtgatgtttcagggaggagtgtgcttgaatgggaagaaaatgcaggtttagagaccccaataactgaaattagtgaagtctgttcagtaccagctaagcaatcaaagaaggtatcctccatggcaaggctttggaggtctggcccaaacagcggggataattacaagataatctctgtggaggggatgaatggtaggctttcaaatggaagggtatctagtgggggcataatgtctcctgattgggaacttggtaacggtggactaagcccccaagaccatctgtaccagttgagttcgcctgagtcagcaaatctgcataatcgaggcatgaaagggtgcattcctcgcaccgtgcagaagagtagtctgaaagccagacttttggaggctaggatggaaagccagaaggttcagttgcgccacgttcttaaacagaagatttag

SEQ ID NO: 20016 - DNA, 1230 bp, Glycine max
  Peptide Sequence Number=SeqID_111701
atgggtggtttagcctctcattgtcatgagaggcttaccaatacaaaaggaaagcaagagcgagctgctccagttcttcagccatcttccaagcctcctactgtgcccatagcatccgcacgtaggcaacaggaagttgtcgttgttgctgaggatgttcctcacgtggatgacgcagctgaagagaaattcgggagaccttctgctgagattaaagggttagttgttgtcacaggactaagtcatttggtcacatgttcattggacactgacgatcgggtacttatattggcttttgcggagaggtggcataaggaaactagcagtttccatcttccagtaggagacgtcaccctcgatgacatggcctttttgcttcatctgcccatcacaggtgcattctacatctttgaaactcttcatgtcgatgaagtggtgttgatgttagtggaactacttaaagtcagtggacatgaagccagaactgaggcagaacaatgtcatggggcatatgtacgactatcatggctacgagacatttatcgtagcaaatgtgataccagacactggactagtggacactacgcatggggagttgctaccctagtgcatatgtacaataatttgaatgatgcttctaagagcagcagcagacaacttgctaaatatatcacactattacaggcttttacggatgaagactatgatgaaagatcaccacatgcctacagttggacctctacgaaggcattaccagtgtcgacgatgccttacggtgatcatcgtgcatttgggtatgttaagacgattcctctatactctccgggttcaagattatgcttggaagatattgacgataaatggatgcatttctctgactaccttgcactggtaggccagatttgtgttgtgcctggacaatgtgcaccatactacatggactggttctacatgatttcacattcattcatgaggccgacacaacccagggatccacccagatatccacctatcgcagcagctatggaggaagcacatgcgcatgcaccttctgatgtggagcagcctagacatgcagtggagacttgccaagcaataactggaaggttggagcgattgctcaacctaaggatagtgactaaaggcacaaaaacaaacggtgtcatgcaagactccttaaggatcgctagaggtgtcactatggattgctatgtatatgtgcggacatga

SEQ ID NO: 20017 - DNA, 453 bp, Glycine max
  Peptide Sequence Number=SeqID_111702
atggtgtttgagatacccaattggttcctccccaaggttttggcattaagtttgagtctttcgagggatttcctagaggggtcgccaacgcgcagtggcaccacatatgagcacaatagcacaatggcagaaccaagagagaacgaagaggccgaggaggttgccgaggtgaagggactctgtggtggggtcgaagccacagtaggccttgaggggtggcggtttcaagaattcgctgtggagcgtgtcgccgatgatggactcgaccaaaccgtgctcttcgatgttcggtacgaaagggcttgtggcggcgttgctggaagctgcggttgtgttcgaggcggaccaacgaggaggctgaagttgttgggggggggggttgtaaattatccactggtagtgggggactacaataacaacggtggtgctgaaggtcaggacaatgttgaataa

SEQ ID NO: 20018 - DNA, 318 bp, Glycine max
  Peptide Sequence Number=SeqID_111703
atggatagacttttctgcttccatttactaagtttgaactcaaacttggcggaatttgatatcctagaggcttctgacagtaggacgaaaaggaagttactacagaccgtgggggagagatggaggcagtttaaatcatacctcacgaggaaatgggcccttgcagccgatcaggacggtgtcgaggacactgtctgtgacaaatacggcatcagcaaggaaaagtgggcccagttttgccagactcgtagagacccttcttgggaggatgtgcgcatcaaggcacaggccatccagaagcagaatactgccccccat

SEQ ID NO: 20019 - DNA, 294 bp, Glycine max
  Peptide Sequence Number=SeqID_111704
atgggagaaggtggtggagaaatttttaaagaaatatttccagagtccaagactgttgagggaaaggtggagatctcttcattccaccaattccccgatgaatcactgagtgaagctcttgaccgcttccatgccagtgactatgtcatccttcgtgatcgagcctacacacctacaaagaagattcttctcgagctcacatcacaagacgcactagtagcccagaacaagctcctagccaagcaactagagaccctcatagagacgctaagcaagcttcctcaacaattgtag

SEQ ID NO: 20020 - DNA, 588 bp, Glycine max
  Peptide Sequence Number=SeqID_111705
atggctgaaggttatggtggtggggatgaagtcaacatgcttcggaggcttttacttgggacaccaactaagtttggtgttggtgctaatggagctggtgttgcaagtcattttatccaaaaatatggctgcattgatattgataagagttcatggcatgagaaacaataccttgatcagaaggtccaggattctcttgattcagaaaaagttggggttgtagttcttgatgatgcaatgcaagtttctgagcatactctcaaggatattgaatcaatagtcctagggattgaaaagtctgttcctattttcttaataaaaatggatccaacttacttatttgaggtgggaactatcaatgtcaaaatactattgacggctcttcatgaagctactatattatgtgtctctgctataggttctgcagagccttttgtgaagcagattcagaagatgggagcactttacgttgatcgaatagatttcagtgatcatcacctactccttgccaggatacatttttcccctcctgaatttggaagtactaatttgttgatgaatactatgttacttcagatcaacatttaa

SEQ ID NO: 20021 - DNA, 470 bp, Glycine max
  Peptide Sequence Number=SeqID_111706
ggctgttttatcctggggacgtcgtggttgatagtctgcttgcacaatttttggcagtgccacgaaacgtcttaaagaaagcgacattgttcgtgactcagccatatgtgttcaacaatagaaagcttgattgtagccatgtcttggccaaaatgttcagcaacttaaggagtcaagatgtgccccaagtgactcaaaccccacccatccaaggttctgttgtgtggaaaccacctagagttggattgtttaagttaaattttgatgcatccgtaaggcaaggtactggaactggtatgggaatgatagttagggaccaccaagggcaagtgcttgtagctgcaacgtatttatcagatgttgtaatggagattagagaggtagaagcaacaactttcagatgggctattattaaagcagtgttggataaactaggttccatcgcaattgaaccaaatcatatctactga

SEQ ID NO: 20022 - DNA, 840 bp, Glycine max
  Peptide Sequence Number=SeqID_111707
atgattggttatggtggtggggatgaagtcaacatgcttcgcaggcatttacttgggacatcaactaagtttggtgtcggtgctaatcgagctgttgttgcaagtcattttatccaaaagtatggctacattgatattggtaagagttcatggcatgagaagcaataccttgatcagaaggtccaggattctcttgattcagaaaaaattggggttgtagttcttgatgatgcaatgcaggtagcattggagcgagatttggatattgtaatggttaatgaattaactctttggggtaaccttcaactgctgccacgtggacctttaatggaacctttgactgcacttagacgggcagatgaagttgttatccatcatgcagatttagtttctgagcataccctcaaggatattgaatccatggtcctagggattaataagtctgttcctattttcttaacaaaaatggatccaacttacttatttgaggtgggaactatcaatgccaaaataccattgacggctcttcatgaagctactgtattatgtgtttctgctattggttctgcaaagccttttgtgaagcttattcaaaaggatattgagatgatcagagccaaacttggagaactagaggggaagtttggttccaaaccaattgttgtaataactgaaaaggattatgatagggaccctgaaattcttaagcaattgcatccatttaaagtttttgttctctgttctgcattgaaggttctgccctatagaggaagcagagaggatagctttaagaaatttctgaaggaccatttaaaattagaattgcctccagcacgttag

SEQ ID NO: 20023 - DNA, 330 bp, Glycine max
  Peptide Sequence Number=SeqID_111708
atgaatgccttgctgttacttgtggaggatcctgaagtagcaaagtttagagagcaatgcctcaaatttttacctgagatgaaattcctttttaaagattcaagaaaatatgaaggattcaacacaagaacagaagagacaaatgataacattgatgataacactgacatggaagtgaatgagcctgagatagacacgacaactcagaacacgtctttggcaaaggaaaatggacagaggaagagaggaagagagggtgataaaagaattggggttgctgccaagctttcctcacaattagatcgtattattcaaacatttgaatctagt

SEQ ID NO: 20024 - DNA, 282 bp, Glycine max
  Peptide Sequence Number=SeqID_111709
atggagaagttgattaacaaaacacaactctttcccaaaataatcccagcatcatcacgtcggcttggcggctcctcaacagagtctcacttcctgcaccctactactgtcattttgctcccacgaacaaggttcgcgatcatcacagggacattcggcaaggtcaatacaccccccccccacgaacatacacaacatccaacgaatgaaacatgggcaccatcaagtacactgatcatggatgaattaaagatcctaaggcatcccctcggagatgcttaa

SEQ ID NO: 20025 - DNA, 675 bp, Glycine max
  Peptide Sequence Number=SeqID_111710
atggtgttccatgtgaaggtggttgaagatgcggagggaatagtggaagggaacgagagtagtggagtgggaagagaagttgatgagtctgcttgcggcgtaggggtcggtgatgaggcctgtgaggatcgtttgagagagaagctgtttgaaggtgataacaataatgatggtgatggggtcagcagcaatgaaggtagagataccaataatggttgcagtggtaatggggcaacgatagtggtgatggtagtgatgcaaatggtgggggtgttggtggcattgatggtggtggcaactagtggtgatgacgttggtggcgacagcgacaaatgtggtattggtgacaatgatagtggtggtggtagtgatgatggtaataccaatgtcaatagtgatagtgatgacattgacgatgatagtagtagtggtagcggcgacaatgttgatggtgacgataacaaacgtggtattggtggtaacgaaagtggcgacaacggtggtggtattggtggtagtgatagcggcgacgatggtggtgatgatagtaataatataattggtgtcagtgacgatggtagtgacagtggtggtaatggtggtgatatcgacattgagagcaatgatgataatagcgatggtggtaacaacaaaaagtgggattgtcaaatgtaa

SEQ ID NO: 20026 - DNA, 306 bp, Glycine max
  Peptide Sequence Number=SeqID_111711
atgtctgcaagtgaacattcattaggtggtgttgcagagacatatgtgaattttccatggcctactatgaccccttcagagcaacatgatgttccaattgaaacacctaatgtcccgttaggtactcaatggaatgtacccgaagcaatacctaatgtggatgaattattaggtgttgatttgcgtcaccaattttctcttgaggctgaccagcatgaagaggggggccatcgtagcagaagaaatcccacgaagatgggatcgtccatgcggcacatcctcacgacatcatcgacatcaagatga

SEQ ID NO: 20027 - DNA, 612 bp, Glycine max
  Peptide Sequence Number=SeqID_111712
atgtgttggggggatttaactttgtgttttctcaggcctgctctcgcttcttctgttggttgcacttctcgggaccggtgccaatacgggttttgtgtctcccactgcagttttgtggcaattcttgaaggccatatcagacagaggacttcagctgccgtcctcaacttttgccttcagttttcttgtatggactttgtttctttgcatccaacgctgaagatagctgaggaaacaaccactgcagttggatatgtggtagagcgtttgtatacggaacgagagcatgctgcagctccttattttcgcataaagagagtggagatagaggatcaattgtatgacatgacaagtcctttaactcaaacattaaatcagttatcaatgtctgaaattttaagaaagccgattaataggaagagtcatggtgctagggtcactcttgcctgtcacaagatacccaaatctttgtctgataagccagacatgcttgcagcatggcagccagcatcacaaagcttattgactgtcgttgaacatgagcccaacaacgacagcctaaccttgtcgcacgacgttgttctcatgaatacaatgacggccttaggttga

SEQ ID NO: 20028 - DNA, 381 bp, Glycine max
  Peptide Sequence Number=SeqID_111713
atgttctcactgaggaaggaagaagacaggactcaagctgagacagagacacaggcagaagcaattgaagtcactcaaggagtagcaacatccacaacacaggtgcacaaagcagagaaaaccaagagagcagtgaagaagcccacttacctcaaggctaggactttgtctgaaggggatatcaagccacagaacattagtttgtttgaagagtctcatatattcaacatcattgatcttggagctgctacagatctccgagtcggcatcaactgcattcctaaggagtttcttttggatccaaggtctccttatgtggtgactcatggtccagaagatgtgactgatgcagctgtaattgcagtcacaatgccattgtga

SEQ ID NO: 20029 - DNA, 1155 bp, Glycine max
  Peptide Sequence Number=SeqID_111714
atggttttaaatttcattgtcgtgagtcagaaaacctttacattgcgggaaaatgtgactgatgcggccgtaattgcgatcatgatgccatggaaatcaagtgacatatctgtcagtgcagattgtgtccagttttattctgttgaggaaaattgtgatgcagagaccaccagtagtggtgatgaaattgaaaggtcagttcatgcaaacaatctccaatacttgacataccacagttgtgctaggaaaactcaaaccacaagtatggctatttcctccagttatcttgcaagcaggaacaattctagcaaggctgagtccttgccagcaagccttcagaagaaattgcagattcttgactatcaccagcagaactcagcattgaacatatcttcaacttccttccccttcgctcgcttaactttgacaccatgtcgagatattgaaaatgctgaatctgatgagaaaaataaaacaatacaacagaaaccttccagtgatgaagtccattgtgcatcttgcctgaccaaaatatctactcatgattccactgaggtccaagatagcttgaaatcctggtttgaaacaactgaaaaagcaggaaatcctaatggagaagattgtgaaattaaagaagtccctgaagagttagtccaaagagatagagagagagcagttgtgggacattctagaattgtagaacactacactgatctactagaaaaatatgatgacttggttgctaagcatgatgctatagtgaaaagaggtgaagaaggcaacagcaaaagcctcaaaaaagatcatgcctgcgttgccaaatctctttctgctgagctttctgtgttgaggaaagatgtttctagaattggaatttgtcattctggaaaagagtttttagaattaggtcataatttttggaaatctcttttcgaaatggggtttctggaatgctggcatgttttacaccttcatcaagttcctgacattgaatatgaccattttgctattgttgagctccaagacgaggcaattcttgaagtcgttgagcattttgccgtcgtagcccttggacatggcagcggagcaggcattgcagattttctctggtatcgggtgtcggtgaacaagattaggggtatttttgtcctttaa

SEQ ID NO: 20030 - DNA, 345 bp, Glycine max
  Peptide Sequence Number=SeqID_111715
atggaaaaatctcttttgattgtagaagaagcaaacttatcatccagatctttttctggaagagttagtgatgataaagctaacagaagtggaaggaaggaaatgaaaaagcaaggagtttttgaggaatgtcgagaacttttgaagggtgttagtggtgtctttaggccaagagtactaacaactctgatgggtgcaagtggtgccggtaagactacattaatggatgctattcaaggagttcctaagatcaaagaaggttataatcctgcaacctggatgttggaagttacatcagcaggcatagaagcatctcttaagatatttcaaaccaaaggctattga

SEQ ID NO: 20031 - DNA, 714 bp, Glycine max
  Peptide Sequence Number=SeqID_111716
atggctcgaaccaaacatgcatcatatgtggatggatgcgatccctctcatgagtgcccgagcccctcacatgaaagggatgatgctaaagagaggcatcgaaggctgaccgtgtcaacacgcggccaacgacattggtcgacaaagctagaaccagagccaaagccacaagtaaaggcacatccatctaataggatcattggacctccatttggaagagaggtcatgaagattttgctcatgactcaccttagcattaattcaaaggaagaggctataactgcgaccaccgtagatgccagggataggctgacgttgctggcagacctatatgcacttgcatggtcaggtgccgaatctctgagtctgagaggctcagctccaccaagtgccgcgatgccggtccctgggatcggcaccggcaccggtttcagtggcatgctccagctcggctcgaaggtgggccccacgcgtcgcttcatggcgatgccgaggctatggagcttcttggcgattcgttcaatggcgaaggagatcgacaagttcgggtttgaatctcgggagtggagcaacgaatgtggaatctggttttggatttggggaatggaagaggggaaaaattcaatgaagaaggaaaggtgtattgaaagtggatatgagttgcaagaagcaacatttcagcagttacttacttcatggaacatggatgaataa

SEQ ID NO: 20032 - DNA, 1116 bp, Glycine max
  Peptide Sequence Number=SeqID_111717
ggtggccaaattaaaagctgtggtgttcatgacctagtacatgaaattatccgtgagaaaaatgaagatttaagcttttgccattctgcgagtgagcgtgagaacttgtcaagaagtgggatgattcgtcgcctaacaatagcatccggttccaacaatttggtgggaagtgttgtaaactcaaacattcgatcacttcatgtttttagtgatgaagaattatcagaatcctcggtgaagagaatgcctacaaactacagaaattcaaagatagtaaatcttccaaaatcaatagacgtgttgcacaacctagaaacattggatctaagagaatctcatgtgcttatgatgccaagagagttctacaagcttaaaaagttaagacaccttttagggtttcggcttccaatagagggtagcattggagatttaacgtccctagaaacactgtgtgaagtggaagcaaaccatgatacagaagaagtaatgaaagggttggaaagacttacacaattaagggtgttgggcttgacccttgttccgccacatcacaaaagttctctgtgctccttgataaacaagatgcaacgcctggacaagttatacattactactccattggcattatttatgcgcattgatttgcaatttgatgtatgtgcacctgtgcttcagaaggttcgcattgtaggggggttgaaggagttcccaaactgggttgccaagctccaaaatcttgttacgttgtccttgagacgcacctatttgactgttgatccattgcctctacttaaggagctaccatatttgtcatccctctttattaatcgtagtgcatacgagggtaaagttttgcagttcccaaacagggggtttcagaacctaaagcaaatactactgggaagcctttttattttgaaatccatcgttattgaagatggagcattgccttctctcgaaaagttcaagttagtcggaattcccgaactgaaggaggtgccttctggtctctacaagttaccaaagcttgaggttttccatgctatcaatatgtcagatgaatttcaagaaaactttaatctcaacagaggacaaggtcaatggataatagaatga

SEQ ID NO: 20033 - DNA, 552 bp, Glycine max
  Peptide Sequence Number=SeqID_111718
gattgctggaacttgaatgatccttcaattacttttccagggacccagaaatccaaggctagaagatctgaggccccatctacttttgctccccctgcgtctactccctctacttctgctcttccttcaccgccagcagctccagtttttccaagtccctctgctcagagcttagagtctcttatgtctatgctgcagagcctgcatcagggccaactcctgatcatgcagagtttgcaggatgtggcccagcaacgaccagttatgagcctggagaagtttgttgagaaggcctctacagccctggagcctcagtcgaaccaggaagatgatattccagagccctcagagcccataccacctaagccattcactttcgagtttgatctagttattatacaggaggatgttgcagtaccagagccatttcctcgccctgagcctgagccatctgcaccagtgccagacctgcctctttctcaggattcacaattagggactccaacattagatttaaatgagcatgccacggactctgcacaagattgttga

SEQ ID NO: 20034 - DNA, 912 bp, Glycine max
  Peptide Sequence Number=SeqID_111719
atgcacctcaaccaccctaattcgcaacctcacgtggagacggaggtcttctccgaccacgacgttcagattttgcagttctcgacggtgataaagcgctccgtgaaccaccctcactcctccgtcaccacaattgttgctctggagcgtgcccttgagtccgaagagaacaatgctccaagcgctctcgctgctccggttctcgagaacgtgtctcacgaccaatttcaagcattttcgtatgttccctccgatagctttgctttcgacagtgattcctcttttgtcatcactccccctccaattttggaaggtcgtgacattgttaagtgctatggaactaaggctcttgtagttccaatgcattcagcatattggtttttgcctgccacggtgcacaggttggagaggcaagtgagtgtcttaccaggcattcttcaaggggacaagtcaaactccctcttgtacaactctgttgacaatagaaagaaaatttgttggaatgaagattttcattctaagtataatgggtgtcggtggaaaggtggaaggctgaggctggagaaggccaaagaagactgtcttgtgcgtttgaagagagaatgggaacaaggcgctctagattatgctactcaaaaaccacccactgctgcttctgaggaggaaatgcccaacaccacacaatcttccaaaatatgcattttaatcttgtgggttggtcttgtgatggttgggtattgggagttagttgtacattcatctaacaaggaagggaaagatacagagtctattatacctttgccatggtatcccgagaatcttgcttggcattcgaatttctcccgtaagcagctcaggaagaaccaaacacttgggagatttaggcttaatgattggcctcaacaaaaataa

SEQ ID NO: 20035 - DNA, 555 bp, Glycine max
  Peptide Sequence Number=SeqID_111720
atgacttctgctggacctgccttctctttttccggaactccgactatcacgactgcgaaactaaactggaagaactatttgtcctggtctgcttcggaaaaaggtattgatattgttccaagtgacagaaaatctgagtgggagaagctggattatcagctatgtgctgtcttgtggcaatcggtcaaggcagatgttttggagatccttagatcgttcaaaacatgttgttctttttggaagaaggcccgagaaatctttgccaatgatattcagagtttgtttgatgctactatgaaggtcacagccctcaaacaaaccagtcacgacatgattgcacacataggtaaagctcgggctgcagtgaaagagttaaagaggtttcttgtggctgattcgctggaagaagtgaataagaagctggataagttttatatggttcttatcttgaggagtcttcattcagattttgatcacatgcgtgatcaagttcttactggagatcaagtaccatcgatggattctctcatcactaagctgattcgggttgcccat

SEQ ID NO: 20036 - DNA, 426 bp, Glycine max
  Peptide Sequence Number=SeqID_111721
atgacgttcttcatgcccatgtattttctgcaacatctaaaatcaactcttcatgcatttttcttactgaatcttttcaaaggaatttgggagataggaagagatgcgatcgaaaaccctagtgacaaatttacaaccaacataaggataagcggaagaagagagagtgaggatgagatgcgtgagctgagtagcgataggtttgtcgtggaaggaggcgagggcgacaaggagatggaagacgatgaagtgagggttgaaagtgagaagggattgaaggaagtgagggacagagaaggagcgaaagagctgggagaaagcgtaggagacatagacgattggggagagagggttggagacatggttggagaagcacccgaggcagagggaagcactgtcatgtatgagcaaagggtgagtaagtga

SEQ ID NO: 20037 - DNA, 720 bp, Glycine max
  Peptide Sequence Number=SeqID_111722
atggagctgatgagctttctaaatattactggatttcgcgacttccctcttggtgatttaccgatgctgcagttgggggaggaattagagatttcacagattcaactgggagttgcttctgaatactttaggtctggggctgataagatttccattggaagtgatgcagtttatgctgcagaagaatatttaaaagccggagtaaagactgggaagaccagcttggagcagatatcaagagtttatgggaatcaggcagtggttgttagtatcgttccccgtagagtgtatgtaaaggatcctaatgattgtgcaattgaagaccataagggtttcaagtccagaattatgcctagtaattactgtcatattgagctgtatacagtacactgttatggtattgggggtggagggtgggggaggaaatgtgctgaagtatgcagtagggttaatgggggacgagagggccggccaattggtgcttatgaactagcaaaagcagttgaagagcttggtgctggtgaaatactacttaattgcatcgattgtgacggtcaagggaaaggatttgatgtagatttaattaagttgatatcagatgctgtaagtatccctgtcatcgcaagtagtggtgccggtgctcctgaacacttctctgaggtgttctataaaacaaatgcatcagcagcacttgctgctggcatttttcacaggaaagag

SEQ ID NO: 20038 - DNA, 402 bp, Glycine max
  Peptide Sequence Number=SeqID_111723
atggaggcgccgccgccatttgcttcttcttcctcttcctctctcttttctcttcgcaacaagccactctcatcccccacaatcacccatttcggcaacaccaaaccatcgaagagtttctcggttcgtgcctcctcttctagggattctgttgtgactttgcttgattacggtgctggcaatgttcggagtgtcaggaatgcaatcagattcctcgggtttgagatcaaagatgtgcaaactccgcaagatattctgaatgcaagtaggttagtttttcctggcgttggagcatttgctgctgctatggaggtgttaagcaaaactggtagaaatgggttggaccaagactctgttatgtattggggtttactacatctactgacatctactaattactaa

SEQ ID NO: 20039 - DNA, 621 bp, Glycine max
  Peptide Sequence Number=SeqID_111724
atgggagttgccagtcaaactggcgagttctgggagggtaggcttcaggcgttggcaggcttggcagacgtgcttttttcagtaaagggaaattgccactgccagtggtacatcatgaattcagttataacagtgttgtatttcaatggaagggtatatgaagagaatgatggtgtaatatttgaaggcagtaaaaaagcgattcagattaaacgtggaattagtttcaatgctttgaagaaaaaaattggagataaggtaaaatttttagtgtctggaaaatatgttgcgttacaaatttgtgatgatgaagatgttgaaaccatgctcaaaagttttcaacaacaagatcaaatatcagttctggaattgtacatagaaaaggatgtggctggtggttctatgtttcattctgcaaattctcttacatcatgtggaaataatttatctaataatgaggcgcaaccgtcaagaaatgtgagcaatttacatggtgatgaagatgatgatgatgatgattatcttatgtctaactcatacgtggaagagtctttaaacgaagatgataatattgacggtatatctgatacagacgatgaagtcaccgacatgattcaacca

SEQ ID NO: 20040 - DNA, 282 bp, Glycine max
  Peptide Sequence Number=SeqID_111725
atgtttacccatgcatggatccttagattcataggaggtgtcctatttgttgacaaaagcagcagcaaagttttcctaaggtggctacgacgtgaaaatcagcatattggcaatgatgatctgatagtttttcgtcgcaaattggatatcatgaaacaacatgagtttctgtgggagccttacacaacaactgttatgtcagtgttgcctccaatttgtttggttggtagtgtactgtggtgcgcggtggtgccactcatttgtttccatgttgttgagtga

SEQ ID NO: 20041 - DNA, 138 bp, Glycine max
  Peptide Sequence Number=SeqID_111726
atggtgcagagctactatggtgtgcatggaggagcaacaacacaatacccagtttatggaagtggacctgctttagctgcaggagggatgatgagcgatggtgtagtggagcaaaggtataggcagtaccacaactag

SEQ ID NO: 20042 - DNA, 168 bp, Glycine max
  Peptide Sequence Number=SeqID_111727
atgacgacgacgatgctttcaaaaatcatggtggaaaaagggaaaaatagtgttcaaagatggtcttttctaccaccgtcgttgttgaagaacatcgtaattacaaaaatgtcaccgcttaagcaactacaacgagttctgaacaccggtgtagaaggtgtgtcgtaa

SEQ ID NO: 20043 - DNA, 2202 bp, Glycine max
  Peptide Sequence Number=SeqID_111728
atgtcgtcaacactttcaatcccactcggattctgcttccctccaaccgttgctacctccttccctcactcccaaaccaaaccccaaaacgttactttccaacgcagaaaaacaacaacgaaggcttgtgctgcctcagagaaccccaaccaacgccaaaacccgaagcagaaccagaaagaggccaaaaccaagaacgctggcgacgatgatggcgaaaagggtatcaaccccgctggctttctcgccaaacgcggcatttcccacaaagcctttgcgcagttcctccgtgaaaggcaagaattttggaaaatgagaatggaagttgtgtggtataaagtattgaaggacatgaaggatgaaattttgaaacggcatgagaacttcatgattttggcttctgggtttgagttactgggtatgcatcgtcatccagaacatcgggtggattatatggaatgggctccagtggccaacacattggcccttgcgaagagatgtgatacagaaaaatcattattttgtcaagttgccattgtcaccaagaaaaatatgttgtttgaacatgattttgtccatcctttcttattttctgacaagcaagtaaatgcaggggcccgctattgtgcaattattggtgacttcaatgggtggtcacctacagaagattgtgcaagagagcattactttggtcatgatgattttggatactggtttatcattcttcaagataagctgagagagggagaagagccagataaatattattttcaaatgtataactatgtagatgattatgataaaggggatagtggtgtctctgttgaagagctcataaagaaagcaaatgaaaagtactggcaaccaggagaagaccgatttgtaaataatcgttttgaagggccagtaaagttatatgagcagatatttggtcctaatggacctcaaaccatagaggacataccggacataccagatccagaaacaagatacaaagcatgggctgcagagcatggaccttcccctactgctgcgattgatagtggcaaggagtatgacatatataatgtgatagttgatcctcaatggcaagagaaaattcgtgcactggaacctcctgtactgtactggtttgagacacgtaaaggtaggaaggcttggatgaaaaagtatagtcctggcattcctcatggcagcaagtacagggtctacttcaacactgcaaatggaccgttggagagggtgcctgcttgggctacatatgtccagccagaggtagatggaaggcaagcttgtgcaatccactgggaaccatcccctgagcaagcatacaaatggaaaaatatgagtcccaaagtaccaaaatccctgcggatatatgaagctcatgttggaattagtggttctgagccaaaaatatcctcattcaatgatttcacagacaaggtgcttccttacattaaggaagctggatacaatgccatccagttgattggaattgttgaacacaaggattattttactgttggttacagagttacaaatttttttgctgttagtagtcgatatggcacccctgaggactttaagcgattagttgacgaggcccatgctgaaaatcctggaattatgctctggcctaacacaacaaaatcctgtggaaggagcacaattccaggcattttaacattaaaatttggagacaagaagagcatgctagattatattaggttactcacttgccttcattacaatagaaggataaccttcactgtgaccagcaagccaactggatatttatctaaattaaaggaagaaaagaaacaaaagcaagttaagccagaaatggttactgcaccaggaaaacacagatcacagagcaggggtacaaagagaacattcagcagaggtgcagaatatggaaaagcccaaaaggagagtaatgaggccagcttaccttcaagattatgcgtaagggtagaaaagggatttagtggggatagtgccgttagagcaggggacaagcttaacggaattgattctgtgatattcctcttgcaccaaaagataagaattctgttagcagaggatagtataaataagtatgtaaataaaatcagaatcatgaatgagaatatatcttccttgccttattccttcttccctttctctatggaggccctggtcctcgaaaccagttaa

SEQ ID NO: 20044 - DNA, 1828 bp, Glycine max
  Peptide Sequence Number=SeqID_111729
atgccttctcagaaggttgaaacgggtcatcaagacacggtccatgatgttgcgatggattactatggtaagaggctggccacggcttcatcagatcacacaattaagataattggggtcagcaacacggcctcccagcatctagcaactttgactggtcaccaaggacctgtatggcaagtggtgtgggctcaccctaagtttggttctcttcttgcgtcgtgttcctttgacggccgtgtcattgtttggaaggagggtaaccaaaatgaatggactcaagctcatgtgtttgatgaccacaagtcatctgtgaattcggttgcttgggcgcctcacgagttgggtctctgcttggcttgtggctcatctgatgggaatatatctgttttcactgcaagagcagatggtggctgggacactgcaaggattgatcaggctcatccagttggtgtcacttcggtgtcatgggcgccatcaatggcacccggagccctcgtcggtgcagggttgcttgatcctgtacagaagctgtgctctggtggttgtgataatactgtgaaggtatggaagttaaacaatggactctggaagatggactgcttccctgctcttcagatgcacacggattgggtccgagatgttgcttgggcacccaatttagggcttcctaaatctaccattgctagtgcatcgcaggatggtaaagtgatcatatggaccgtggcgaaagagggagatcagtgggaaggcaaggttttgaatgatttcaagacccctgtttggagggtctcatggtcattgacaggaaacatactggctgtggctgatgggaacaacaatgtgacattgtggaaggaagcagtagatggggaatggcaacagatcttcatctccaaacataagaacaaaggtggcaggagatatggtttcgtaaggttcaaaggggtgtccgacgagcgcagactagaaagacagattgacaatatcataattgaacttaagatgtacgtcaatgtctcaaaatactggagaggaaatgagaggcataaagaacacaatgtcaaacccaggacccaagcggatggtgataacaatgaagtggaagcacctggacaaatggcaatgcattatagggcaacttccatgtcatatgcaaaagcggcgtcaaccaccaaaacgaacatcggacaacggaggcacccacaacctataactctcagacctgagggatcatactcatcggtccagctcgagatcccagcgggggagaggaaatggtacacagatgcatgggacgaaattccctgggagataggaacaaacgtggtgccgaaatacattggggatgatatgatactcctccttggtctctcggataccaaagcggaagagctcatcattgaagaaaccagacatggcacatccccgttccattcgttagagaagtggaatccgacgatgagaccaggacacagattggtatggactcaatgttggggcatccctttagaagcgtgggatattgggcaaattcataaaatcatggcagcaataggggacttggtagaggtggaccacgacatcgaagagctcgatgccggaaagtgcactcaccattatcggagtgccatcaggtcatcggaagagatcgactctgacgacagcgatagcagcacaccgaatgcaaagacgatcgaaacccctgaactccaccactcgcccaacagcttagccggcgaccgtatcgacgaagtcgagacccagcagcgtgcaccattacccaacggtcctcgagacatagaggacccaatgggtaacgaccgcg

SEQ ID NO: 20045 - DNA, 1410 bp, Glycine max
  Peptide Sequence Number=SeqID_111730
atgtcgttcaatgggaaacgacttgtcgtggatgagatagatttcttcacagagaagaagaagaaaagtgaagacgttgataatcaattggtgcaccaccaaatggagcttcctattaataccaatttagatctccttattacgaagagttcaaccagcaatagatcaaatatggaagaaggaccgtccgagtcaagggataatacgagaaataagtttgcagctatgttagctgagttgcacatcataaatgctgaaaatcaacacttgagagagctggttgaccaggtgaacaataagtacaatgacctgcacaaggatcttacgaaacttatgcaaaaacaacataaaaatgagattaatggagccatagaggagaaggataagagagatgatatgattatttcaaggtctttcttggatattggaattgctacgaaggaagatccttctcaacaacattcagaagcaaaactgcaagaaagcaaaaacattactgagttgatggagtgcaagaatagagatgttgttgagttggattctggcaaggatagtgcaaaatctaggagagataagcatgagagttcagaaaccatgtcaatgatcaagaaagctcgcgtatcagttcgaacaaaaacagattcatctatgatggatgtcaatggagaaagtatgggcagaagatggcaaaagggaatccatgtccgcgatcttattatcgttgctcaatgggaactgcttgtccagttcggaagcaagtacccatttgttgaaggtcgttcgagcttttcctggaagtatggtatggattacttcagcgctgtacaaaggaatgctgaggatctaagtgtgttgatcacaacatatgaagggcaacacaatcatgtactccctcccactgcaaaggccattgcatccaccacatcagcagctgcatcaatgctactttcaggatcaatgctaagctcagatggccttatatacccaaacatattagaaagtgcatcacttccgttttctcagaacttagcaaccctctcaacttcagctccatttcccactataactttggatctcactcaaagtactaccaataattcctcacagctactacaaggggcaccacaggataaccaacatatatatagcctcctttccccacttttggctcagaagtttatgtcatcagctaccaacattttttatcagaatcaccagactaaggtttctagcttgcatgggtctcagggaacagaaactgcttcatttgtggacacggtaaatgcagctacagctgctatcactggagacccgaaattcagtgcagctgttatggctgccataacatctataattggaagttcacatccaaacattaatggtactagtggagatccagcattgcaataa

SEQ ID NO: 20046 - DNA, 411 bp, Glycine max
  Peptide Sequence Number=SeqID_111731
atgctggaagaagagttcttgatgatcttttggaattgctccccaagggggtcttccattgccatttttggaacatcttcatcagtaggcacgttccctacagtcggggatgaggatggtgtggatgtagatatcagggatgattcatgtgcattaattggagatggagatggtgtaggtgcaacatcagaagatctagttggcatagatacagtagacgatgatgggatagacgatgatagattatctctaggtggcgctggaggtgaccttcaaggctctgaccctgtccctcagaatgttggatgcgactttgaaggagccggaggtgattttcatggtgttgaacttgtacttcaggattttgcatgcgacattcatggagctgaaaatgatcttggcaatctttaa

SEQ ID NO: 20047 - DNA, 124 bp, Glycine max
  Peptide Sequence Number=SeqID_111732
atggcgttcgttccgctatttaacaacactgatatccggcttgaattgaagcgttgtaggcagaaaggtgagagaggaggtgaacgaaggcacggtaagtgttgctacgcaattgggatcgacg

SEQ ID NO: 20048 - DNA, 498 bp, Glycine max
  Peptide Sequence Number=SeqID_111733
atgcttcagtcaagtattgaaactcagggcatagacagacgaagggacactgttgaagcggaagaatattcccaacaaatggcggagcgtggccatggaatgtattacacgccacaaacatttgctgagtattcgacacagatgtatcagtatccttttcagggtcatcacactgatacttctgcaagccagcaatcgttcggtggtgttgcggaaacacaagctcatttttcatggcccacaatgaccccttcacagcaatatcatggcccaattccaacacctaatgccccattaggaacacaatggaatgtaccgggacaaatacctaatacgggtgacttattcggtgttgatttgcgtcacgcattttctgcggaggctgacgaagaagaagcggggaggcatcggggcagaagaaatcctgatcgccaagcacgaagatgggatcgaccatgtggcacatcctcacggcatcatggacaccaaaatgaatga

SEQ ID NO: 20049 - DNA, 483 bp, Glycine max
  Peptide Sequence Number=SeqID_111734
atgtacgatcatttgaatcatgcttgtaggagtggcggccgacagcttgttggttacatcactctgttacaaatatatgagcactttcccttagttgcggagtgtatggttgatccagactatgatgacgtgtcaccacgtgcatgtcggtggattgctacgaaggcttctttgaagtccatatctacatcgacgtacagtcaatgtctagatggactcaggattcctaatgtttgttggatgccttatgggcctgttgccatcaaacaccgaccagagagggtcatgcaccagttcggatacatgcagagtattcctgcagaggctatagattcttggctgtcatttgaagaaattgacaacaggtggatgcactactcagaccattttgcaccaacagatcaagttgatccgtatagacccttgatctgtatggtttatatggatcaacttgatccgtataaaccatatggatcaacttga

SEQ ID NO: 20050 - DNA, 468 bp, Glycine max
  Peptide Sequence Number=SeqID_111735
atgaataggtggatgactatgaagaacctcatgctagaggacacgggaacaccacgctctgataggatgtataagctagaagtgatggtgtatcacaagaaacaaagttccaattttgtactctgggaccgtgagtgcatagaacttatagggaaatctacacaagaattaaacgacatgatgtttgttgatacaactagacatcaggttcctttgtccaacaataaagatgatttctttcaatatgaaactcaatcactctccgcaatatcagatcataatccagagcttgcaatggctgcaactccaaccaagaaagttgtggatgaagtacctaaccatgattcacaagctgaaatgcctgttactctggttcaattgaggtctttccagatgataattttcctaaacaatttctttctgctcagctctcaactaccaagaagcatatcaagaatgaatgaatag

SEQ ID NO: 20051 - DNA, 897 bp, Glycine max
  Peptide Sequence Number=SeqID_111736
atggataaaagcttgaaggtaggagaagatgaatggagggagagggagagggagagaagaagcacgaaattttatgcctcaaataaggaatatgttgaagcaattaaagaagcaaaaaattggggtacaggtcattactttagaaaactttttgctacaatgctaatcacaggatccattaataaactagaagaggtttggaaacaaacatggcattggttagctgatgatattttatattatcaacgaagagtattacatgacgaagctttgcagctaagcgatgatgaattaaaaaatttaactttattggagattgagaaattgttgtgttcaagtgggaagagcttaaaggattatccaccaatgccattcacaactacagaatttccaaatgaaaaactacaaatattcaatcaagtaatgcaagttgtcattgaggaaaagggtggcatgtttttcctatacggatatggtggcactggcaaaacatatatgtggagaactttggcttcagcgcttagagcaaagaaaaaaatagttttgacagttgcatcaagcggaattgcatctttattactacccagtggaagaacagcgcattcaaagtttaggattcgtgtgccaactttagatgactcagtttgtaacataacccaggggagtgacttagctgagttgcttaaagttacaagtttgattatatgggaagaagcaccaatggcacacaaattttgtttcaaagcactagacaaaaccttaaatgatatcatgaaaattagtgacaatagtgacactgttttgggaggaaaaacagttgtttttggtggggactttagacaaatcttacctatgattccgaggggaacccgtttagacatagtgttagacaagtag

SEQ ID NO: 20052 - DNA, 510 bp, Glycine max
  Peptide Sequence Number=SeqID_111737
atggttcgttcacagtttgtggttgtcgtcgtggggtgttgcggtgcaacaatacaagagatggacgaagatcagtggagatatgaaaacataatgtctgaagaagttaatatgaataaagacaatgaagaggaacctggtgtgtttgaaaatattaattgttctgatgtctttcatacttctcaggtgtttgctacccgggatgacgttttgcattgggcttgttttgttgcatatgatattggttttgtgacggtatgcttaaaccagattgctgctgagtttgagcgtgtaaaatatgttggcattgatagatctcgttgtggatgtataatgaaaactactcatggtctttcataccaatgtttatctgagcccgaagtcagcataaccgaagagatagaagccatatcaaggcggtttaaagagcttgatgtcaaaactaaaggtgctcaaaagaaacgaatgaccaaacaacaaagatcaatgaagcatgatccgtctcactga

SEQ ID NO: 20053 - DNA, 305 bp, Glycine max
  Peptide Sequence Number=SeqID_111738
ggatcgcgcccacaagacgcccagtggacccgaagaagtccaacagggccctggggtttccagctctggttacgggcctctgtcagtcctacagggtgcctgttcccccagcgaggtcatgccatcgtgacataggaatcgcacccacaaagacacccagtgggaatgagatcgtgcccgcaagacacccagtggacccgaagaagtccaacagggtcttgaagttttcaagctctaattacgggtctctgtcagttctacggagtacctgtcacctccaacaagggaatcaggccccctactaa

SEQ ID NO: 20054 - DNA, 1071 bp, Glycine max
  Peptide Sequence Number=SeqID_111739
atgttgcctcattttctcattacaagattaacttcatccttcacacactacaagagcacccaaatcccattgggttctctgctgcaacacagacactatgtttttcttttttccttcaattcattcacatctggtagagacaaccataaaggtgtcacctttaccgtatcttacctcataaactcatgtgggttgtccccagaactggcttacaaactctccaacggggtcagtttaaaaacccccaatggcccaaatgctgttcttgacactctcaaggactatggattctccaaaactgaggttgcaaaacttgtggagaagcatcccagggtgcttgttgcaaatgcagagaagacccttttgcctaaactgcagttcttccactctattggggtttccaacactgacatgtctaagatgataattaaaaaccccttaatcttgcggaggagcctggcaaaattccttgtccctctatgcaggatgatcaggcgtgtggttcatgatgatctggaagttgttaaagttttgagaaaatccccatttgctttcacatatgctgacatggtgaatggcttggttccaaacattgaggttttgaggcagtctggtgtgcctcaaggttcgatctctctgctgatggtccattttcccagtgtagcatatgggaagcattccagatttgtggaagctgtcaagagagttaagaaatttgggtttgatcctttgaaaacagcatttgtcatggctatccaagtgctttataatatgcgaaaactggcattggaattgagatttgagatttatgagaggtggggctggaaccgggaaatggctcttcaagcgtttgtgaagtatcccaattttatcaagttgtctgatgagatggttacaaagaaaatgaatttcctagtgaaagacatgggtttgtcaccagaatatattgctgcatatcctactgttctaggctacaacttggagaagaggattgtccctagactctcagaagatttgcctctcttaccagatgtctacaaaggtttgattcatcatgagaatgtaatataa

SEQ ID NO: 20055 - DNA, 363 bp, Glycine max
  Peptide Sequence Number=SeqID_111740
atggcagaattgcttatggatgaaactgcattaccgtgtctttcaggttgtgattgtgacatgagtaatgccaacacatcaccaggtattaaatttgagtcagcatactgcgtcaaggtgtcttatactaggtgccctatttgtccacagttcaaaggtgtctttggaactgccttactaggaaccctattcaacaaatacatgacagttttcaaggcatacatccacaaagatatgggtaaagtcaaattgattaacatactcctaatcatatccattaaagttcaattacgtctttctgatacaccattttgttgtggtgtactgggcattgtgtattgcgcacaaatgccacgtttctga

SEQ ID NO: 20056 - DNA, 483 bp, Glycine max
  Peptide Sequence Number=SeqID_111741
atggggtcgtttccaaattatttccaacatgggacagttatttacgtgaaaaccatgcatgcaggacccaaaccgccagaaccagtggcgagtttggtgtccttgagcaaatcgccagcaccaatgacgatacgtgcatgcagagaggaaaccgtcagtccaaatggcgatatgcttagcgctttgggaaccgccagtcaaactggcgagtttcatggactgaggctgcaggctacgtcctgccatggcagtgtagctgggtcagtgcaggcgaaaccgctattaccattggcggtttgccttgcacagggattgccaagaaaccgctattaccattggcgggttgcttggtttgaatttttttggccctcttccattataaaagcagaagcttcgggtgtgctttgtttcactcttggtacgcgatttctctcctcttcatattacgtgagttctctgtgcttggttaatgttaggttttaa

SEQ ID NO: 20057 - DNA, 939 bp, Glycine max
  Peptide Sequence Number=SeqID_111742
atggaggaggaagacaaccactcccacctccaaccactcataccctattattccactctctccttctcctcccattcactccagcaacactttgccgacaaaaatgcaaaacacttcacctccgacagcaacaacatcgttctccgaatcctctcaattctcttactagctctcatctcactatgggccaactacgaggcatccaaaaccttccacatcaccgtggtaaacgacgccaaggactcccccgcgggacgccgtttcgccctctcctatgtctcaaacgacgaagcctctcgcatactcctcaacacaagctcctacgtagaacactttctttatccaaatagtaataacaatgatagcaattaccccaagaagcacatagatagtgtcacactccagctacctcgccggaatctcaacgtcaccgacatcgttgccgtctacaccgccgccggaaatcacctccaacgaggtggaggaaaatgttttagttatgtcattgagattagccctacgttactagaagaccaaaggtacgataagatagctatagtgggtgcaatcctacgtggcatggctaaggtttggatatgggaaggggccccacaagggcttgttgatggcatggcggagtatgtggcggagatggctggattccgccgtggtatggtctccggtggcggtgagatgccacaatgtagggagggtggtggcggttggtggtgggaggataaggaccctagccatgtggcacgtttgttgcattattgtgagaaattcaagaaggggttcatccaacggttgaatgaagccatgagggacacgtggcatgaccgtgtggtggatgaggtgttggggatgcccgttatggagctttgtggtcgtttgtataatgataataatgcttcttgggttggctccatctccatgtga

SEQ ID NO: 20058 - DNA, 318 bp, Glycine max
  Peptide Sequence Number=SeqID_111743
atggctaaagaaagagggtttcccctaagggagaggctcaaactttggatttctacactagagagttctgagactcacttacttttcaaactgactttgcacttagcgcgcctctgcgcgataagcgcgcactgggcttctcctcgtgggccttctcgcgctgagccggatctgcgtgctgagcgagaattacgcgctgagcgagacatcacgctaagcttggaactactcgttaagcgagtgctgcgcgctgagccaactgtccaattcttcttcacttctttttcttccacattgttttcgtctaattccctctaa

SEQ ID NO: 20059 - DNA, 614 bp, Glycine max
  Peptide Sequence Number=SeqID_111744
atgtcatgtgaaggtgttgttgttgagaaaggttttgaggataataaggttgatgcagggaagtgggtgggtgaacaagttatacctttgaaggacaaggtgcaagtcactgttgatttaagagtgctagagtcaagatataatagaaaacttgggatctttcagggtagctttgtaggttatggacgtcaggatgtactaaccactgtcattaggctaccagtgcatattggttgtgttcgtgttgctggagccagtgtgacgactaggcaatactttggacaagcttcaacgggctcccacacatctacgtcgataagcccaaaagatgacgagacaactaatgttgtcattcaggcagatgcagtccagggaatcgtacatccaattgagccagaggtagctccttatggtgcccgtgggtcaacaaccgcgcaccatgtgcctttgggcaacgatatggtaaaggtaggtgttaaggaagttcgagatgttgatgctcgtgtccatgtatccactgaagaggataaacaggtaccaaagagaccaataaagcctgctgataggtcagaacctgatgacaatctcatataccagatggcattaatgacccc

SEQ ID NO: 20060 - DNA, 552 bp, Glycine max
  Peptide Sequence Number=SeqID_111745
atggaggcggcgaacggcgtcgtgtcgaagaagatcgaggcgttggagcgcgagaacgcggccaagaaggacgagatccggaggctgaagaaggagatcgattcgctccggcgcgaggcggcggagctgcgggactcggagacgagcgcggcgctgaagaacctcctcgaagagagagaacgaacggtgacattcctagagagagaaacagaatctctgaaacagttgaaagcagagagcgagatgaaggttcgcgatctggagcggaagctaagcgttgtggaagtgagggagagcgaggagcgcagcaagagggttagggcggaggaagagaccaaagagaaggttggggagaaagagagagagattgaagagatgagacagagaattgaagatttggagaaagttagagttgtggaaatgagagagaaaggagagagagtggatggcgaatggacgaagtggttggggattgtgtggccggtggtggcgacggggagtggagccgttgctgcggtgttctatctctgttttcgaaaacgcagtaggtga

SEQ ID NO: 20061 - DNA, 1017 bp, Glycine max
  Peptide Sequence Number=SeqID_111746
atgattgaaagaaacatgcctaccgcatttacccgtaggcaacgacaacaagtgcgtgatgttgaggatccttcgacggcgtgcgaaggaattgaacgaagagcaataacaaccacacatgttgaagaaggtgttactaatgttaagggttttccaggcggacctcatgacacatcagttttgagagattttgaaaatcacattgctttgagagtttggaatggagatttccatttgcctataagagaggtgactatcaccttggatgacgtggcatcgttgctacattttcctatcgtaagggcgtttcatagtttcaagcaacttcatgtcgatgacattgtcaatctgttggtggaattactcgaggttagcactgtagaggcaagagttgagacgatttattgtcatggctcttatgttcgactatcgtggctacgagacgtgtatcagacaaaaatcgaggcatgtcactggattgtagcagcgcgagcgtatttgttgcatctgcttggatgcacactctttgctaacaagagtgtcacacacgtgcacgtggtattcttggatgcgctgcgtgacttgacacagagtgagacttacgcttggggcactgtttgttggatctatgagcatttcccgtctgttggttttgccctagttgccgaggattatgatgagaggagatcgcctgcatgtcaatggacctctggcaaggcactacccgtgtcgacgtatcgtaggcgtctggacagactgacccttgatgttatggggtcccttgacgatcattcactgaccggagagaattgtacgatagtttggcaaccggtggcgacaacaacacctgatgaagcagatgttgatgtgcatcatcctggacatgcagtggatgattatgtagcaattgttgacaagttggacagactactgaatctgaggatcttgatcgaaggaatagaagtctatactgttactgaagaatgtctgagcatcacaagaagctacattggctaa

SEQ ID NO: 20062 - DNA, 201 bp, Glycine max
  Peptide Sequence Number=SeqID_111747
atgagatcaaacacaaatattagtgttagaggaagggcctcatttttattaatagcttgcgaaaggagtggtcgactgactaaagatgagaagattgttgttgttgatatgacaaagtccatggtgaagccaagaaatattcttttaacgttgaaggagcacaatgccaacagttgtacaacaatcaaggggatcctctag

SEQ ID NO: 20063 - DNA, 267 bp, Glycine max
  Peptide Sequence Number=SeqID_111748
atggcatgggctcagagcgaaggcacgacaatgtcgctcataggacagcacaacagaggcgtgagagttgcagtgtttgtggtggttacaaccaatcttatcaaactcgagagtttacgtaaactcatgagagttccaaagactcgacttgtagattcaactcgtagactcagagcgagagttagactgaggagtcgttgtgccttcgtcgagagtcatagtgagagcaagaacgagaacgagagcgagagtgagagtgagagatga

SEQ ID NO: 20064 - DNA, 930 bp, Glycine max
  Peptide Sequence Number=SeqID_111749
atgccagggctgagacagggcagtgtcgtggaccctatgtacgcctgcaatggatacgtgatatgtattagcgccgatgccagtgcaacccatgttcatgttatgtttttggaggcccttcgtgacctcagtcagaccgggaggtacgcctggggagttgctgcgttggtccatatgtacgaccacctgaacgatgcttcagtcaccaacagccgacagcttggcggttacatcacgctgctacagtgctggatatacgagcactttccctcagtcgcggagtctactgctgatccggactacgatgaggattcaccgcgtgcctgtaggtggattgctacgaagaagatcgtcaagagcatacgtacactgacgtatagggagcacctggaccgactccagattctggatgtctgttggatcccaaatggggagcatcgatcgatccgggacttccatttgatttcatgctattccggtctcctgtactgggggcccgttgccgtgtactactggccaaagagggttatgcgacagtttggatacacccagaccattcctgctccgcctgtcaattcatgggtgtcatatgatgatatacacgacaggtggatgcactatttggagcatatggttacagcagctgaggcatcagatcctctgccagatcatcatgctctgcagcctccagtcgttcctccgaagccaggagcaccatcgacatctactgtggacgagcctagacatgcagtggaagtttgtagtgacattgttgagaggttaaagcgtcatctgagccttggggtggtcacgccaggctcatccacacatgacgtgatcgaagaatgcatcaggatggccaggagtgtgacacaggatcagctagtatatgttaggtctcgacataggcagcgcacgtatcaggcgtag

SEQ ID NO: 20065 - DNA, 915 bp, Glycine max
  Peptide Sequence Number=SeqID_111750
atggctacaccacttagctcccttcctcctcctcctgagtcagcaacaccttcgtcacctgcgttaaagaagacaagaaaaacaacacagctcaaaccattgactactagaccagttggggcagaaagaccagtggttcatgaggatcctgccactaggaaagccgatggtccccatagaaagaaattaagaacgtatttgaggattgtcgctcgcgataagagccgtagagatctttcatgggaggatgttcaaaagaaggcacatgccattcagaaacaaaacattgcctctcacgtgttgtctcgtaagggttatgattatctagaacaaaagggaagctttattgcccatggacatctggatgtattgactactgccattggacgaccagaacaccctcgcagtgtccatgctgctggagtcgatgtcatgatcaaacaatactttggaatgacttcaaggagatcccgcacatctatgtccatggctcccaaagacctggagcatatgacacaaaaaatcaaggaccatctggaggagttgatcacatacaaaatgcaatcgcaaatgcaatcacaaggactcgcattgcctcctgagcctaaggttggtccttctgctgcttgtgtcagcacaaaggaaagttgtgttgatccctcagggcaggacccagacacagactctgagagtttgactatcatccacaacatccctatgggcaatgatcaagtcaaggtcggtgttaatgaagttcaagatgccgatgctcgcgataaacagtgttctaagggatcgacgaaacttgcagataggccggatccttatgtcgatccccaatacttgatgacattgaccatcccgcagcttttcctcaagcctttgctggtgtcgtgggatgttattgtgtttggg

SEQ ID NO: 20066 - DNA, 344 bp, Glycine max
  Peptide Sequence Number=SeqID_111751
atggatgatccattcatctataggtcgagcccaattacttcctatgggttagatgtcaatcgacaagggccatatggtgcatggcacaagagttggattattgattcatggaaacgcggagatgaagttctacatatcaacgaaggggataaagagagtgacgatatcgaacggcgagggaaagggatcggcgaagacgacggcggtggcggccggcgccggtcgccggatatcggctcggacggtgtttccggtgatggtggtgctcgggatcgtgctgccgtttctgttcgtgaggatcgcgatcttgatgctggaatctgctgcggcgtgttcctcattgg

SEQ ID NO: 20067 - DNA, 225 bp, Glycine max
  Peptide Sequence Number=SeqID_111752
atgtatttggccactggtaatcgattacatcctctgtattgtcttgaatttttaatcttgaaaagcccatttgcatcaattgcaacacatcatcatgatcatcatcaaaacatcaaagccttgcatctacattgtgactcttcagacttgaaatttgaatttttgtgtctgatctaccgttgggcaggggcgtggtggtggccaacgccgttgaacaagagctag

SEQ ID NO: 20068 - DNA, 549 bp, Glycine max
  Peptide Sequence Number=SeqID_111753
atggaactgattgagaacatgacaactagtgaccatgctatcttgcgtgacagaacacacattcccacaaaaagaagtctgttagagctttcatcacaagatgctctattggcacagaataagctattagctaaacaacttgaatcactcacggtgaccttaagcaaattgccaacacagttacaagcagctcaaccaactcattcaggagttatgcaaattgaaggttgtagtatatgtggaggggctcacgaatctggtggttgtatggctcaagatgatgcatttaaagaagttaattatatggcaaatcataacaggaaaggatttcacacaggtggtttttcaggatatcaacagggaggaaactttaatcataatcaaggacagggctggaggtcacatctaggaaatcagttcaacaaagaccaaggaggttcttctaatcgacctcttaaccaagggccgaacttgtatgatcgaaccaccaaggtggaggacatactgactcaacaattaaaaacctggaaatccaagtgggacatgtaa

SEQ ID NO: 20069 - DNA, 213 bp, Glycine max
  Peptide Sequence Number=SeqID_111754
atggatcccatcacaatactcgtcgtgcaaaactcgtcgcccttaaagggtgttacgagagagctacggtgcaaagggttttactctaagctcagacatgattttgaaattcccaacgatgagaatcctcggaattgggttgggaacagggtgctcaaatttcacgacgatccaacggtgaatgaattcgagatcgtcatttttatgagatag

SEQ ID NO: 20070 - DNA, 1017 bp, Glycine max
  Peptide Sequence Number=SeqID_111755
atggcttctaaaaagagacgtgcctcgtcttccaagccccaagagccatatgacacgtctagatttgtgtccgaaatcgcttgggagcaatatgagaccaatgttcatcacaggaacatcctcctagagcggaacatagagctaacatacccatattatgatgaattccttcgagaattagagcgacaccagtggcacaagaaccttacaaggcagatggagaatcatattgacctggctttggtcaaggagttctactctaacttgtatgacccaaaagaccaatcccctaggcagtgcaagaccccaatggtgctcgagcctgggaagaggtactcatcatattcccgctactgccatactcacccggaccatcaggatattgcaaccaaattatctataccaggcagggggtttgttcttaatgctgagggggctccttggaagctgttgaggaaggacctaaccactatcgctcagacatggagtgtcctttcttactccagccttgctcctacttctcacacctctgaccttaacatggatagagcaaggttggtatatggcttggtcatgcagatggacatggacttgggctctatcatttcaggccagatatctcagattgcctacccgaccattaatttggcatatattaggaagaactgttggaaccctgaggattcttctatcgcatttctagggtcctgcaaggccaaggcccgggctccttcagacgttccagttacagcaccggctccagcccctacacctccaacacctattccagctccagcctggccctccgtacccaacagtgatccgattatgagcatggaggagtatttagcacaggctgttgagggcactctagagggtaaggaggccgctgaggacaccccagaagctgaggaggcttcaggcgcagcagatgtagacattgatgatgattatgtagcaaatgccactgcaacgcaggggacttgggatccatggcccacaccagctcaggattga

SEQ ID NO: 20071 - DNA, 216 bp, Glycine max
  Peptide Sequence Number=SeqID_111756
atgaatcctccaagatttgagacccctacaccgagtccaccagatacgcataaacggattttgttgtgtatattcctgaattttccaattgccaccaccatgaatcctccaagatttgagacccctacacagaagaaatacttaaaaaaagaggaagtgagttttgccgcaaatggtataactgcagctggattgagagctttttcattagcataa

SEQ ID NO: 20072 - DNA, 291 bp, Glycine max
  Peptide Sequence Number=SeqID_111757
atgcaaccactcaattccatcgccaacggtaaccctaacaataaaataatcataataacaaaacaaaagaaaggaaggaaacgtcgtaccgtgaggaagaataggtttgattcggtgtgtggtgcgtgcaaagaacgaaaaaggggtttggaagaaaaccctaatcgaaaggtgaaagaaggaggaagaagaagaagaggaagaggaagaagaagtggaacactaagaggagagcaatgtggtcacacaggcgtagcagcttcctactcttctgctcttgttgaaagttaa

SEQ ID NO: 20073 - DNA, 315 bp, Glycine max
  Peptide Sequence Number=SeqID_111758
atggaagaccaaaccattgaagacattgataaggtggagaagtctacacccaaggaagacaatggtgtggctgattttaaactagttcaaccgcctattcagaatcagaatactgatgttcagaatgatgttggtgtccagcaacctgaagatgaggtagatgtttttgctgatgatgatgatgaagaggagcatgacatgtcacaagatgaaaatcttgaggccatggaaagtgaagaaaagacaaagtggctggatgcaatgaagtttgaagcttgttgtgagatcgtcgatttggcggtcacccccacatag

SEQ ID NO: 20074 - DNA, 282 bp, Glycine max
  Peptide Sequence Number=SeqID_111759
atgttctttcctgcgttatcccctgattctgtggataaccgtattaccgcctttgactggcacgacaggtttcccgactggaaagcgggcagtgagcgcaacgcaattaatgaggttcatgtagatttaggtcgaggggggtggtcgactggttcgcctatgggtttcaggtcgctggcggcaccatgcaatggtctgggcaggggtaatggtgatgcatatgcaagtattggtgattgggacatggtggttgttattgttttgggaaaggagaaaggatag

SEQ ID NO: 20075 - DNA, 195 bp, Glycine max
  Peptide Sequence Number=SeqID_111760
atggcagagccatcaaagaagagaaagggatcatcctccaccgcttctgctgctgcccatcgccaccacggcccatccggagcacccacagcacctattccttcttctttgtcatctccaagatcatcaacattgttttcatccgatgatcaacgtctacggtggttgtcatcatcaaaaaggaggagaatgtaa

SEQ ID NO: 20076 - DNA, 924 bp, Glycine max
  Peptide Sequence Number=SeqID_111761
atggagttcttctcaaatgagaattttgaatgcttccaagcatttgaaaactccaatcttattccattcatgtctccgaaattacctgtctattctgagttagtcaaagctttttattcaaatttagaaattcatgacgatgttctaatgtctgaaatctatgggattaagatggtcattgaccaatccctattctatgatttaacaaaattgcctagtgaaggtgtgccttttgagggtgcactgattgatgaatggaaattcgatttctctgtgcatgatgcccgccggttggtttgcaccaaccaagcggatatgaccggaagacttcttgccggttcattggcttttgaatgtcgcatcctccattaccttatagtttgcattttgcttcctagatcttcaaaccttgcccaggtttctaaagaagatctcattgtcatgtgggcctttcataaaggtttacaaattgattgggcacatcttgttagatatcgcatgcataaggcattgggattgaatgccccattgccttatcctcaccttgttaccctctttcttcaacatttcaatatccctcttgattctgaaccttatgttccaatcaagagatcattccttataggcgcttcagtcatagcatcctttggttatattaaggagcatgatggatcatgggtaaagaagggtgctagaaatattagtgaagaaggacatgagggagaagattcatctcttctttcgaagattttggaaaggtttgatggtcttcaaacctttgttggtgagaggtttgatactttggaactgcaagtagatatgcgcttcaatgaaatggagtcaagaatgactagagttgaagaagatgtatcttatatccggtcaagctttgatcttccaccaccgtcgccaccatcatcttag

SEQ ID NO: 20077 - DNA, 297 bp, Glycine max
  Peptide Sequence Number=SeqID_111762
atggtttcttctatatatacccttatgtgtgttcttcattccacaatagctcttacttgtggagctttgatgatattctactccaaagagatctctgtgcttggccatagatccgagaccgcaagcaagcttcaagggacaacaccccatgatcagcttctgattgacacctctgattccttctctggcttgttgttgttcacaataggattccttctcttgatgaggaagcttggggatcttgcacatgaatggcctaggcatgctgttggggacatagcattggcaatttcatag

SEQ ID NO: 20078 - DNA, 183 bp, Glycine max
  Peptide Sequence Number=SeqID_111763
atgacttacatgtacgacgacctaagacacgctttccacgggcaaacggcgcgaggtcagtatgagggagacagtcttcacgacgcgagctccactgcttcacgccgaggtttcaaggagagaggggaaaggcaaatctgttatgatacaccttatccaaaaatggtggcgggaacattgtag

SEQ ID NO: 20079 - DNA, 534 bp, Glycine max
  Peptide Sequence Number=SeqID_111764
atgatgcatcgcaagaatgttcataagtgcttaaaatgggataaaagtagagctggatatttggacttgccctcgggctatccaactttttcttcttatacccagcatttttcttgtcattatgaatttgcaatccgtaagaccattacgagttcgcaatctgtaaggccatggacctccgcggcaaggttgacgctgacaaagtatgcggctggtggtgacctcgcgcacgccatgcccactccttccccctccttggccagcgccaccatgaggatatcaatagcctcaagcgacaccggcacggagatgccgctgggagggaccaaagggagggcgatggccatgaaggaggtggtagtgctacgtcgcatcggaggttggagcgaagcgcagtggcgaggttggagcgaagggcaatggcggtggagaggaggtggtggtgttgcgacgtggcaaaggtggcgtagcaaagttggtgaggaggaggtggggaaggtattgaccttacggattcgccattacggattgtga

SEQ ID NO: 20080 - DNA, 306 bp, Glycine max
  Peptide Sequence Number=SeqID_111765
atggacaaaaataagtggatatatgacatcataatgtctaaggaagataatatgaatgaagaaaatggagaggaacctagtgtgtttgaaaatattgattgctcttatgtcttccatacttctaaggtgtttgctacccgtgattatgttttgcattgggcttgcactgttacgtatgatattggttttgtggcggtgattatgaagttagacacaaatactgaaaataaaggaagaatatcatatgttttaattggttgtgaaaggagtggaagatatagggcatacaggaaaaatttagtatga

SEQ ID NO: 20081 - DNA, 306 bp, Glycine max
  Peptide Sequence Number=SeqID_111766
atgtatcagtatcctttcgaaggtcatcaaactaatgcttctgcaagcaaatattcgttggatggtgttgtggaaacacatcctgatttttcatgtcctactatgaccccttcacagcaatatgatgtcccaatttcaacacttaatcctccattaggtacgcaatgggatgtacccggagcaatacctgatatgagtgatttattaggtgttgatttacgtcatcaattttctgctaaggctgaccaagttgaagtgaggagacatcggggcagcagaaatcttgataggcaagcacgaagatga

SEQ ID NO: 20082 - DNA, 453 bp, Glycine max
  Peptide Sequence Number=SeqID_111767
atggccaagagaaaatctgtcgacgaaaccacaactttctcgaaaaaagcacatcaatatcaaaatacaccacaaacagccattcaaaagaggaaccaaccccaactccaaaaccatacaaagaatgcaaaaggacaaaatttgacgaaaacctacttcaagaaatccgaaaaggaagaggaaaagcagcatcagcagtaccttcttgaagtcagaggctctgacagtgccatctggggtgacttcgatctggtacttcttgccggtcctctcgtcgacgacggtgacagtacccttcaggttcaccggcggagaggatccggcgggggcggagaggcggtgggggcggaggatcgcggtggcggaggcggcgtcggagggaagcaagtgagctgcgagggtggccaaacggttgcgtgcagtttgttcggaagaagaagttgttgtttttga

SEQ ID NO: 20083 - DNA, 1254 bp, Glycine max
  Peptide Sequence Number=SeqID_111768
atggatcgagaggaaaacctacatggtgggaaacgaatcaatgtccagggacgggtcaacactcttgctgatgaagataactggactacggtggttactagaagatcagcgaaggccatgaagaagcaatcactaacgggaagacaatcaaagaacttggaatcaggcggacactctaaacactacagccttaactggaggaactatgctgatatcacttccttctatttcactcattttcctgaagaagttaacgaagagctgctatggggctattttaaaaagtggggcgatgttcgtgaagtatatattgctaaaaggctcaacaaggaaggtaggagatatggcttcgtgcggtttaagggagtgtcgggcgtaaaaggcttggaggtgagactggataacatcttcatcaatgactgtaaattgttcgtcaacctacctaggttcgagaggccagcaatgaaaaaagacttgcaacagaagagctccaatgggaggaagtcttttgacggacctagtaagcattgtggggcaactactggacctccgaggagatcatatgcggacataacgactaacggggcgtatacaggaggcacaaagagagaggaggcaacaataacaaccattctgatcaacccagaagaagatagggggtactggtgcaaggaggcctgggttggcaagttaaagaaagtgatggaggtggggaccttagaggatcgtatagcttgggagttagggtacaatacacgcactaagttcctcgaagatgatatggtccttcttcctgggatgcctgatcagaaagcccagcacatcattcgttcggagatggaatccggaaattccctcttctactctctggagaagtggacgccagactgcaggcccaacaacagggttatttggcttcaggtgtggggattcccgattcaggtgtgggaactggaccatctcagaaaagctgtagctactatcggcgatgtcattgagctagatgacgacacagaagacagatatcgactggaccgggctaggctgttggtgcggacacctcttccgccatcgataaggacagaggttcacattcatgtgggggacctagagtatcgggtatggattgtggaagagatggggctcgaagtcgggttgacccggaaagcaaactcgccgtctgagggatggtcggaggagatattatcggacgacgtcatagacgacggcgacactagctcttccttctcatag

SEQ ID NO: 20084 - DNA, 1308 bp, Glycine max
  Peptide Sequence Number=SeqID_111769
atgggtcatgttgaggacaacatgaccgtactcggatgtgtgacattgattctgatttttggctctagaaaaacatggtccgaaatcctatccatccgccacgtcctcctctcccgccgcgcctccgccgctgatctcgtcctctcccacctcgcgcgcctccgcctcaccgagccccacctccccgacgacgacgtcctcctctcccacgcgcgccgcctcgacgcccaaatcgccgccggagaggaccccggccccttcgccggcgtgctcgtgggcgtcaaggacaacatctgcaccgccgacatgccgtcgacggccgggtcgcgcatcctggaggggtacagggcgccgttcgacgccaccgcggtgaagagagtgagggagttgggaggggttgttgttgggaaaaccaatatggatgagtttggaatgggtagcaccactgaagcttctgcatttcaggtgactgccaacccatgggatgagtctagggtgccaggaggatcatcaggtggatcagcagctgcagtttctgccagacagtttgttgtatcattgggaagtgacactggtggaagtgtgaggcagccagcatctttttgtggtgttgtaggtttgaagccaacatatgggcgtgtctcaagatttggacttatggcgtatgcatcatcacttgatgccattggctgctttggttcatcggttgctgatactgggattctccttcatgcaattgctggccatgatagatttgatgccacctcaagtaagcagggactgagagttggtctgatctgtgaaactattgatgatggcattgatgctggagtaatttctgcaattcgtgctgctgctttgcattttgaggaattaggatgctctgtgaatgaggtatcactgccatcgttttcccttgggttgccagcctattatattcttgctgtgtctgaatcatcttccaacttgtcacgctatgatggtatcagatatggaaaccaagtttatgctgatgagctagattctctttatggaggttcccgagctaaagggtttggttctgaggtcaaaatgagaattttgatgggaacatattctctttcagctggttactatgatgcgtattacaaacgtgcacagcaggtaaggaccataattaggaatagctttaaggaggcactcaatcaaaatgacatcttgatttcccctgcagctccttcagctgcttataaaattggtgaaaagaaaaatagtcctttggctatgtatgcaggcgacatcatgactgtgagcatttcattcttctag

SEQ ID NO: 20085 - DNA, 102 bp, Glycine max
  Peptide Sequence Number=SeqID_111770
atggagattctggcttccatccttatgttgctattcttgctcgtatttttgtctcaggactgggtcattgtcttgaagcataccttccatgaagttatttag

SEQ ID NO: 20086 - DNA, 1791 bp, Glycine max
  Peptide Sequence Number=SeqID_111771
atggcaattccattcaagacaaaagatgtcaacgaggaagtaacctctaaagacattaaaagcctaatggaacaggcaaattataccaataaatacttacaagctttaggagaaaccattaaaactaaggtagttcctaaacaaaaatcaattgaggaagcttcgccaagtgtccccattgaaaaaactttattcaaacctttcaaagttagtgagaaggctaaacgaaaaattagggaacttagaaaaactaaatccttaattgaaggcgtaggtgacaatcatagcgaattactaaacaagattggttgtttgcttaaggtcattccagatactccccaagcttcggaaaatacttccaaaatggtaacaagaagtacctccaaattaattaatgttattaatgaagatagtgaccaaaattcagataacacaactgagataggatcagtgtcagaaaagaatataaatccattaaactccaaacactggaaaaccccctccaaattatattatcaacgtccaactgcccctgaccttctattagaagaaagaggtgaaaacaatttcaaaagttttagtgcaaataacatctatgaatggaacatagatgcacaaacggagtataacatcatgaatacactccaacatatgaccatggagaaatcaaaaatttacagcgcagttaagacggatctcaatggaaaagtcattactaatgacgatgataaagagattcctgacgctgttaacacgttaatttttacaatagcccaacatttcattggagacccatccttgtggaaagacatgtctgtagaattattatcaaatcttaagtgtagaaccttagcagattttaggtggtataaagatactttcctaactagggtttacataagagaagatagtcaacaacctttttggaaagaaaaatttctagccggtcttcccagatcattaggagacaaagttagagataaaatccgtagtcaatctgtcaatggagacattccatatgaaaatttaagctatggtcaattaatttcctatgtccaaaaggtagccttaaaaatctgccaggacgacaagattcagaggcaattagccaaagaaaaagctcaaacaaagagggatttaggttccttctgcaaacaatttggcttaccagcctgtccaaaacaaaagaaaaaacgaacctctaggaaagaagcccaggatcataagccagccaatagaagaagattttcaaaacgaagatactctcaaaaaccctcaaccagtagagaaatggaaaatcctaaacaaaaaataaaaccaaaaataacgtgctacaattgtggaaaacatggccacattagcaaatattgtagactaaaaaagaagttaagaaaccttaacctagaaccctcaattgaagagcaaataaacaatttgctcatagaaacctcggaggaggaaacagaaacagaaacttcatcctccgtgctttccgatgaaaacctaaacctaatccaacaagatgaccaactatcatcaacagatgatgatgggcaaatcaatactctaacgagagaacaagatctcttgtttgaagcaatcaattccatacctaacccccaggaaaagaaggttttcctggaaaaactcaagaaaacattagaggtaaaacctagacaaaaggattttatcacgaacaacaaatttgatgctctgataccagagatcagcgataatgaaagatgggaagtaagatcagcggatgaagtaggaatcctagaaatttgttaa

SEQ ID NO: 20087 - DNA, 1536 bp, Glycine max
  Peptide Sequence Number=SeqID_111772
atggcaactctttttgctactttttatttgaaggttttagagacgagagatgtagatgaactggttttggcaaactggaagtctcagggagtcacgggtagcatgtctatgcttgaagacaatgaggtgttattttttatgattcaggttggaagctatgtctctaagtggatcactataaagaatcctagtcaacatccaatggtgatgcagcttatcttgaattcaagagaaataattaatgagtgtagggatttagatgatttattacacccttcttcatctagtaatttggttctagatgaaggtgctacttcagaaaagtatggattctctattccagagaatgcactaacagaggcttatgtgcaccctcatgatcatggatatggagggttgctttctctagttttgctcgagaggtctgagcatgttgacaatgtagattttgatcttaaaatgcctaagacactcaacttttctcttccatataccttacttcacatgaaagagataagttctgcttgttcacaacatttagtgaaagagttatatgccaaaaacactggagacttgccattggaggttaaaagtatcagagtttctgggagagagtgcgggttggatggttttaagattctttcatgtaaggcttttgctattgagcctggggaatcaactaaacttttgatatcatatcaaactgatttttctacagctgtggtgcatcaagatcttgaactcatattggctactagtatttttctgttacctatgaaagcaagtttcccttattatatgctaagtagctacaagagatccattggtgataacttgatccacaccaccataaaaagtgttgagaaaacccttatgctacatcatgaccagagaaagagtaagctctctatgtctaatgagatgaatcatctaatagaggcctctagtggaaaatattcctatgttcaaggcaatccatttgaactggaaatatctcaacagttgacacacaaatttgaaaatcatgaacagactagtcatgcattggatattcaaagtgaaagaaaattatcatcctcaacagttcagaactctgacccaatggaagcatctcagttgggttatctcacggtcaaaactggtaaagagaagggtagaagaagaaagaggaagagtcttggtgccaaattagtggcattttctgaagtttcaagtagtcaaagtggtaattctacacccttgtctcctttatcccatactccttctactacacctaaatgtaactggccaatgtctccggacgaagagcaaccccctaaggctcctagttcaatgacacaggtggctacccaacattctgccaatgatcaagcttctgccactgttgttgtgtcaaatatattgaagcctgcttctacacaaaggtgcactaatagtaaagtatcacattcagctgcaagaagtgctactagttttctcaagtaccacaaatattgttttatgacaaagacatcaatagttttcacacatctatga

SEQ ID NO: 20088 - DNA, 603 bp, Glycine max
  Peptide Sequence Number=SeqID_111773
atgtttgtcgaagttttgttgaacattcagtctcagtgcaaggctgatcataggacatatgtgcatttgctttacagccaagtgggactttgggtatttggaggacttcttaacattgatgctgtatctgctgcaattcttggattatctgtacttcttgtcactggggttgtaacatggaaggagtgcttagctgaaggagttgcttgggataccctcacatggtttgctgccctcatagcaatggctggctacctgaacaaatatggtctcatttcttggttcagtcaaactgttgtcaagtttgtcggtggattgggtctatcatggcaattatcttttggaattctagtccttctatacttttactctcattacttctttgcgagtggagctgctcatattggtgccatgtttactgcatttttgtctgtggccactgctctggggactccgccattctttggagccatagtgctgtccttcctctccaaccttatgggtggccttactcattatggaattggatcagctcctgtgtttttcggtgccaactatgttccccttgctaaatggtggggctatggattcctcattagtatt

SEQ ID NO: 20089 - DNA, 873 bp, Glycine max
  Peptide Sequence Number=SeqID_111774
atggctattaactcatcgataccttttcagcatcagttcctccatgacgaacggggcgaacatattcttccaccaataccaataccatcacgtgaccccaatcacaccaactgcaacaacaacaacaacaacattagcggacatgatttaaagccaccggagctgctcattcccgtcccaaatatgcctcacttcatgcctcaagacaacaccaaattcgattcctcaagcattggttctgaccatctggaatcgctatgggattcagttagttcgccccagtcaacgctctcgtcaactttgatctcaattcagggtagttctgaagattcttctcaggaaccatcgcctaatagctatgacttttgttggaacagcacctacgatgtggtggagatgttagagaagatgaagcttgacgaaagggacagttccaaatacaatcctggttatgggaatcacaggttggagatctcaaacgttggagcctgctctctccttcatgaacaaattcaagcaattcaattgtctcgggtcaggcaagagcagattctgtctgagaagcataaactaactgcatacagaggaaaaaatcatgggcagatatcacagcaatttcagaagaaagttaaagggattgatgatgggtgtgataaaggatggaggactcgtccaccgtggcacaatcgttcacaccagcaagctggttcaagaggcaagtcttgtggaactggtgttttcttgccatgtggcagaacaagtgcaccgttggagtcacgtaagagaccaggtagtgtttcggtcgctttaagaatttggcgctgcttcatcatttcctataattgtttgttcgctggtcgtcgacttaggtga

SEQ ID NO: 20090 - DNA, 183 bp, Glycine max
  Peptide Sequence Number=SeqID_111775
atgccttcagttcaccatgtcaaatgtcccacaagaatggcagacactcctccatcaatacaaataatctggccagtgatgtatgatgatgctggtaagcagagaaaggcaacaagagaagagacttctgctggatctcctaggcgccttagtggggttctggagtacacttcttccagatag

SEQ ID NO: 20091 - DNA, 348 bp, Glycine max
  Peptide Sequence Number=SeqID_111776
atggaaactagtcaagctcaaacccttatggattaccttacccctaccttgggggataccaatcccatcttactgcccgagctgctaaaagaagtcatttttgacttcaagtatgagttcttacaaatgctggagaacaacctctttagtagtgctacccatgaagatcctatgcatgggactggttatgctcactacctgagaacaacatcacctcatggaaccagtgcacaaggtaacctcatgttaaaaccccctattgatgccatcgagatcattgaggatatgtgctctaatccctgtaacaactcaggggatatgaggattatgaaaagaggcgttaactag

SEQ ID NO: 20092 - DNA, 1452 bp, Glycine max
  Peptide Sequence Number=SeqID_111777
atggcatcaacttctctcttcaacttcagactccctctgttcaacttcaacccactgcaccatcgacggataaagaggccaaaatctctgctctcctctcctcgcaacagtccacgcctcgtttcttccattaacgaccatttggcgctcacacgtgtcacatatccgcttctccaatctcactctgctccgaagcgcagattccacgttggtgtacagaaagagtattctgatggggaaagctctgagtcgattgtttctgacgctacataccaagaggaattttcctggtcttctgtagttcttccgtttctattccccgcattgggtggcttgttatttggttatgatattggtgccacctctggcgctacaatctcactgcagtcacctgagcttagcggtatatcatggttcaatctttctgccattcagcttggactagtggttagtggttccctatacggggctcttcttggctcgcttgttgcatttgcgatagctgatttccttgggaggaagaaacaactcattactgcagcactgttgtatttgtttggtggtgtgattactgcctatgcaccagaacttggtgttctcttagcaggaaggctgatttatggacttggtataggtttgcttggttattttgtgggaagctttctgattgagacagttggaggatggcggttcatgtacggatttagtgctccagttgctgtattaatggggcttggaatgtggactctccccaattctccacggtggttgcttctcagagcagtgcaaggaaaaggttcttttcaagatttgaaggaacaggcaattgcttccctgagcaaattaaggggccgaccacctggtgacaaagaatctgagaagcaaatagaagagacccttgtctcattgaaatctgtctatgcagaccaggaatccgaggggaatttcttagaggtgtttcagggtcccaatctgaaagctttcataattggtggggggctagtcctatttcaacagagtgctggattttctgctgcatctgatgctacaaaagtttcagttgttattggcctattcaaggccctttctctagttctcctttctgcttattataaatttcttggaggttttccacttgttgctgttggagctttacttctttatgttggttgctaccagatatcatttgggccaataagttggctaatggtatcagaggtcttcccacttcgcactagaggcaaggggattagtctggctgttcttaccaacttcgcttcaaatgctgttgttacctttgcattctccccgctaaaggagtttctaggagctgaaaatctttttctcctttttggggctattgctactctatcacttttgttcattatcttttctgttccagagacaaaaggcatgagtttagaagatatagaatccaaaatcttgaagtga

SEQ ID NO: 20093 - DNA, 1086 bp, Glycine max
  Peptide Sequence Number=SeqID_111778
atgaatttggatacgcaacccggaacgccgtcgtattggtgctacagctgcactcgtttcgtgcacctctctgtccaagccaccatcgcctgcccccactgtcaaagcggtttcgtcgaagagatccgcgccggcgccgaagcctcgccacgccaccgtctaagtcctttccctgacgatcccctttctttccggcgacagggcttccgccgccgtaggagagaaggtgccggcaaccgctccccgttcaaccccgtcatcgtcctccgcggccccggcgacgactccgccgccgccgaccacgacggtgccagcacgttcgagctcttctacgacgacggcgatggcaccggcctccgccccctccctcccaccatgtcggagttcctcctcggctccggcttcgaccggttactggaacagtttgcgcagatggagatgaacggcttcggccggccggagaatccgccgacgtcgaaggcggcgatcgagtccatgccgacggtcgagatcggcgaaactcacgtcgaaaccgacgcgcactgcgccgtgtgcaaagaagtgtttgagctccacgcggaggcgcgtgagttgccgtgcaagcacatctaccactccgagtgcatcctcccgtggctctcgatgcggaactcgtgcccggtgtgccgccacgagcttccttccgatttggaaactagagttccgagccagatcgacgaggaagcgataggattaacgatttggaggcttccaggaggcggattcgccgtagggcgattctccggcggccggagaaccggggagagtcatttgccggtggtgtacacggagatggacggtggacttaacacaaatggtggtgctcctaggagaatttctcgttctgttagaagcaatagggttagggaaagtcgagggtttggtagagtttttcgcaatttcttttcattctttggaagaattggttctagaaactcttcttcttcttctgaacatgggtctgtgagtagaagccgtagtcacgtgagttcaatgttcaatagaagctcgcggagacatagcaggacttgggttatggatgattga

SEQ ID NO: 20094 - DNA, 396 bp, Glycine max
  Peptide Sequence Number=SeqID_111779
atggaggggttcttctgtgagaagctcctaggaatagtggttttggaagtggaggaactcttttgggataagctcctgatcaagagaggggagtttgaagaagaagaagaagaagagcctcttgttgagcaactccttgagaacaatgatgacttgctggatgatgtgcttgaacctgcttccttctttgacaccttccacttttcatccatgaaaaacaaaggaactgtaatatctacaactagctatgggacagagtgtgtgtgtgagagagagagagagagtgagaatggaaaagtttgtacaccaatattaccaatgctggaactttcgaaactgtatcacttcacaaaactagtgagtgtccaacttgctcaagatgctcttcttccctaa

SEQ ID NO: 20095 - DNA, 423 bp, Glycine max
  Peptide Sequence Number=SeqID_111780
atggcaacagctaccttacctaacacattcgaaactacttccaatgcaaatactgtgcatgatccattaccaataattgaaactaccttttacttattacagtatctatttcatgaagcacttaattttgttaatgctgacgtagaggagagatgttggcctattttactggtgttcaatagcatttttttccgccgaatggactcggacaagcacccccaaatcacaaatcaattaatgataattagaacaagcatacataagttgtcacctttgacagaggcaaacaaagtctggaacataaggaaaaagaagagaatcaaccctaaggttaataccatgtctagcgaaaacatcagcataggtaatagcctcacgtattacataagcaaaataaatattaacaaaactgctatctcttga

SEQ ID NO: 20096 - DNA, 396 bp, Glycine max
  Peptide Sequence Number=SeqID_111781
atggcaacagctaccttacctaacacattcgaaactacttccaatgcaaatactgtgcatgatccattaccaataattgaaactaccttttacttattacagtatctatttcatcaagcacttaattttgttaatgctgacgtagaggacagatgttggcctattttactggtgttcaatagcatttttttccgccgaatggactcggacaagcacccccaaatcacaaatcaattaatgataattagaacaagcatacataagttgtcacctttgacagaggcaaacaaagtctggaacataaggaaaaagaagagaatcaaccctaaggttaataccatgtctagcgaaaacatcagcataggtaatagcctcacgtattacataagcaaataa

SEQ ID NO: 20097 - DNA, 252 bp, Glycine max
  Peptide Sequence Number=SeqID_111782
atgcaaacaatcacggggaaaagctttcaggtccaggcaaacttggcaatgcagcaacagataataaatatgaagttctctgatcagtggaaaaaactaccagcaaattctagaaatgctgagaggaaatctgatacagacccaaatgttgttgggctaaatgagcccttgatccaagacgaggatggtaagaagaggtggggcagggtgtatgtgaggaagaaacctagaatgggtgacgtggcacactag

SEQ ID NO: 20098 - DNA, 2970 bp, Glycine max
  Peptide Sequence Number=SeqID_111783
atggatcctcatatcaagtccaatttcatcaatggcgttaaacccagccaagtgcccaacacggtcgatgcagaggatcacttctttgaccctgttaatgggatgatgaaaccctttgattttcgactcatggataacccatttcttattccgcctgatccaaatgctgctcaaaatcctttttccttgtccaatgatgaagactctccagtggatgagattgatttttctgccactgtcctacgctacataaaccaaatgcttatggaagaggacttggaggcaaagccgtgtatgttccatgattccttggctctccaagctgctgagaaatcattctatgaggtcattggtgagacatacccttcttcttcttcttcttcttccatccaaaactatcacaacgtggacagccctgatgaaagtagcttcagtggtacaacgactagcaccggtaactcgtttgggtcgcaatggaataacgtcgatcttgctgactacaagccttccatactgcaaaccacttttcctactgactttgttttccaggccagttcaatccaatcttcaatgaacaccacgagcaaatttgccgtaaccaatagtgaattcttggctagttccgcggctggatttttgggtccaggttcaacaaacttgtttagcaagagtgagtctgtactgcaatttgagaggggtgtggaggaagccaataagttcctgcctaaagggaatcctttggttattgacttggagaacccatcttttagaatggttcctcttcagcaggaggaaattaaggcggagagggatatagatgaaatttctgccgagtcaagaggaaggaagaatcacgagcgggaagatgaagaaacagatttacaagatgggagaagcaacaagcagtcagctgtgtacattgatgacagtgagatatcagaattgcttgataaggtcctgctaggcacgtggtgcagaaatgaaccagctccttcgtgtattggttacacagaccttcccagtggaccatccttgggtaaattagaagaaacaaacaagtctggtggtgggaagagccgtgttaagaaacaaggcaacaagaagggagttgtggatctgaggacattgttgattctatgcgcacaagctgtttcttcagatgatcatgtatctgctaatgagttattgaagcagataaagcaacatgcttctccactaggtgatgggactcagaggctggcccattgctttgcaaatgcccttgaagcacgcttggctggcaccggcactcagatttatactgctttatctcacaaaagaacctctgcagcggacatggtgaaagcttaccaaatgtatatttctgcctgtccattcaagaagctttcgatgatttttgcaaaccatacaattttgcagctagccaaggaagttgaaactcttcatattatagattttggcatccgttatggcttccagtggccagcttttatttatcgtttatcaaaacaacctggtgggcctcccaagctgcgtattacagggatagagctcccacaacctggtttcaggccagcagagagagtccaagagacagggcttcgacttgcaaggtattgtgatcgctttaatgttccatttgagttcaatgccattgcacagaaatgggaaaccatcaaaattgaggacttgaagataaaggaaaatgaacttcttgttgcgaatgctatgtttcgatttcaaaatctacttgatgagacagttgtggtgaatagtccccgagatgctgttttaaagttaataaggaaagcaaatcctgcaatctttttacatgctactgtcaatgggagctataatgctccattcttcgtgacacggttccgggaggccctttttcattattctactttgtttgatgtgcttgataccaatgttgctcgggaagatccaatgaggttgatgtttgagagagagttctttgggcggcaggtaatgaatattgtagcttgtgagggtagtgagagggttgagaggcctgagacatacaagcaatggcaggttaggaacatgagggctggatttaagcaattgcccttggataaacatctcattaacaaattaagatgcaagttgaaaggtgtgtaccacagtgatttcatgcttcttgaagatggcaattacatgctgcaagactcgtttggtggttttccaatcatcgatccttcttcactggaagacaacaacgacttctcagaaactgcaaagttcataatgattatgaaagcagctgccaaggcagaaaccgttcatgttattgattttggcatcctatatggtttccagtggccaaatcttgttaagtttttgtctgatagggagggtggacctcccaaacttaggattacagggatagagtttcccaacatggctttcgccccacagaaagaattgaggaaacgggtcgccacctggctaactattagctacgacatagttgctgtgaactgtcactggaggtttgaacatttactggacgagtataccattgaaaacagccctagaaatgctctctttcattattctgctacttatgatttgattggcacagtcctacctcgtgaaaacgaatggaggttgatgattgagagagaacttttgggcagggagattatgaatataacaactggttgcttcaaggttggaagtgccgcattttgtttgcttccacttgttgggtgccagcataatgagaagctactggactcgcttcgaggtatagtcccactagcacttgctgatcacttgagtcttgagatatttcagcatgttgcaatggtgaagcttgttttgctggttatattgtttgatgttctggtacctacttgcttaaccttcagctgctgcggtgaagattgtaccaagctttacatcaagttactccgtaaaattatggcacgacttttcgggtag

SEQ ID NO: 20099 - DNA, 1380 bp, Glycine max
  Peptide Sequence Number=SeqID_111784
atgggtagcccctcgaagaagaatgaaagtaaggggtttttcgccgccatgtcttccatgttcaccagcgctgtgaaccgatcagtcaacgggcttagtgtagaagtcataaatccagagggaggtaaagaagatgcagaggaggaagctcagagaggaagatggaaacaggaggaaagagatggttactggaagatgatgcagaagtatattggctcggatgtaacatcaatggtgacattacctgttattatatttgaaccaatgactatgattcagaaaattgctgagttgatggagtactcctacttgttagatcaagcagatgaatcagaggatccatacatgcggttagtttatgcaacatcatgggctatatcggtgtactttgcataccaacgaacctggaagccttttaatcctatccttggagagacttatgaaatggttaaccatggtggaattacatttcttgctgaacaggtgacttgggacttagctcacaacaaagtgagtcatcatcccccaatgagtgctgcgcatgccgagaatgagcattttacatatgatgtgacttcaaagttgaaaactaagtttttgggaaactctgttgatgtttaccctgttggaagaacacgtgtgacccttaagagagatggtgttgtcttagatttggtgccacctcctacaaaggttaacaacctcatatttggccgaacttggattgattcacctggggaaatgataatgacaaatttgacaactggagacaaagctgtactatattttcaaccatgtggatggtttggtgctggtcgatatgaagtggatggatatatttataattcttcagaggagcctaaaatattaatgacagggaagtggaatgagtcaatgagttatcaaccctgtgattcagaaggagagcctcttccaaacacagaattgaaagaggtttggcatgttgctgatgttccccagaatgacaaatttcagtatacacattttgctcataaaataaacagctttgacactgcccctagaaagttgttggcatcagattctcgactacgcccagatagatatgcactcgagatgggcgatctgtcaaaatctgggacagaaaagagcagtttggaggaaaggcagcgtgctgaaaagagaagccgagaggagaaagggcatagcttcacaccaagatggtttgatttaactgaagaagtgacatcaactccttggggtgatttggaaatctatcaatataatggtaaatacagtgaacatcgagctgctgcagataactcaggaagcattgatgatgttgatgctaaatcaattgaattcaatccatggcagtatggtaatttggccacggaatga

SEQ ID NO: 20100 - DNA, 96 bp, Glycine max
  Peptide Sequence Number=SeqID_111785
atggtgcacactcccaatgctcagaacgtgtatgtggccccaactttctcccaccacatccactataaaaatcacgtcaacatggccacactataa

SEQ ID NO: 20101 - DNA, 1653 bp, Glycine max
  Peptide Sequence Number=SeqID_111786
atgaacaacaactggctttcgttccctctttctcctactcattcttccttaccagctcatgatcttcaagcaactcaatatcatcaattttcccttgggttagtgaacgagaacatggataaccctttccaaaatcatgattggaatctgattaacacccatagtagcaacgaaattccaaaagtggctgattttctaggagtgagcaagtctgaaaatcagtcagaccttgcagccttaaacgaaattcattcaaatgattcagattatctgttcacaaacaacagtctggtgcctatgcaaaaccctgtgttggacacacctagcaatgagtatcaagaaaatgctaatagtaatttgcaatcattgacattatccatgggaagtggtaaggattcaacatgtgaaaccagtggtgaaaatagcacaaacactactgttgaagttgcacctagaagaactttggatacattcgggcagagaacatccatatatcgtggagtaactcgacatagatggactggaaggtatgaagctcatctttgggataatagctgtagaagggaaggccaatcaagaaaaggacgccaaggtggatatgataaagaagagaaagcagctagagcttatgatttagctgcactgaagtactgggggacatccaccactaccaactttccaattagcaactatgagaaggaattggatgaaatgaaacacatgacgagacaagaatttgttgccgccattagaaggaaaagcagtggtttctccaggggtgcatcaatgtatcgtggagttacaaggcatcaccaacacggaagatggcaagcaaggattggcagagttgcaggaaacaaagatctttacttgggaactttcagtactgaggaagaggctgcagaagcatacgacatagcagcgataaagttcagaggtctcaacgctgtcacaaactttgacatgagccgctacgacgtgaaagccattcttgaaagcaacactctcccaataggaggaggcgctgcaaagcgtctgaaagaagctcaagctctagaatcttcgagaaaacgcgaagagatgattgcactaggctcatcttccacgttccaatacggaacctcagcaagctcttctaggcttcacgcttaccctctaatgcagcaccaccaccagttcgagcaacctcaacctctgctaactcttcaaaaccacgacataagttcttctcacttctctcaccagcaagaccctttgcatcatcagggttacatccaaacgcagcttcagttgcaccagcagagtggcgcttcttcttatagctttcagaataatgctcagttctacaatggttaccttcagaaccaccctgcattgcttcagggaatgatgaacatggggtcttcttcttcttcctcatctgtgttggagaataataatagtaacaataataataataatgttggtgggtttgtgggaagtgggtttggtatggcttcgaatgcaacggcggggaacacggtggggacagcggaggagttagggctggtgaaggtggactatgacatgccggctggaggttacggtggctggtcggcggcggactccatgcagacgtcaaatggtggggtgttcacaatgtggaatgattaa

SEQ ID NO: 20102 - DNA, 246 bp, Glycine max
  Peptide Sequence Number=SeqID_111787
atggcatgcattagcaagagcagagcaatgttcttcttcatggctttctttgtggggcttctatttgctgcaggggtgagtgctcagaccagtgagttccctcaagcgccagcaccagcaccaacaatggacgctggagctggatttttggtgacttactctggagcatttgaaggggaagaaacacagctcatgtcacattttgggaaagaaaaggcagagagagagagagatgaactgatgtag

SEQ ID NO: 20103 - DNA, 75 bp, Glycine max
  Peptide Sequence Number=SeqID_111788
atggctcaacaggttgaaggaaggacatggcatctaggcttagagccactgaatgtaaggattgggaatggctag

SEQ ID NO: 20104 - DNA, 201 bp, Glycine max
  Peptide Sequence Number=SeqID_111789
atgagatcaaaatcgacaacgagcacatggaaactggtaatcaaaatcaaccaagaaatgggaatgaaaattccaatagatatcacgtcaaataattatattctattctataccaacgcaataagaggagtggatcgtttgatacaggctacggaggtttggatgacgccacttccggtgaaggaagataagtcagggtag

SEQ ID NO: 20105 - DNA, 549 bp, Glycine max
  Peptide Sequence Number=SeqID_111790
atgaatgcccaagtggagaaggatgaaggcccagaggcagagacactatcaagactattaattacttatcaaggtaatccttgtggcgtctacccagacttatcttccttaaccggaagtggcgtctacccagacttatcttccttcactggaagtggcgtctaccctgacttatcttccttcactggaagtggcgtcacatcagagacgctcgacattgaacaatggatgcaattgagcaattcaaatggtcataacaattcccttggaggtccgattcaggagcataatatatcgagatgcacgaaattgaacaacggaagctctcgagaaattcaaatgctcataacttttcacacggagagttccgattcaagcgcatcacatatagagacgctcgaaatggaacaacgtaagttctcgagaaattcaaatggtcataacttttcattcggaggttcgattcaggcgcataatatatcgagaccctcgaaattgagcaatggaagctctcgaaaaattacaatggtcacaactttgcactcagag

SEQ ID NO: 20106 - DNA, 426 bp, Glycine max
  Peptide Sequence Number=SeqID_111791
atggcttccatgcatgaaccagagattaaggaaaacaaattgaaagatgagattttcaatttgaacaaggatccaaacgaaatttttgtaaatgattccctgaaaaaagctatcaagattgaagaggatgaagattcctttgataagattgttgacgactcgtcggtggctagcgaggatgaaaatgaggttggagaaaccttttttaggcgtaagcacaaaacatggcttgaggaagatttaacagaaaacaaagaggtttgttcaaatggttgtgctcccttgtcttctagtggcttcgtcaacaacaatcttgtttatcttaacaaatatccggatgacgtgcatgattttggttttgaaagtgaagatatgaacaaaaacgttttgtcaatgctaaagatttattttgatatattctactaa

SEQ ID NO: 20107 - DNA, 134 bp, Glycine max
  Peptide Sequence Number=SeqID_111792
atggttaacctctttgaaattggtgcaggaattgaacgtcagaggtccttgcaatggcagggaattcttctgatgtactgtcgccgaagcaacctcccttgccatctcccttgcgtttctccaaattctttcag

SEQ ID NO: 20108 - DNA, 369 bp, Glycine max
  Peptide Sequence Number=SeqID_111793
atgcatgtgataggggggatgtttgtggaggcactgccgcaacaatctctggccggagaggagtttagtacaaaaggaaggagagaagaaggaaataagagaaaacaaagagttgcaccgccgccaaaaatcgctcctagcagcggacggcagagcgctgcggtgaaagaggagacagttgatccttatattcttgagaattttactgggggaactagatggaggaagaaggagttgaagggggagtgtcgtggcagcacgacgatgaagaagccagaaaaaaaaaagggaaagagagaggtagaacagaaaaaggaaaaaatcttggtcattgatttaaaaatcaatacatctagcggtgttaaataa

SEQ ID NO: 20109 - DNA, 129 bp, Glycine max
  Peptide Sequence Number=SeqID_111794
atgggtgggaattggatgattcacagcatgcatggagattgggtagatgaacaaagccctcttttcctccgtgcaacaaaggtgctcgcaataccgtcaacgaaagaaaagaaaaagaaattcagataa

SEQ ID NO: 20110 - DNA, 621 bp, Glycine max
  Peptide Sequence Number=SeqID_111795
atgatgtctatttgggcgcgcaaagaaatcagggaagagagggatttcaattttatggaaaaagagaaaaagcatcttaaccgtccatctacagggtcgtcaatcgccagctcatcaatccgcacctcattcaacttaatcttaatcggtcgtgaccggctattttcatttacttcgaaaattgcagagaagaagccagcggagaagaagcccgcggaggagaagaagtcgacggtgggagacaaggctccggcggagaagaagccgaaggccggaaagaagcttcctaaggagggaggagccggcggagaaggggggaagaagaagaagaggaacaagaagagcgtggagacatacaagatatacatattcaaggtgctgaagcaggtccaccctgacattggtatctcaagcaaggccatgggaatcatgaacagcttcatcaacgacatcttcgagaagcttgctcaggaatcttccagacttgcccgctacaacaagaagcccaccatcacttcaagggaaatccagaccgcggtcaggcttgtgctgcccggtgaattggccaagcacgccgtttctgagggtaccaaggccgtcaccaagttcaccagctcttga

SEQ ID NO: 20111 - DNA, 207 bp, Glycine max
  Peptide Sequence Number=SeqID_111796
atgggatttgttgttttcatgaataatccaagcagacgagccaggaagcaagagcgcgttcggaatcgaagcaaatctcttcgatcggaggcaacagaagctttgagcgcgaataacgaagagcccatcctacttcagttcagggtgatggcgaggttggctgggggtggggtgggggtggaggaaggtacgaaaaagaaaggataa

SEQ ID NO: 20112 - DNA, 168 bp, Glycine max
  Peptide Sequence Number=SeqID_111797
atgaagcccaagggtgtgtctatcttggagcaagaagtgaaccacaatggacagatcaatgtagttgcgttttgggtggagaaagagatccaaagcattagaacaaagaaagtgggtgagggaggctatggtatgggaatggcatgtgtcaagactcaagacatgtga

SEQ ID NO: 20113 - DNA, 345 bp, Glycine max
  Peptide Sequence Number=SeqID_111798
atggctcgaaccagatcggtctacaaatctcaaactggtggctacagtaaggtgggtggtggcgatagaacattggttgctcaccagagtgaatcagcgctacctaaacctgagagttctaatattttgtcatctcatgtcctcctaaaaggaggaaaacgtgtgctttgggggtaccattgtactccccagtctagcatgcaaaacaatccgttcaagttaacctacgacgctgacactatggtacttgtggagatcagtgaaccttcactctgcagaaacaagttcaatgtggccaacaactcaaaattctggaaaattgaggaagtcagaagtgaagcttga

SEQ ID NO: 20114 - DNA, 612 bp, Glycine max
  Peptide Sequence Number=SeqID_111799
atggtggactacgtgggcccagtggagagtttggatgcgagcgagatcttccttggttggtctcttgctactattcaccactggaaggaaacaatggccaaggctaacaacaagacaaaaacgatggccgcgaagctgaagtcgatgaaggtcgaggttggcaagactaaggaactcaagctagagttgcccaaaagtaaggagttggtggggaagctgcaggaagaccttgacaaacatgttcgctattcgttgaatcaacaagtgaaagatattagcgccaaggtgaaggagctaacctctgagaaaaaaatagtggaggagaacctaaccactgcaaaggacaaagttgcagatctggagaagaaaattgaagatttgaagagcgagttgcgaaagaaggaggaagtgaagtctacactgacggtcaagtttgacaaggccaaaaggttgatcgtccttaaccatcaagaaggtttcaagaaggcacaacgtcaagtcaaagtgttgctcccttcctccgacttttcacaactcgatgtgaattgtgacgtcgttgacggtgagattgttagagagtcccaactttgctttgagtctaagggagaatag

SEQ ID NO: 20115 - DNA, 342 bp, Glycine max
  Peptide Sequence Number=SeqID_111800
atggatgaagctaatcctatctcttctcccatggttggtggctgcaagttatctaaggcaagttttgaagatttttttaaccttgctttctacagatccaacatagaggctgaatataggagtcttgctttggctacagttgaagtgacttggatcaagtccttgcttgttgagctcaaaatgtctcatgctcctcttatcattgtgacaattaaagttgtacatgttccagttgtggatcaaagagctaatattctcaccaaagccatttcaccttctactttcactgtgtacaagtccaagcttagagtggttaacaagcctttggccaacccttcttga

SEQ ID NO: 20116 - DNA, 333 bp, Glycine max
  Peptide Sequence Number=SeqID_111801
atggtagcatacatacttaacaaggctcaagtggagaaggatgaagaagcaaagcttcacggtgaatcaaaggtgattcaaaggtgttttgatgataacaatgatgatgacaaaggtgatgacaaaaagctcaaagatcaatcaaagaacaactcaagtgaatcaagaacaattcaagagttcaagataagaatcaagaagaattcaagaactcaagaagaaagtctaaagacaagaatcaagattcaaggttcaagatctcaagaatcaagatcaagattcaagactcaagattcaagaataaagagaagactcaatcaagataagtattaa

SEQ ID NO: 20117 - DNA, 508 bp, Glycine max
  Peptide Sequence Number=SeqID_111802
atgacaaagagaatacgtaaggattgttccttgcaggaggatgtagagaaagtgaataatagctttgttgaattggatacaagggaaggaatgaatgatggttttcctagagctggaccaaatgattcgcttcttcctggtctttttgatgatgttgcgctgaattgtcttgcttgggctagtagatctgattatgcttcactagcatgtataaataaaaggtacaacttgctgattaggagcgggtatctatctgagttgaggaagaagctggggattgtggagctagagcatttggtttatttggtttgtgatccaagagggtgggaggtatttgaccccaagaagaatagatggataacattacctaagataccttgtgatgagtgttttaatcatgcagacaaggagtccttggctgtggggagtgaaatgctggtttttggtcgggaattgatggattttgccatttggaagtacagcttgatttcttgcaattgggtgaagt

SEQ ID NO: 20118 - DNA, 153 bp, Glycine max
  Peptide Sequence Number=SeqID_111803
atgtggagtggagtgttttttatagggactaggtgggtggcatgtttgtggtggtcctggtggagattaaggtggtgcatcaaggtagatgagataaaggtgattaagagatttgcaccttttgcttggcaaagcaggaaaaagaggagttag

SEQ ID NO: 20119 - DNA, 630 bp, Glycine max
  Peptide Sequence Number=SeqID_111804
atgaagcaagcaactcttttctccttctcactcttcctactcctttcctccaccaccatggccatttcaccagcacctgcagcagcaccaaaaacacctcctaccccaaaggcaacagcaccatcaccaaaaccattagttcccacactacctcagtctccagactctcctgactcagtccccgacgacatcaccagaatcctgaaaaaggcaaaaatgttctcagtcctaatccgcctcctcaaaaccacagaaatcatgaacaacatcaactcacagctcataacagccaagagtggcggcataaccatccttgcaccagatgattctgccttttccaacctcaaagcaggcttcctcaactccctaaacgaaggccagaaaatcgaattagtgcagttccacatattgccagagtttgtgtcgagctcaaacttcgattccctaagcaaccctgtgcagacagtggctggtaaagaccctgcaaggcttccgctgaatggtgaatgcattaggctccagctttggctccaacaactcttgcaaaggctcctaaagctgccaagcaaaactcttctgaggatgatcaagaagaaacagaccaaaatcacaataaatccggggcagtga

SEQ ID NO: 20120 - DNA, 75 bp, Glycine max
  Peptide Sequence Number=SeqID_111805
atgagagaagcgtcacggctgcaagctgtgaacaggaagctaatagcagtgaataaattactgatgacgtcttaa

SEQ ID NO: 20121 - DNA, 2301 bp, Glycine max
  Peptide Sequence Number=SeqID_111806
atggaaattgatctgaaccatgaagtgactgaggctgagaagaatgcattctgtgatagggaatgtgagaaaggtgctggtgctggtgctggtattacttgttggtcctcttccacttgttcgtcctcttcagcagcttgtgtgtcctcttcttaccttgagctttggcatgcttgtgctggccctctcacttctcttctcaagaaaggaaatgtggttgtctattttccacaaggtcacttagaacaggttgcatctttctctcctttcacaccgttggagattcccacctatgatcttcagccacagatcttttgcagggttgtcaatgtccaactacttgccaacaaggagaatgatgaggtttatacacaggttactttgcttcctcagccggagttggaagggatgtattcagagggcaaagaactcgaggaattgggagcagaagaggatggagatgaaagatcaccaactaaatcaacccctcacatgttctgcaaaacactaactgcctctgataccagcacacatgggggcttttctgttcctcgtagagctgctgaagactgttttcctcctttggactataagcagcagaggccatcacaagagcttgttgccaaagacctgcatggtgtggagtggaaatttcgtcacatttacagaggtactagaaaaactaggggtgaaaatggtgaactgagattgggaatcagaagagctgttagacctagaaatgatcttcctgaatcggttatcggtagccagaactgctattccaatgtcctttcttctgtggcaaatgcaatatccaccaaaagcaagtttcatgttttctacagtccaagagcaagtcacgcagactttgttgttccctaccaaaagtatgttaaaagcatcaagaatccagtgagcattggaacaagatttaaaatgagatttgaaatggacgaatctcaagagagaaggtgtagtagtgggacgttgattgcaacgagtgatttggatccttatagatgggccaaatcaaaatggaggtgtttgatggtcagatgggatgaggatattgaaactaatcatcaagaccgagtatctccatgggagattgatccttctgctcctctgccccccttgagcattcagtcttctccaagactgaagaaactgcggacaggtctacaggttgcctcacctagtcacctcatcactgcacgaggcagtggattggtaggctttgaggagtctgtaagatcacccaaggtcttgcaaggtcaagaaaatgcaggttttgtgtcattctactacggatgcgacacagtaaccaagccaccaggttttgagatgagctctccgagtcatccaaatcttggatcagctgaagtaagaaaggtttcctcttctgagctgaatagtgtccaccctttcagttatgcaggctttgtggaaactaacaggtttccgagggtcttgcaaggtcaagaaatatgttcattgaaatccctgacaggaaaggttgatttgaaccttggtgcttggggaatgcccaatctaagttgcacaactttcaacctccaccaggcaaccaaaccaaactttcaaccttcattgtttccttacggggatattcaccaagccggtcaagctagcttgttttgctcaaaatccaccactttccagagagaaaatgtcccatttaacaagccatccactcaggcagggatcattgtaaatgaagttggaagatcagatctcccaaatgagcataagctgcaggacaatatttcttctgctgcaaatatgggggtttctaatgacaacaatgtccagggaaaggtaaatgcctgcaaactattcgggttttctttgtctggggaaactactgcccaaaatttacagaactctgctaaaaggagctgcaccaaggttcataagcaaggcagcttagttggaagagctattgatctttcaagacttagcggctacaatgatctgctaagtgaactagagagactgtttagcatggaaggccttctaaaagatcctgataagggatggaggattctctacactgacagtgagaatgacataatggttgtgggggatgatccttggcatgagttttgtgatgtggtgtccaagatccacatatacacccaagaagaagtggaaaagatgacaattgggatgatcagtgatgatactcatagctgtttggaagaggcaccagtgattatggaggcttcaaagtcttcctcggtgggtcagccagattattctccaacggctgttagagtctaa

SEQ ID NO: 20122 - DNA, 1290 bp, Glycine max
  Peptide Sequence Number=SeqID_111807
atggtggcaacggcgatcgaggaagtgcgaaccctctggattggcgatttacagtactgggtcgacgagtcctacctctctcagtgcttcgcccacagcggcgaagtggtttccatcaaaatcatccgcaacaagctgacgggccagcccgagggctacggcttcgtcgagttcgtctcgcacgcctcggccgaagcctttctccgaaccttcaacggggcccaaatgcccggcacggaccagaccttcaggctcaattgggcctcgttcggggactccgggcccgaccactccatcttcgtcggcgatctcgcccccgacgtcaccgatttcatcctccaggagactttccgggcccattatccctccgttaaagggtccaaagtcgtcaccgaccccgccacgggccgctccaagggctatgggtttgttaagttcgccgatgaggcccagaggaaccgcgccatgactgaaatgaacggcgtttattgctccacgcgcccaatgcgtatcagcgcggctactcctaagaagaatgcttcttttcaacaccaatatgctccacctaaagcaatgtatcaatttcctgcatacactgctccagtgagtactgttgcgccggagaatgatgtgaataataccactgtttgtattggtaatttggatcttaatgtgacggaggaggagcttaagcaagcctttgtgcaatttggtgatattgtgttggtcaaaatttatgcgggcaaaggatatggttatgttcaatttggaactagagcgtctgctgaagatgccattcagaggatgcaagggaaggtaataggtcagcaagtgatccaaatttcttggggcagtaccttgacagctagacagtggtttggctgtttggtcgttgaaagatgtttggaagataagtctagactctacttgacaatcatgagattgatgcctatgaaggatgtacccggtggctggggtgcacagatggatccaagtcaatggagtgcttactacggatatggacagggttatgaatcatatgcttatggtgctactcatgatccctccttgtatgcttatggtgcatatgccggttatgcacaataccctcagaatgttgaaggtgctcaagacatgtcagcagtgtctatgcctatggaggaattgtatgaccccctggcaatgcctgatgtcgataaattaaatgctgcatatctttcaatacacggaagttccattttagggcggtccctttggcagagaacttcacaatctttacagcaagcctag

SEQ ID NO: 20123 - DNA, 207 bp, Glycine max
  Peptide Sequence Number=SeqID_111808
atggagttgcaaagactaaatcaacatgaagaaaatgataaaaaggagaagggaattgctcttaaagcctcatcttcaacccaagaggaaagtgacatagaagattcaattgacttagatgaagatgaagatcttagcctctttgtcaaaattcaacaaatttattataatgagaggaaatcaaagaagacaaaacttcaaacctaa

SEQ ID NO: 20124 - DNA, 495 bp, Glycine max
  Peptide Sequence Number=SeqID_111809
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccggtgatggttgaggatggcaatgatgggttcgataattataatggtggctacaacggtggttatgatgttgacaatgacaatcacgatggtgatgggtcaattgtgatattttag

SEQ ID NO: 20125 - DNA, 192 bp, Glycine max
  Peptide Sequence Number=SeqID_111810
atgaagcgcatcataaattcaaacaaccataaattttcacccgaatctacgaataagttcgatgatgacaaaggtgatgacaaaaagctcaaaggtcaatcaaagaatgagttcaagatgttcaagaaggaatcaagaacaattcaagactcaagaggaaaagttgaagaacacttcaagattcaagattga

SEQ ID NO: 20126 - DNA, 576 bp, Glycine max
  misc_feature (504)..(504): n is a, c, g, or t
  Peptide Sequence Number=SeqID_111811
atggaggccttgaaagagcaaatggccacaatgatggaggccatgatgagcatgaagaagataatggaagccaatgcggttacaattgccgctaccagtgctattgctaaggtgaacccgatggccccatttggcctcaaccaaattaatcatccaacctcagatatggtggacaaagatttgggaagtacgagcggcccccattatgtgcaaattcaaaacaaacacgccttcatgccatatggcttgccttccaactatacaccacccaatgtggcatacactcccagtgaggatgtcaataactccactcctatacccattgagagccaacaaccccaaactgatcatgcagatgtctctcaaaccatgggagagacacatgaaatttcccaccacaatctagccgacttcgcgcttgcctcggatatgccattaaagggcaagcagttggtggtatacccctgcaaaacactttggagggcccttagtatcacccaaaancacaactcttgcattccacaacaagtaaaaaccctcatgctatggcagaaatgggaaagttggatcatctag

SEQ ID NO: 20127 - DNA, 447 bp, Glycine max
  Peptide Sequence Number=SeqID_111812
atgactagaggcaatccatctgacttacaaccctttgatcctgagatagataggacatttcatagattagttagacatcatttagtaccttttgagcatcctaaacattctgttattggtgattttgagcattatagttttgaacattctgagaacatggcacaacctccaccctgtaagaggactctaagggaaatggctacacctgattttacctatgaaagcttgtgcatccaataccctgatgaggatgtcccatatgttcttgcaggaccacgaccatcaaaaaagatatttcaggcattagacaactcagtggagagagcttatatgaatactgggagagatttaagaaactatgtgctagttgccatcaccaccagatttatgagcagcttttcctccaatatttttatgatggacttagcaacatggagagaagtatga

SEQ ID NO: 20128 - DNA, 270 bp, Glycine max
  Peptide Sequence Number=SeqID_111813
atggcttgcttgggaggcacaacaggtgtgtacatggtgttttacttcttgctcttcttcaagacaacctcgtattcagatgcaacttttaagaattgggatagtgcttctatatatacaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtga

SEQ ID NO: 20129 - DNA, 299 bp, Glycine max
  Peptide Sequence Number=SeqID_111814
gccacgctccagcctttgtagatgagctgagggactctggaggtggcggcggtgcgtctattgctcgctgccaaccatccccaggatgttgtggtgtctcgccctgtgcctgctcggggggcgcaatacttcttgatgaaagcccgattaatatggggcctgatgaccttgttgggggtgacagacactccatagaactgacaaaggcccgtaatcagagctggaaaccccaggaccctgttggacttctccggggggagatcggtattgtggtcactgggcagaatgttgctaagtag

SEQ ID NO: 20130 - DNA, 489 bp, Glycine max
  Peptide Sequence Number=SeqID_111815
atggcgcccttcacatgtgcatgcggcaaatacaataaagaagctatgcttaggtataggcttgaggtgatgatcaaccagggagatgaaaacacaaaattcctgctttgggaccgtgaatgcagtgaattaattggtcaatcagctgatgcagttaataagcttaaaattgaagatggtgatgttgatttgaatgcttcaccccaagcacttgataagctgttgggttatgaacttgctttcaagataaaggtgcaacccaagttcaggaattatgctattttgaagtgttcagctgactcaagcttaataaatgttgtgatggatatgctagttgatgctgagacatcttcaaaaatggatatcccagtttctgattccaatcattctgtccaacatgaatctcaatccttgtctgtgacagcaggccatgatccactgcttggactccccttgacacctacaagcggcatacatttcagattatga

SEQ ID NO: 20131 - DNA, 264 bp, Glycine max
  Peptide Sequence Number=SeqID_111816
atgccgggagcagacaagcccgtcagggcgcgtcagcgggtgttggcgggtgtcggggcctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 20132 - DNA, 368 bp, Glycine max
  Peptide Sequence Number=SeqID_111817
atgtttcagcttatattcctactaaagtaagttccattacagatggccaaatattcttatctgccgatctattcaatgctggaatcagacccgctattaatgtagaattagaagcttttgcccaattcgcttctgatctcgataaagctactcaaaatcaattagcaagaggtcaacgattgcgcgagttgcttaaacaatcccaatcagctcctcttaccgtggaagaacagataataactatttatactggaacgaatggttatcttgattcattagaaattggacagacattcactggggaagcagaagtccttttgaaggaagctattcaagaacagatggaactctttttactacaggaacag

SEQ ID NO: 20133 - DNA, 225 bp, Glycine max
  Peptide Sequence Number=SeqID_111818
atggggatcgcacccacaaagacacccagtgggcctgaagaagtccaacagggccctggggtttccagctctgggattgtgcccgcaagacacctagtggacccgaagaaggccaatagtgtcttggagttgccagccctaaatacgggtctctatcagttcaagggagtgcctgttgcccccagcagggtcatcaggccccctaccaatcgagttttcatctag

SEQ ID NO: 20134 - DNA, 336 bp, Glycine max
  misc_feature (240)..(240): n is a, c, g, or t
  Peptide Sequence Number=SeqID_111819
atgggtaaagtagaggaggtgcaaaagaaggtgaaggctgacatggaggccatgaaggagaaaatggccacaatgatggaggccatgatgagcatgaagaagataatggaagtcaatgcggttacaattgccgctaccagcactgttgctaaggtgaacccgacgtccccattcgacatcaaccaaatgaatcatccaacctcagatatggtaggcaaagatttgggaagtacggacggnccccatgatgtgcaaattcaaaaacaagcacgctttcccaccatatggcttgcctctcagctatacgccacccaatgtggcgtacactcccaatga

SEQ ID NO: 20135 - DNA, 168 bp, Glycine max
  Peptide Sequence Number=SeqID_111820
atggcacttcacaagggaagatcaattatgatcgctggggaggatgtgctgaaagcaacgtctttaatctgtccatgggccctgcgagttgagtccattgcctcctggcaacttcctcctagaactcagtgtattctccctttctcagctggacccgtctctccttga

SEQ ID NO: 20136 - DNA, 246 bp, Glycine max
  Peptide Sequence Number=SeqID_111821
atgctttcactggacgtatctcaaaagactgagatgaaagtttatagcgcgggtgacagtagttggagaaaccttaaaggttgtcctgttctttggactttacctaaagttggtgaagtggttcatccgccactaccaatcaatttcttgcttgaatcgctgtttggaggtttggagagcgagaacaccttttcacgttcattcactcagttctgtaaagacttaactacatctagtagccattga

SEQ ID NO: 20137 - DNA, 383 bp, Glycine max
  Peptide Sequence Number=SeqID_111822
agtctttggatgaagatgatagtgttgatggaatatctgatacagacgatgaagtcaccgacatcattgaaccagtttcaattgttcacccaacagaaggtgtaccaggaattcaaaatctattttggaatgatgctttgcattataacaatatcaattggagtcatctggacgaagaggacatttgcggtttggacatgccaacgacttttaatgttggacaagaattatatgctggcatggattttgacagtaaagatgcggtaaaaaatgcactgaaacaatatgtgatgaaggttcatcaaagttttaagttgaattacaagcatgatcaaagaagatccatcaataaaaatttctttgattcaagaaaggataaatag

SEQ ID NO: 20138 - DNA, 492 bp, Glycine max
  Peptide Sequence Number=SeqID_111823
atggacccgggtgtggggccccttttttactcaaacccgtgggtgcttagaatgcagtgtaaagaatgcgaaatagacaacaattatttacattttacacagtttcaactaatgcacacacgaagtttcacaaatccacaattccataaaataggcctaactcacaaaaaatatccccagtggagtcgccaactgtcgcaacgtgcccttcgcgggcgagcgagggcgaggctcacaagtgcactttccaaaggaggaaagatgcgcggagtcaccaccaatgtttatttgtggaaaacgtcggaaaaaaccgaaggaaaccggtcaaaacgaatagtccaagttcgggagttgtatttacgtttgaggaaggtcgacaaaagcgaggctcttgctcctacgtaccctccatcgaagaggaaatcagacctacgtagttcttttttaggggtgaatcaagcgattctttttacttggaaggtgatcatttaa

SEQ ID NO: 20139 - DNA, 366 bp, Glycine max
  Peptide Sequence Number=SeqID_111824
atggtttctcttgagacagaagacgaattagaaattcgaatagctgcacgtcttccatggtggcattgccgaatgaaactaccagaaaatgcacaacaactgccacttgcagacatggtgaaatcaagtgaacaagcagcagcgactgagcctcagagtagaagaagaagaagcaactcagcgtgggaaaaagaagaagaagaagaagaagcaaccagaaacttcgtaaaccctaattattttggggaagaagaagaagcaaccttgcatgagagagattttatagatgcggacctcagtgccacgttggacaatctacgtggcactgaattgccacctatacacctcactaacgccgtcacctga

SEQ ID NO: 20140 - DNA, 486 bp, Glycine max
  Peptide Sequence Number=SeqID_111825
atggcagaagaatttgtggcatgcatgagacatcaaatcatggatatggttgagaaattttgtcgcaggactgcaaattatggaaggaaattgaaagaccacttaagtaaagtaggactagttgaaaatagacatgtgtcgcaacctacccttcggcgggagggcgacgcagggctcacgggtgcgtcttccaagggaggaaggcgcgcgagttgccaccaacgtttattcgagaaaaacgtcggaaaaatcagaacgtgtggtctacgaactttaatcgtgaaaggtttgagagttatttttacacacggggaagctttttatgggcctttttgtattttttatctttttgtggtcgacaagggtgtttccctcactcctacgtattcctcaattgcgatgaggaaatcagacctacctagttctttcataagaattgaacgttggttaagttgttttgatctttttccgcaagatcgattttaa

SEQ ID NO: 20141 - DNA, 600 bp, Glycine max
  Peptide Sequence Number=SeqID_111826
atgtcgactttgaaagaacaaatggattctatgatggagggcatgctgggaatgaaacgactaatggagagtaacgcggccaccgccaccgccgctagcacggctgccgaggcagacccgactctcccaattactgcacaccatcccattccaaacattatgggacgagagggaagcacactggggcatgtcagcaacccccatccggggtacaaccgaggtgcttacccctacggtttaccacccaactacacaccaccagccatgcatgaagacgtgggtcacgttactcccctcatcctcgaaggggagcctcctcggcatcctgacggggtccacgagaatcctcgagaacgcgctcagggagacgtcgactcctactccccgtttcctgctgaggggtcggtgcccaacgcactacctcaacccaacatcacgggagagcctccaaaccacccaatgcagccaatgtttctgtccatggaagggccgcccccgacagcagaaggaaaggaaaaactcgatctcatcaaagagagattgagggccgttgaaggattcggcaattatccgttcacaaacatgaccgacttgtgcctg

SEQ ID NO: 20142 - DNA, 320 bp, Glycine max
  Peptide Sequence Number=SeqID_111827
aaggaagcgttatgttaactgtggttgcagaaatttgcgttaagccgggccgccgtcaggaggtgctggaggcgattaataaactgatccctgtcgtgctggaagaagagggttgccatcagtacgatgcgctggtcgatcaccaggcgcaggtgccgtggaagcagaactcgccagactcgatctttatgcttgagcagtgggaatcgctgcgccatctggagcagcatcagcagatgccgcacatggatgcacaccgcgccaccatcaaagatgacgtggtggacgtgaaaattctggtgctggaaccgaccgcctga

SEQ ID NO: 20143 - DNA, 531 bp, Glycine max
  Peptide Sequence Number=SeqID_111828
atgggtggcggctacacactggccgacggcaagctgacggtcagtgcgatggcctcgaccatgatggcctgcaccgacaaggcgctgatggcgctggacgaggccgtgtcgagccgcctgcagggcgagctgaaggccgagcaggatgccgatggcaagctgaccctgaccaccgccaagggcgacgtgctggtgttcaacccggaaccgaccgctgaaacccgctatggcggcgccggcgaaaccgtgttcctggaagtggccgcgaagaccgagaagtgctcgcacccgctgatcccggactaccagtgcctgcaggtgcgtgaggtcaagttcgacgacaagggcctgaagcagggtgagccgggcaagttcgagaacttctacggcaacatcgagggctacacccatgaagacggcgtgcgcaacgtggtgcgcgtgaagcgctacgaagtgaagaacccgccggctgatgcgccgtcgcaggcgtacgtgctggacatggtggtcgagtcggccatcgagaagtga

SEQ ID NO: 20144 - DNA, 207 bp, Glycine max
  Peptide Sequence Number=SeqID_111829
gtgaaaaagaggctaagtcaggaagtgctaacagtgacagttgaacttagctcatcaagtgcctatttcgggaaaatagccctagaagcagcaagaggaacaacttgtgcattgaagcctaggttttgtaaattgagagaaattagtgagttggagagtgagtgtgagatgctaagaagaagaggaggaatcccccttcttgtgtaa

SEQ ID NO: 20145 - DNA, 107 bp, Glycine max
  Peptide Sequence Number=SeqID_111830
atgaatagaagttggattcaagcaccacgcataagcgatgagtatgaaaagggggttgaagatttcttgaagtttgaacaacaacatgcaccaactgtgggtggaaa

SEQ ID NO: 20146 - DNA, 512 bp, Glycine max
  Peptide Sequence Number=SeqID_111831
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggctggcattggagaaagaagaattgataaaagccttgacatctgaatcatctgagtgttctaggatgaaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaacgctgcgccttatccggtaactatcgtcttgagtccaacccg

SEQ ID NO: 20147 - DNA, 231 bp, Glycine max
  Peptide Sequence Number=SeqID_111832
atggcagcggaatggagagggaagagagagaggagacgcctcttcaaggagaagatgagtctagaagaagctcaccaccataggagaccatggataatagcttggaggaagaaggagatgaatgaagggagaggaagagaagagcacaaaattttatgctctaaaagagctcttaaatctgaacccactaatccaagatcaattccaagattctccactaagtgtgcttag

SEQ ID NO: 20148 - DNA, 961 bp, Glycine max
  Peptide Sequence Number=SeqID_111833
agggctgcacgccctcgccttcagagggctacatgccctcaccttcagaggactacacgtcctcgccttcagagggctgcacgcccttgcctttagagggatacatgccctcgccttcaaagggctacacgctctcaccttcagagggctacacgccatcaccttcagaggactacatgtcctcgccatcagagggtcgtacgccctcgccatcagagggctacgcacccttgcctttagaggactacacgtcctcaccttcagagggctgcatggcctcaccttcagaggactacacgtcctcgcctttagagggctgcacgccctcgccttccaaggactacacgtcctcaccttcagagggttgcacgccctcaccttcagaggaatacacgtcttcaccttcagagggctacacgtcctcaccttcagagggctacacaccctcgccttcagagggctacacgtcctcaccttaagagggctacacaccctcgccttcagaggactacacgtccttgccttcagtggattacacgtcctcgccttcactgggctacatgccttcaccttaagagggctgcatgccctcgccttcagaggactacacatcctcgccttccgagggctacacatcctcacctttagaaggttagacgccctcgccttcagagggcttcacgccctcaccttcagagggctgcacatcctcaccttcagagggttgcatgccctcgcctttagagggctacacgcccttgccttcaaagggcgacacgtccgtgacttcagagggttgcacgccctcgcatttagagggctatgcgtcctcactttcattcctgggccaccccctgatctcgaaggagggccaattgtgcgagcacaaccagagggaggctattgtgcagccactatgcatactggggcaagatttcacccagccattgcaaggagacga

SEQ ID NO: 20149 - DNA, 547 bp, Glycine max
  Peptide Sequence Number=SeqID_111834
atgggggattcgcaagaaaataacaaaggaaagagtagagacaaagataattatgtatcttggactatggaggataccaatgagttgttgcacctcttggtggatgctatgaataggggattgcgtgatgccaatgagtcacttagcaaacaaaatgtagaacgaataatacttcctcaactcaatgcaaaaactaaattccctaaaacttatagtcattatttgagtcggatgaagtggtttcgaaaccagtataacatgatgtcaacccttatgcgcaacaactatggctttggatgggacccaattggaaaaactttcactgctcatgaggatgtatggaaagattacttaaagtcccacccaagtcacaacaaacttcgaggaaaaagtatggttgattatgagtatttgaagatcgttgttgggggtggagtttctagcgggaataattctatatcagtcgatccagatgatactgatacaacaacttttgagccagaaaatagaactgttgggatagaagaatttccatatgatcctaata

SEQ ID NO: 20150 - DNA, 246 bp, Glycine max
  Peptide Sequence Number=SeqID_111835
tggagaatggagaattgcactaggaaatcacttcgcgtggctcaagactcactggtggaggatgcacgaacgacaatcaattcatgggactccgaataaaagtggagaatggagaattgcactaggcaatcactttgcgcctggctccagactcattggtggaggatgcatgaaccacgaatcaattcatgggactccgaataaaagtggagattggagaattgcactaggcgatcattcggcttg

SEQ ID NO: 20151 - DNA, 447 bp, Glycine max
  Peptide Sequence Number=SeqID_111836
atgctttggctccaagaatttgatttggagatctgtgatcggagcggtgtacagaacctcgtgactgaccacctgagtaggattgagcatgcgtttgaggactcatccattcgggatgattttttggatgactatttgtacattctatataatatttctgattccttccccactccttggttattaggagatgcattccagaccatgagattgactcggtcctgcaattctgtcattcttccgcaccaggtggccatcttggcatatagaggacagctcgcaaggtgcttgactgtggtttctattggcccaccatcttcaaggatgcatggagaatatgtagcacttgtgagccttgtcaaagatcaggcggctcactttcatggagatagcaaatgcctcaacaacccatgttgttatgtgaggtgtttgatgtctggggtatag

SEQ ID NO: 20152 - DNA, 306 bp, Glycine max
  misc_feature (143)..(143): n is a, c, g, or t
  Peptide Sequence Number=SeqID_111837
atgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcnagagcaggattgtactgagagtgcaccatatgcggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 20153 - DNA, 244 bp, Glycine max
  Peptide Sequence Number=SeqID_111838
tgtagtttacaaaagcaaaggtgaaaggaaagatattgaactggtagaggaggaagagccacagattggtgctgattgttctagtgcaacctctaataaatctgagatttgtaagaaggaaccaaggaatgcagcacaaaagcataaaccaaagagggtggagagtgtcaatgttgatgcagaagcctttggtgatcactggaaagttcatattgatttatgcattctgaagctgaagcactag

SEQ ID NO: 20154 - DNA, 863 bp, Glycine max
  Peptide Sequence Number=SeqID_111839
tgctgactgtgaaagagtttgaagaaatcctgggatgcccactgggaggaaggaagccatatcttttctctaggttctatccttccacgacaagagttgccaaggtagtgaaaatctcagcacaagagttggacctggcaaatgggctttcttttattgacatcttggcgcttttgatctttgggggtgtcctctttccgaatatggaagggttagtggacctagcagtgattgacgctttcctcgcctttcatcatggcaaggaaagcccggtcgtcgccattttggccatgtatgacacattcgaccggggaggtgaaaagagtggcgcaagaattgttttttgtgcactggctctctatgtgtggctggtttcacacctttttctccaagaaggaaggaagaatcgggattctatcttcatacgaaggatgtccaaatgttcccttgatggaacaaggggttgtattaattataatcctgtcctcgccataagacagcttggctaccccatgagaggagtgccatcagacgaaagcatcacgcctttcatcgcacggggtttcagtgaccacaacgcgagggacagagagcttaggggaagcagtaatgggatcatcggcggctatcataagtggctgagagtccgaacacaaggattggattggctcccaaatctaaacactgtgagagacgatgaggttaaagcttcggaagaaagtgatgaggtacaagccctaaaggcagagcttgaaagagcccgggtagtcgaagagaagttcaagtccatagccatcaaaggcagcaatagtgagctcaagctccgaagaggtgaaaggaatcatcacgggtcaaaggcatga

SEQ ID NO: 20155 - DNA, 114 bp, Glycine max
  Peptide Sequence Number=SeqID_111840
ctggcactggttcaacctgtgctggtgtgggctcaggagaagcagcctctttgggtcccaccaatggaggttgagcaccaggctaggctactcgctcaaggaaatgctttatag

SEQ ID NO: 20156 - DNA, 346 bp, Glycine max
  Peptide Sequence Number=SeqID_111841
ctgataccgctcgccgcagccgaacgaccgagcgcagcgagtcagtgagcgaggaagcggaagagcgcccaatacgcaaaccgcctctccccgcgcccagcgatagcagcatcactagcggttccctgagattcctccagtttttttcctctaactgctctgatagagttctcaaacgtcagagtgacaaagaagggattgaagcctccactcgtactgtcttgatcccaagagtgaaggccgttttgggtttctgcgggaaaggaaaaggctacgatgcaaaaggtatttctctcagctcaaacatgatatcaaaattcccaacggtgagaatgctcgaaatcgg

SEQ ID NO: 20157 - DNA, 556 bp, Glycine max
  misc_feature (248)..(248): n is a, c, g, or t
  Peptide Sequence Number=SeqID_111842
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggctccgnccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtacgtcgttcgctccaagcttgggctgtgtgcacgaaccccccgttcaagccgaccgctgcgccttatccggtaactatcgtcttgagtccaacccag

SEQ ID NO: 20158 - DNA, 171 bp, Glycine max
  Peptide Sequence Number=SeqID_111843
atgactaaagcacgtcaaaagggggtacggaaagggaaaagagggaggagcttgccacccagctcgcccaggcaagctaggttgcttcctctagaaggcatcgtcttttggtggaacttcttggaaggcccaagtgggcctgattgctatttacacacccctgtttactaa

SEQ ID NO: 20159 - DNA, 213 bp, Glycine max
  Peptide Sequence Number=SeqID_111844
atgaagaaagagtgtcccaagtatgccgcatggcatgtgaagaaagataaatttcttactctagtttgttcagaagttaatttggattttgtacctaaagatacttgggttgcctgtggagccgactaccaagtgatgatgaaagattcatctttatgggtgatggcaagaaggttgcaatggaagctactggaacttttagattacagttaa

SEQ ID NO: 20160 - DNA, 570 bp, Glycine max
  Peptide Sequence Number=SeqID_111845
atgactgctgccatcgagcgactagaacaccctggtcatgtgcgtgctactggagtcggtgtgaccatgaagcaatactttggatcagctccacgaacctctcgcacttcttcctccatggctcctgaagaactagagcagctgactcaacaaatcaaggaccatctggaggagtcaatcacaaaaaaaatgcagtcccagtttccatcacagatgcaatcacagggacttgcactgcctccggagcctgaggttggtccctatgttacccgtgtcagcacaaaggagagttgtgttgatccctcagggaacaatccagacacgggtgactcagacaaatgcgggttgtacatcgaagaaaattctccccacctggtttccctaggaagagtttatgagagatccacaactgttcacagcattcctttgttgcatgatcaagtgaaggtcggagttgaggaggttaaagatgtagatgctccaattcctatacccactaacgagggagctgtaggacctgcaaaacctggagataggccgatcataaggtcgatgatcccctatatttga

SEQ ID NO: 20161 - DNA, 177 bp, Glycine max
  Peptide Sequence Number=SeqID_111846
atgaagatgtctagaaaattcagtaaaaatttcagctcaaaattcgaagagttcaatattcacttaggatcaacatttcagccagcaattcaatcaccaaaactcaaattcacaatagacacaatcataaggaaacctaaaagttcaagaaaaggttcacaaccaaagactctctaa

SEQ ID NO: 20162 - DNA, 1167 bp, Glycine max
  Peptide Sequence Number=SeqID_111847
atggaggttgagctaagcgtgccttgctacgctaagcctaagggtcattttggtaaggctgagctaagcgcaccatgctgcgctaagcccaaacccttttctgttttgaaaattatggcttccaagaagagaaagtcttctgcttcttcctctacccaagcaagatatgacagatctaggtttcattctcaagaagcttgggagaggtacactgatataattgtgcctaggaaactgcttccagagaggaatgtggtagtatattacactgagtttgatgatttcaaagaggaactcgagagaaggaaatgggatgaagaattgactaattttgatgaaggcagcattgatgttgccatagtgaaggaattttatgccaacctctatgacccagaagacaattcacttaagcaggtgagggtcagaggtcatctgatcaaatttgatgaagatactttaaacacttttctgaagacccaagtgattctggaagagggggaaaatctttgtgcttattctagattttcactcttgaggcctgatcctcaagagttagctgctaagctctgcatcccagggaaaggatttgagcttaatgcagatggcctccctttgaagattttaaggaagaacatgaccactttagctcagacatggagcattctttccttctctaacttggttcctacctcccacacatctaatgtcacattagacagggccaaattaatctatggaataattatgaagatggacatgaatgtgggttacctcatctctcaccagatctctattacagcacagcatgacccctctaggcttggatttccagccttaatcacaactttgtgtaaagctagaggagtcacatcagattctagatccctggagagcctcagccctgtcattaacttcgcgtacattaagaagaactattggaatctagatgatccaacagtagcattcagagggcctaagaagaccaggggcaagagatcagaggcccctactactttagtagcactagagatagtcgcaccttcttcatccactcctccagtacctttttcttctacttcatctactcagataccacttccaactccttcatcttttggaccctcagattttttgtttactccagagatgcttcattctatgctctag

SEQ ID NO: 20163 - DNA, 303 bp, Glycine max
  Peptide Sequence Number=SeqID_111848
atgccactcaagagagttaggcatgtaaattttacaacgcctcattttcaagggtttttcaaaggaagtgtaaaacatcctattacgacacctaaatcgcaagagatactaagagaagctcaaactaagaaggagaaagacatagaagtcaaggttacgtcaaagaaactacgaaagaaagggttgggagcttcattctctactgatcccttggggtggattttgaatattccactccgactaaagcgttcctctttgtgtggtggttcggcgacaagcaatggcggccaccggtggttgtga

SEQ ID NO: 20164 - DNA, 499 bp, Glycine max
  Peptide Sequence Number=SeqID_111849
gtatattgtaccttacaatccaagattgctcagaaaataccaagcacatatcaatattgaatggtgtaaccaaagcacttctatcaaatatttatttaagtacatcaacaagggatatgatagagtgactgttattttgattgatgaagataatgatcaaactcagaatggtggcactcataatgatgagatcaaagaatatctagattgcagatacatatgtccctgtgaatctacttggagaatctttgggtttccaatacatggcagaaaacctgctgttgaaagattacacttccatcttccaggccaacatagtgttctctatgaagaccatgatgatattgatgatgtactgtctaagccaagtatctctgattcaaaaagaaaagatgttggcacctttggtaggaaggctacaccacctggcagattactatgggttccaccaattacaggggaattattttatttcgagaatgatgcttactgtttgtaa

SEQ ID NO: 20165 - DNA, 375 bp, Glycine max
  Peptide Sequence Number=SeqID_111850
atggttagaacacgaggtttaggtcgtgcgttaggagctagtaaaggtagaggcattaatgaggatgcgcatcaggttgatgttcctcggcgtcgcaggcctactgcttcagcatgtaggcaacgggtttgtctgcgtgaggacgtcacagagagacctgaggatgtgcctcagtcgcatgaggatgttcctcatgtgtctgatgccaccccagagatgacaggcgccgccgatgctgttcacacagagggaatggctactgatgggagcttggggtcacttgctgcagatgagggattccccggtggaccacgcgacccatcgattttgaccggttttgctgagcatgtcacacacagcatctggagtggccag

SEQ ID NO: 20166 - DNA, 1226 bp, Glycine max
  misc_feature (61)..(61): n is a, c, g, or t
  Peptide Sequence Number=SeqID_111851
atggcgagccaagagaagtggggcccgtttgcagatattttagctttgttgatttttgggnttgtcctctttccgaacattgacggcttggtagacttagccgccattgatgctttcctcgcatatcatcatagcaaggaaagtccagtggtggctatcttggcagatttgttcgacacctttgaccggaggtgcgagaaaaacagtgcacggattgtttgttgtttacccgctctctgtgtatggttgacttcacacctattccgacaagacacgagacacccgtgtccgcttcaaagctatcgctcatgcgctgaaaaaggaagagtcgtttgggaccaacatttggctgtgatagggggcagcacgatccattggtttccgcgttggaaggaaggcaaggaaggagttcttttctcgtgtggggactatcctaatgttccactggtagggactaggggttgtattaattataatcccgcactcgccataagacagctaggttatcccatgaggggagcgccaaccgaagaaagtctcacgcctttccttgtgagagatttaggcgcccaaagtctcaaggttatacaaagaatccacaaggcgtggaggagtccgttgaggaaagacaaggagcttagaggcatccgaaacggcgtcatcggagattggctctccaaattgaaagttatcgatgaggagaacttcgaagctccggaggaagatgaagaagtccgagctctaaatttagagttagggaaggcaagactcgccaaggagaagttcaagtcagctgctacacacatccggaaggagtgcactgagttacaagaggaaaacgcggccactgcaagagcccttgaacaagaaaccaaaagggcctgcaaggaggaatatggccgagagaaattccgaggagcattgtggggtagcaacaatgagctcaagcttcgaagagaggagagagatcggtcacgggttcatggcatgatcttaaaagaagagttagttgcttgcgcgaggtccaaaaggagtttggctcaacacttggaagccacggagcaaagcatgctagctatcatagggaaatacaaggaagaattgaaccagtccatggcccatgaacaaaagctagtggaggattttgcacaagtgtatgccaaaaaagaagcaagagggagggtgattgatgcactgcatcaagaagcgactatgtggatggatag

SEQ ID NO: 20167 - DNA, 558 bp, Glycine max
  Peptide Sequence Number=SeqID_111852
atgcacgccctcgccttcagaaagctgcatgccctcaccttcaaaggactgtgcatcctcgccatcaaagggctacaccccttcgcctttagagggttgcacgccctcgcctttagaggactacatgtcctcgcctcaagagggctgcacatcctcgccttcagagggttggacgtcatcgcctttacaaaactacatgtcatcgcctttagagggctacatgccttcgcctttagaggaccacacgtcctcgccccaagagggctgcacgtcctcgccttcagagggctacacgccctcgccttcataggactgcacgtcctcaccttcagagggctacacgccctcgcctccagaggactgcacgtcctcgccttcagagggctacacgtcctcaccttccgagggctacacacccttgcctttagaggaccacacgtcctcgcctctagaggactgcacatcctcgcctccaaagggctgcacgtcctcgccttcaaaggactacacgtcctcgccttcagagggctgcacgtcctcgccttcagagggctgcac

SEQ ID NO: 20168 - DNA, 474 bp, Glycine max
  Peptide Sequence Number=SeqID_111853
atgagccaggtgattctcgatttacagctggcctgcgaagacaccagcggtctaccggacgaagccctctttcaacgctgggtggaagccgtcatcccgcagttccaggaagagtcagagttaacgattcgcctggtggatgtcgccgaaagccacgagctgaacctgacctatcgcggcaaggataagccgactaacgtcctctccttccccttcgaagccccgccgggcattgagatgccgctgctcggcgatctgatcatctgccgccaggtggttgaacaggaagccaaagagcaggaaaaaccgctggaggctcactgggcgcacatggtcgtgcacggtagcctgcacctgctgggctacgatcatatcgaagacgacgaagcggaagaaatggaaggcctcgaaacagagataatgcttgctctgggctatgaggatccgtacattgccgagaagattgctgaatag

SEQ ID NO: 20169 - DNA, 798 bp, Glycine max
  Peptide Sequence Number=SeqID_111854
atggtgcttgctgaaggtgaatctttgcccgcctactcaaaatactgcaggatgcctactgacattagagaaattgaggttgcattatgcatacccaaccgagggtttattctaaatgctgaaggccacctggggaagatccttagaaaagatctaaccacccttgctcaggtctggagtgttctatcctactccaacctggctccgacctcccacaaatcggatctggctgtggatcgagctaggttaatctttggcctagttactcagctggacatgaatgtcagagccctcatttttgggcagattacttctatcgctaagtctaactcctcaagactcgggtttcctgctcttatcacagctttatgcaggaccaaaggagttgcctccgacaatcttgtctttgaacgtctgagcccggtcattaatttggcctacataaggaagaattgttggaaccctgatgatccaacaattattattaggggggccagaagaccaagggcaaggccagctgaggctccttctacatcaacaactcctcatctagcttctacatcagcagctcctcctccagcttgtattgcagcagctccttctaccctaccacctgcagattttcaacgtttcgaagccatgcttcaaagcatacatcaggggcagattattttgctgcaaagtctccagctggtagcacctccagactccatccctacagtagagcaatttaatgaatgggtagcctggccagggactcagcctcctcacagggacgacgaggatcccgccgctctg

SEQ ID NO: 20170 - DNA, 211 bp, Glycine max
  Peptide Sequence Number=SeqID_111855
atggtaagtgaaactgagcaagaggctccataccaaaatgatgagtttgtggggcttcaaaaagtgttggaagttgatcctgatatcattaatgaatctgttgtagatgttgatggaggtgaagaggagatagatgtcgatttacttaaacgactagacttggttgaaccagacaaggatgaatgcatattaagtgagaatgagattaaga

SEQ ID NO: 20171 - DNA, 213 bp, Glycine max
  Peptide Sequence Number=SeqID_111856
atggctaacgtttctctcctgcgaaaaataaaatgggatgaagtaactcttcccgaaagatgggttatggataaggccacgttgtctgttccccgacccactccaaccatagagcaaattaagcaggataactccggtaaggtagaaataaccttcaataggagaaattctttttcatcaagaatagaagtctctaggtctgaatatgagtaa

SEQ ID NO: 20172 - DNA, 486 bp, Glycine max
  Peptide Sequence Number=SeqID_111857
atgtcagttttggaattgtacatagaaaaggatgtgactggtggttctatgtttcattctgcaaattctcttacatcatgtggaaataatttatctaataatgaggcgcaatcagcaagaaatgttagcaatttacatggtgacgaagatgatgatgatgattatcttgtgtctaactcatacgttgaaggctctttagacgaagatgatagtgttgacagtatatctgatatagacgatgaagttaccgagatgatccaatcagtgagaattgttcacctagcagaaggtgtagaaggaattcaaaattcattttggaatgatgctttgcattataataatgtcaactggaatcatcctgatgaggatgacatttgcagtttggcgatgccatcgagttttaatgttgggcaagaattatatgttgacatggaatttgatagtaaagatgcgataaaaaatgtagtcaaacaatatgttatgaag

SEQ ID NO: 20173 - DNA, 312 bp, Glycine max
  Peptide Sequence Number=SeqID_111858
atggatttcgaaatctgccctattatgcagaaaattgctgtcaaatttgtgcagcagaatttttgttcatgtgcagaaaatgtttgtgcattgctggttatgggaaagcttggaggggttgatggggacccggtgctgagaggaacgaggataagggctacgtgggagtacatgagctcagttgaaggtgggcaactggggatgagtggtacctggagatatgtcgcgggggtcaggagaccttggggacgtcaggtggggtgctattgcccaaaaccaagcttgaccaatcccgacccaacctgggcatag

SEQ ID NO: 20174 - DNA, 1728 bp, Glycine max
  Peptide Sequence Number=SeqID_111859
gttccagtgcagcttgcggcgcagggtggaaaagaagctgtagccttccggatgcacgaagcggatggtgtagggcgcgcgctgcaccacgatgcggtcgccgggctgcaggtcggaccaggtctgcatgtcgaaatgcacgctggccccgacttcgacgcggcccatggcggtgagcgtcatgttcagcacgccgctgtcgggaatgacgatgggacggttggacagggtctgcggcgccaccggcaccagcaccatggcgttcatgccggggtgcaggatcgggccgttggccgacagcgcataggcggtcgagccggtgggcgtggcgatgatcaggccgtcggcgcgttgcgtgtacatgaaggcgccgtcgagttcgacgcgcacctcgatcatgccgccgcgcccggcgcggttcaacaccacgtcgttcagggccgaggccgcgtacatctgctggtcgccgcgccacgcgctgccttcgagcagcatgcgctcttcgatctggaagttgccctccagcacgcgcgtcagcgcgccgtgcgcgtcctgcacgggaatgtcggtgatgaaacccaggtggccgtggttgatgccgaccaccggcacgccgtagggcgcgaggtggcgcgcggcgcccagcaccgtgccgtcgccgcccatgaccaccgccagcgacgcatccttgccgatctcttcgtaagtggcgaccgggtattccgtgaggccggtgttgcgggccgtgccggtgtcctggtatctgccgatcagcgcgacggtaggaaagtgcatggtggcgaggcgaatcagaaaaacgaaatcggtccggaatcgggcctgttagccgattatatggggccgcatatcggcttgcgggacaaaaatcgccttaattggaaaagattccctaaaatacccgctatggatgaccgcgcacgcgcattactgaaagcgttgatcgaacgctacatcgccgatgggcaaccagtcggctcgcggacgctatcgaaggttttcgatctgtcgcccgcgaccatccgcaacgtcatggcggacctggaagaactgggcctgatccacagtccgcacacgtccgcggggcgcattcccacgccccgtggctaccgcatgttcgtcgattcgctgctggcggtgcagtcctaccagctcgaaccccacaacatgggcgacatgctggcggcggccgagcccacccgcgcggtcaacgccgccgcggcgctgctgtcgaacctgacccagttcgccggcgtggtgctgactcccaagcgggcccaggtctttcgccagatcgaattcatccgcctgtccgacaagcgcgtgctgctgatcatcgtcacgcccgacggcgacgtgcagaaccgcatcctgttcgtgcagcgcgaatacgccgaggccgaactgctggaggcgggcaatttcttcaacgtccatttcgccggcaagtccttcgacgcggtgcggcgcaccctctcgaccgaactggcgcagttgcgcgaagacatctcccggctgatgcaggcggcggtcgaggccagcgccgaagcggccgaggatggcgacgccgtggtcatctcgggcgagcgcaagctgctcgacgtcaccgacatcgcgtccgacatggaccgcctgcgcaagatgttctcgctgttcgagaaaaagaccgacctgctgcagctgctcgacgtgtcgagccgggcgcagggg

SEQ ID NO: 20175 - DNA, 345 bp, Glycine max
  Peptide Sequence Number=SeqID_111860
atgtctcgtcgcggtggctctaaacaacaaccagattcacgccatccagcaccaccgtctgcgggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtatttttctccttacgcatctgtgcggtatttcacaccgcatatggtgcactctcagtacaatctgctctga

SEQ ID NO: 20176 - DNA, 288 bp, Glycine max
  Peptide Sequence Number=SeqID_111861
atgaacaacatgcccacggtgctgattggcgcactctccattgatggcagcacggcaacaggattaattaaggacgcgatgatttacgccaacgtgattggctgcgatctggggccgaaaatcacgcccatcggtagcctcgccaccctgctctggctccacgtgctggcgcagaaaaacatgacgattacctggggcgactatttccggacgggcatcatcatgacgctgccggtcctgtttgtgacgctcgccgcgctggcgctacgtctctccttcacactgtaa

SEQ ID NO: 20177 - DNA, 554 bp, Glycine max
  Peptide Sequence Number=SeqID_111862
atgttcgccagttctccattctccacttttattctgagccccatgaatttattgcctagtgttgttcatgtgtcctccaccttcgagtctggagcccggcgaattgattgcctcgcgctgttcgccaattctcaattctccacttttattcggtgccccatgaattcattgcctagcgctgttcaagcatcctccaccaacgagtctagaggcctgcgaattgattgcctagcgctgttccccagttctccattctcaacttttattcggagccctattaatttattgtctagcgttgttcatgtgtcctccatcttcaagtctggagccccgcgaattgattgcctagcgctgttcgccaattctccattctccacttttattgggagccccatgaattcattgcctagagctgttcgtgtgtcctccaccttcgagtctggagccccacgattagattgcctagcgctgttcgccaattctcaattctccacttttattcatagccccatgaattcattgccaagcggtgttcatgcatcctccaccaacga

SEQ ID NO: 20178 - DNA, 660 bp, Glycine max
  misc_feature (639)..(639): n is a, c, g, or t
  Peptide Sequence Number=SeqID_111863
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctatggtggctggtcttgtgttgaatagtgaatatgtggaggggcggattcggatggggtttaggccgaaggctttgtgccttggggttggaggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagnccgagcggtgcgccttatccg

SEQ ID NO: 20179 - DNA, 621 bp, Glycine max
  Peptide Sequence Number=SeqID_111864
atgggtttatcagtccttgaaccagagatttctttttcctctttgtctaattcacttgtttcttgggcagaaacaacatgggcaatgaacatgacatgttttgcagaagacaaatttgacattcttaagcacaacaatctaaattctgccaaagaaggaaggggagttttggtcattcaaattggggtcaatgaacaagttatgtacatgcattggagtggagctgcatccacaatattggataattgtgcactatactatgatattataggggaattccatgccacggaaaatcagaagatcaaatttgggcaggtgattcaagagatgggggatgctagccttaaactaattgcttttgcttatagacaaacagatggagaacaacttcaacaagaagaactgataggtctcaaatgcactaatagtcttgaatccataaaatcagctttggaaaatgatgacatcatggaagtgaaagccatagcttctggactaagactagaacatggtattgtgctcgaaggaagaaaagttaaagatttgaatgaggaagctattagaagaagtggatcagcccatgtaatggcaaacttgcatcctgaagacaaacttctatga

SEQ ID NO: 20180 - DNA, 354 bp, Glycine max
  Peptide Sequence Number=SeqID_111865
atgtccaagtatggtggctggaatgctctgattcatggcagaaactccacagctttctctaactggtggaaggacttaaaatctattttccagcagcagcacactaataggctgtccaataatttgtgttggaagttgggtaatggggctaaaatcaggttctggaaggataaatggagggaggatgatttaactcttcaagaaaaataccctactttgtatcaagtgagctaccagcaggatttttctatcagcctaatgggaattcttgttgataataaatgggaatggaggatgcaatggaggagaaacttctttgaccatgaaatcgatggtagcagcctttatggatga

SEQ ID NO: 20181 - DNA, 366 bp, Glycine max
  Peptide Sequence Number=SeqID_111866
atgacggtgacatacaacaactgcaaagagagatgtgtagtgccaccgattacaaaattaaatcaattggaggaacgatgcacgaccttggctccaaagaggactcctcctgtaatagaaaataaaccactcagacataggtggctgagacgtggaaatcagcatattggcaatgatgatctgatagtttttcgtcgcaaattggatatcatgaagcgacatgagtttcagtgggagccttatacaacaactgttatgtcagcgttgcctccaatttgtttgattggaagtgtagcatggtgcgcggtggtgccactcatctgtttccatgttgttgagtggcaccaatccgatagagttttgtga

SEQ ID NO: 20182 - DNA, 615 bp, Glycine max
  Peptide Sequence Number=SeqID_111867
atgttgactagaagaaccttggatcagccgcgacctattgtcaccgttgatgctgcaattgggcaaggattgggcccacataaagagagattccacagctatttaggtgttgtagctagagaaaaggttccaattgtacataacaattggaaggatgttccggacacactaaaggagctagtatggaatgacattttggccaagtttgatatcccaaaagccctacatgcaaagaaaaaggaccaacataaagaagatccttccgtcaaatatggctttgatgcacaaatatgggaggaatttgcggcaacccgcaaaacccctaattggcagggaattaggaagaagatgcaggaaatcaaaaagaataatgactgtcctcattttctttcccgtgggggatatgatttgctagaaaagaagttgttagacgagaaaatcaagaaaaggcagcatgacgcattgatgactgaaaatccagcactcattgaggaccccccatctcccattaaaagacatgtcaagtggaagatggcacgcacaaaccgatatgggaagatgacatctgaggctgcaagacaaattgctgataaaattggaagtctaacgatgtga

SEQ ID NO: 20183 - DNA, 609 bp, Glycine max
  Peptide Sequence Number=SeqID_111868
atgtcaggacatcgtgtccgacatcgtggatcctgcagcttcacttctgcacttgacttttatcttgcattgtacagcaattccagtattctcgggcaggatgtcaggacattgtatccgacatcgtggatcctgcaacttcaattcttcatttgccattttatcttgccttgtacattgtgcagcccgatctcattccttgacataacgttggacatcatgtataggcttgaggtgatgatcaaccacggagatgaaagcacaaaattcctgctttgggaccgtgaatgtagtgaattaattggtcaatcagctaatgcagttaataagcttaaaattgaagatggtgatgttgatttaactgcttcaccccaagcacttgataagctgctgggttatgaacttgcttttaagataaaggtgcaacccaagttcaggaattctgctgttttgaaatgttcaactgactcaagcttaataaatgttgtgatggatatgctagctgatgctgagacatcttcaaaaatcaatatcccagcctttgattccaatcattctacccaacatgaatttgtgagttttgatcatgaccctcatcttttaatatga

SEQ ID NO: 20184 - DNA, 522 bp, Glycine max
  Peptide Sequence Number=SeqID_111869
atggcattcttaggagaagctgcatctcagacgatcgtcaactcatggttggcattcatttttccaaatggagtcgtcattcacaatgagtgtggggtttattttcaaagttctactccagtgtttcatgagagtaacaacattcacttccaatgtatgcaattgaaacatgacatggatgtgaaaaccatgttaatgtgtaatgatcaattttcatgtgttggaccgattgagttgttatgcaccattggtagaacaccagatgcaattttaaacttacttcaatgccccagcatccctactcatgatgcggttctgtattacaacggaaggtggaacatgccacgccaaaacaactttatgggttacacgttcacaggaataaatccccaaaaatttgatattccaaaaggatgtaccatagatgaactgaaggatttgatcaagcaagtagcacctaaagggaatcctcctcatgggattcatgaatcccaacttgtaaggcgtttgttttatcgataa

SEQ ID NO: 20185 - DNA, 312 bp, Glycine max
  Peptide Sequence Number=SeqID_111870
atgcaatttcagcaagaaataagagcctccattcagagtctgacgaatcagatggggcagatggatactcagttaaaccaagctcagtcccataattatgacaaattgccttcacaaactgtgcagaatccgaaaaatgtgagtgccatcaccttgaggtctggcaaccaaattcaagtgcctccaccagtagcagcacctgtatctgaacctgtcaagcttcattctacacctgaaaaagaggatgagatagttgcacaaaagagaaagcttcctatcaaaaaaatttcatgcaggtggaccttcatctag

SEQ ID NO: 20186 - DNA, 362 bp, Glycine max
  Peptide Sequence Number=SeqID_111871
cattgatcacgggtctctgccagtcattcagggttcccgtcacacctagtaaggtgattcgacctccgatcacccgggccttcattgagaagtattacacgcctagacaggcgcagggtgatgcaccgcaggccgcagacgcaccgccaccacctcatcaggctgatccagttgggtcatttggcatggagcggtatttacagcacttggttcgccagcaggcggccaaccacagggggcaggtgcagatccatgagtgtctctaccagcttagcctcaatcagcaaagccagggtttcgctccttttgcatgccttactccagatcagttcagggcggaggtcacatggcacggagattag

SEQ ID NO: 20187 - DNA, 378 bp, Glycine max
  Peptide Sequence Number=SeqID_111872
atggatcaactttattttgatggcatatctatatgcagtcacgtaggcttcccaaatctttttattacttttacttgcaatccaaattggcttgaaattcataggctgctgacacctttgaatttgacagcaatagataggccaaaaataatctcccgcattttcaagcttaaatatgagcagatgttatcacaccttacaaagaatcacctgctaggcaaagtcgtcgcattagaaataccttcacagaaagatgatccagaactctataacttagtgcaaaatcacatgattcatggtccatgcggaattttgaggcctgcatctccatgcatgaaggaaggcaaatgcagtcgattttatccaaaaaaattttag

SEQ ID NO: 20188 - DNA, 888 bp, Glycine max
  misc_feature (370)..(370): n is a, c, g, or t
  Peptide Sequence Number=SeqID_111873
atgacatcaataaatgactctacccttatgcccgctgcgctgcgggatacacgccgcatgaaccagtttgtctctgtggccgccgccgtggcgggcttattattcgggctggatatcggcgtgattgccggcgccttaccgtttattaccgatcactttaccctgagcagccgtctgcaggagtgggtggtgagcagcatgatgcttggcgcggctatcggcgcgttgttcaacggctggctctcgtttcgtctggggcgcaaatacagcctgatggtcggggcggttctgtttgtcgcgggctccattggctccgcatttgccacgcacgtggaggtgttgctgctctcccgcgtgctgctgggggtgncggtggggattgcctcctacacggccccactttatctctccgaaatggcgagtgagaatgtccgcgggaagatgatcagcatgtaccagctgatggtcaccctgggtattgtgctggcgttcctctctgacacttacttcagctacagtggcaactggcgcgcaatgctcggcgtgctggcgttaccggcgctggtgctgatcgtgctggtgattttcctgccaaacagtccgcgctggctggcgcaaaaagggcgccacgtggaggcggaagaggtgttgcgtatgctgcgcgacacctcagaaaaagcgcgtgaagagctcaatgaaatccgcgaaagcctgaagctgaagcagggaggctgggcgttgtttaagatcaaccgcaacgtgcgccgcgcggtcttcctcggcatgctgctgcaggcgatgcagcaattcaccggcatgacatcatcatgtactacgcgccacgcattttcaaaatggccgggttcaccaccacggaacagcagatga

SEQ ID NO: 20189 - DNA, 666 bp, Glycine max
  Peptide Sequence Number=SeqID_111874
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttacatttgcatatcatggttaggactagaggcctaggccgtgccttaggtagggttagtggcagaggtctggggaaagaggatcgtgatgattctgacgatgctccccagaggcgaagaccgaccgcattcgcatgcaggcaacgggtacttatcactgttgctgacgctgagccagtggtacctgcggctaaggctgacgtagctgtgactgaggctgacgtagtagcggatgagccaatggtagaagttgacgtacatgacactggtgcaaacactgctgcatacaccggtgcacaggctactgtagatgagcctaagggattcctaggtggactgactgacccatcagtgctgaccaagtatgttgagcatgttgcagctagcgtatggaccggggaggagagtcctaagttgaagttatcctcccatgggaggaaagtgcataatttaggtaggcatatccctgccattgaggggctagttgctaggacatga

SEQ ID NO: 20190 - DNA, 868 bp, Glycine max
  Peptide Sequence Number=SeqID_111875
ccacagggcgtcgccgtcttgcggctgggggcaagaccggcggaatggcagtgggcggcgagttttaccggtacctgaaacagcggggcgaccagcaagctgctgtctcctgctccctgcgcggcgtcgatcgccgcttgcaacgtcctggcggcgtcgcgtggatggccgtgcatcaccaccagtgcgctacgcggctggggggagcgggcgtgagcgacaaaataaggcagggaaccggccgccgtcggcgcgcgatagggcgtggcgaggcgctccaacaccggctctgcacgaaccgattggccgaacagcagcagggcggccattgcgatgcaccgcaggcagcgcattctcgtcaggctcggcgcagcgcagtgcgcatttgtctcaggacttcccggcatcgttgttcctcacgcgctcgttggtagtagcgataaaaggcgcgttccgagctgaggttacccgcgcgtgccagctgtctgaaggtcagtaccagcagcgtgacgaacagcaaatacagcaaaaaatagcgacacgaaagcaggaaacgtttgaaagcgttattggcgcttggccgcaaaacgaagcccgcggacgtggcgcgcaagatttgctggcggccaccggtgaagcgataacgttccagcgccgctacgctgtccggcaatgccagcagcagttgcagcgcagtaaggccggcgctgctattgccgagatagtcgcgaaatcgcaacaggcgtatgggggcgctctggcgcttctcgacggattcgagcaggttcagcagcttatcgcggttttcccgccgaatgcgaaaaggggttttgacgacggcgataaacagcgtaatgacggtcggtaa

SEQ ID NO: 20191 - DNA, 63 bp, Glycine max
  Peptide Sequence Number=SeqID_111876
atgcttggaagtgcgcttagtgcacctgttgcgctaagcctgaactactctctaaagcgctaa

SEQ ID NO: 20192 - DNA, 309 bp, Glycine max
  Peptide Sequence Number=SeqID_111877
atgtatttgttaaatagggttcctagtcaagagttcctaaagacacctgctcatggacaacataggacacctagtacaaggcacctgcgacgtttggggttgccaggcagaaataagaatttacttccgcaagaaagaaaattggatgcaagaacaatcagtggatatttcattggtctatccagaaaagatcctaaaggggtatcatgttcattatccattatgactagctacatcatagtagtgagaaacttgtctgaatggagactggagaatatttgtatgaaccaaccaatggggtttcattga

SEQ ID NO: 20193 - DNA, 168 bp, Glycine max
  Peptide Sequence Number=SeqID_111878
atgacagaagtcagtaaaaatttgataactcagtcaagattaacaacaatcatcaagaccatggataaccatgagcatgcaaatcattgtgatacagcacaagctaggataaagaataaaggtatcaggcagcacaaagttaatgatcaggctcagaatattgattga

SEQ ID NO: 20194 - DNA, 420 bp, Glycine max
  Peptide Sequence Number=SeqID_111879
atggattactacctaattacatgccaccagtcatacatgatgacgcgggtcatgtccctccccccatccttgaaggggagcctcctcgacagtcggacgaggttcacaaggatcgtcgagagcatgcccaaggagacattgattcctactccccgttcctcgtcgagggaccggcacccaacacacttccttagtccaacctcatgggagaacctcgaaaccccccaacacagccaatatttttgctttggcgactatccgttcgtggacatgactgatctttgcttagtaccagacgtcatcatcccccctgatattcaagatagcttggctggggaagcggtcatctggtacactaatcaagaagcttcctgcatccgcacttggaaggatctagttaccgcattccttaggcagtag

SEQ ID NO: 20195 - DNA, 123 bp, Glycine max
  Peptide Sequence Number=SeqID_111880
atgtcatggtcacttgaggacaagttaattaggaaagctttagaaagtgttgtttttcaccttctcgctaagccaatctgttggcttagcgagcatccgctaagcgcagcactcctgggctaa

SEQ ID NO: 20196 - DNA, 492 bp, Glycine max
  Peptide Sequence Number=SeqID_111881
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaccgttgcgccttatccg

SEQ ID NO: 20197 - DNA, 342 bp, Glycine max
  Peptide Sequence Number=SeqID_111882
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggcgttatgtcaactgttggtacccttcaaatgtttctgcttgtctcccacattctttgctctattccaccctccttcgctgacaagacaaccaccaattaa

SEQ ID NO: 20198 - DNA, 484 bp, Glycine max
  Peptide Sequence Number=SeqID_111883
gactacactcctcgccaacagagggctgcacgccttcaccttgagaggactacacgtcctcgccaacgtagggctacacgccctcacctttagaggactacacgtcctcaccaacagagggctgcacgccctcacctttagaggactacacatcctcgccttcagaggactccacatcctcaccttgagaggactacacgtcctcgccttgagggactacacagggctgcatgccctcacctccagaggactacacgtcctcgtcttgagagggctgcacgccctcacctttagaggtagtttccttttaacggttcctgggccaccccctgatattggaggagggccaactatgcgagcacaaccagagagggaggctatcacacagctactatgcataccggggcaagatttcacccgtgccgctgcaaagagacgagtgcggatcatgcgcaccaacatgaccactcttacacagatatag

SEQ ID NO: 20199 - DNA, 240 bp, Glycine max
  Peptide Sequence Number=SeqID_111884
ggagaacaatgaggagttgtatgaaagaattgagagattagagaatcgtgaacgtcatgaggaagaaagaagaggaggaaatggtggtgatccaaggccaaaccgaattgaaggagttaagctcaacattcctccttttaaaggcaaaagtgatccaaaggcatatttggaggagagagctagaaatgaggagcctttggtggaaacttgggttgagatgaaacggatcatgaggaagcg

SEQ ID NO: 20200 - DNA, 681 bp, Glycine max
  Peptide Sequence Number=SeqID_111885
atgaaaatcattgctgacttcgaactctctgcgctgctggtcacccgctccgagcaggggatgaccctgctgcaaccgggtaaagcgccgctgcatatgccgactcaggcgcaggaagtgtacgacgtgaccggtgccggtgatacggtgattggcgtgctggcggcaaccctggccgcgggtaactctctggaagaggcgtgctattttgccaacgcggcggcaggcgtggtcgtcgggaaactcggtacctctaccgtttcgcccattgagctggaaaacgcggtacgcggtcgtgccgataccggttttggcgtcatgagcgaagacgagctgaaagtggccgtcgccgctgcgcgcaagcgcggtgagaaagtggtgatgaccaacggtgtgttcgacattctgcacgcgggccatgtctcttatctggcgaatgcgcgtaagctgggcgatcgcctgattgtggcggtgaacagcgatgcctcgacgaaacgtctgaagggcgaaacgcgcccggtgaacccgctggaacagcgcatgatcgtcctcggcgcgctggaagcggtggactgggtggtgtcatttgaggaagacacgccgcagcgcctgattgctggaattctgccggatctgctggtgaaaggtggggattactaccaaacggggggatgcctctag

SEQ ID NO: 20201 - DNA, 427 bp, Glycine max
  Peptide Sequence Number=SeqID_111886
atggggtttttgcaagatgataaagaattcattgaggcaatcaaagaagcaaaagactggggctcaacacattatataagaaagctatttgtgttgttacttttaactgcaacaatgaacaaacctgaacaagtttgggcccaaactaggcattggatggctgatgacattgtctataattataaaaaatcatcaacaagtccagcattacagcttgatgatatgactcttcaaaatctggtcttgcttgaaattgaacaactattgcaagcaaatcaaagatcacttacagactatccttcaatgtcatatccagaagatgtgaatttcccaacctatctagacaatagccttatattagctgaactcaattacaacaatcaagaactcagatcagagtttgaacatctattttctcatatgacag

SEQ ID NO: 20202 - DNA, 249 bp, Glycine max
  Peptide Sequence Number=SeqID_111887
atgttgtgcaaaaaagcggttagctccttcggtcctccgatcgttgtcagaagcgtatcacgaggccctttcgtctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggctggcttaactatgcggcatcagagcagattgtactga

SEQ ID NO: 20203 - DNA, 525 bp, Glycine max
  Peptide Sequence Number=SeqID_111888
atgaccactgtgacccagatgtggatgacgttttggctcagcaatgtcttgcctagtgatcataactccgatctccctctgccgaaagtggtcagctggtgtatgccacccacctggcaccctctagacccgaataagtctaatagggccctggggtttccggcattgatcacgggcctctgccagtcattcggggttcccgtcacccttagtaaggtgatccgaccgccgatcacccgggctttcattgagaagtattgcatgcctagacaggcgcaggatgatgcacctcaggacgcagacgcaccatcaccacctcatcaggccaatcccggtgggtcactaggcatggagagttatctacagcacttggttcgccaacaggcggccaaccactgggggcaggtacagatacatgagtgtctctaccgcttcaaccttagtcaccaggggcagggtttcgctccttttgcgtgccctactccagagcagtttagggctgaggtcacatggcccggagattag

SEQ ID NO: 20204 - DNA, 797 bp, Glycine max
  misc_feature (639)..(639): n is a, c, g, or t
  Peptide Sequence Number=SeqID_111889
gactacacgtcctcaccatcagagggctgcacgccctcacctctagaggactacatgtcctcgccttgagagggctacacgccctcaccttgggtactagttaccctcaccgtcagaggactacacgtcctcgccttgagaggactacacgtcctcaccatcagagggctgcacgcccttaccgtcagagggctacacgccctcaccttgagaggactacacgtcctcaccatcagagggctgcacaggggcatgccctcaccttgagaggactacacgtcctcaccatcagagggctgcacgccctcacctctagaggactacatgtcctcgccttgagagtgctacacgccctcaccttgggtactagttatcctcaccaccagagggctgcacgccctcacctccagaggactacacgtcctcgccttcaaagggactacatgttccccattttcaaagaggggcatgccctcacctttagaggattgcacgtccttgccatcataggactacactccctcgccttcgaaaggctacacgtcttgaacttcagagggctacacgccctcgcctttagaggactatgcgtcctcactttcagggccagtagtttccttttaacggttcctgggccancccctgatattggaggagggccaactgtgcgagcacaaccagaaagggaggctattacacagctactatgcataccggggcaagatttcattcgtgccgctgtaaagagacgagtgcggatcatgcgcaccaacatgaccactcttacacagatatag

SEQ ID NO: 20205 - DNA, 396 bp, Glycine max
  Peptide Sequence Number=SeqID_111890
atggcgagtcaagaagagtgggtcccgtttgcggatatagtagctttgctaatctttggggttgtcctctttgcgacgtggacggaaggaaaggagggagttcccttctcatgtggggactacccaaacattccattgatagggacaaggggttgtattaactataatcccgcacttgctataagacagttagggtaccccatgaggggagcaccgacggaagagagcctctcgcctttccttgtgagagatttcagcgtgcaaagtttcaagatcgtacacagagtccataaggcgtgggaaagcccgttaaggaaagataaaaaacttaggggcatccgtaatggcatcatcgatggttatcatgaatggataagagtcatacacgagggttag

SEQ ID NO: 20206 - DNA, 213 bp, Glycine max
  Peptide Sequence Number=SeqID_111891
atggtagtggaatggagaaggagaagaggtgagaggagacaccacttcaaggagaagatgagtcaagaacaagctcaccataggaagtcatggataagagcttggagcctactaatccaagatcaagtccatgattcttcactaagtgtgcttaggtgtcatgaggcatgtaaagtaggaaggacatgcacaaagtgtgattatatgatgtga

SEQ ID NO: 20207 - DNA, 423 bp, Glycine max
  Peptide Sequence Number=SeqID_111892
atgaccagaaggcttcttgccggttcaattggccttttgaaagccgcatccttcatgatctcattgtgcgtatcttgcttccaagatcttcaaaccttgcacagatccttcttaattggtgccgctgtgattgcatcctttggttaccaaaaagagcatgatggctcttgggtgaaaaagggtgctcaaccaaatgatggagaaggacatttacaaggtggagaagattcctctcttcttcaaaagattttggacaggttcgatggtcttcaaacctttgttggtgaaaggtttgatgctttggagttacaagtggacatgagatttgatgagatggattcaaggattaccaaggtcgaagaagatgtctcttacattcgcacaagctttgatctaccaccaccaccgccaccatcatcttag

SEQ ID NO: 20208 - DNA, 670 bp, Glycine max
  Peptide Sequence Number=SeqID_111893
atgaccggccctcttgatgagtcaatctcttactttctcataagggtggacccttggagggctacatgtcctcgccttcagagggttgcacgccttcaccttcagagggctacatgtcctcgccttcagaaggctgcacgccctcgccttcagagggctacacgccctcgccttcagaggactacacgtcctcaccttcagatgactacacgtcctcgccttaagagggactacacgtcctcgccttcagaggagtacacgtcctctccttcagaggggctacaggtcctcaccttcaaaggagtacaggtctcttgccttcagaggactacatgtcctcaccttcagaggactacacgtcctcaccttcagaggactacatgtcctcgccttcagaggactacacaccctcaccttcagaggacaacacgtcctccccttcagagggctacacgccctcaccttcagaggactacacctcttcgccttcaaagggttacacgccctcgccttcagaggactacacgtcctcgccttcataggactacacgccctcaccttcagggggctacacgtcctcaccttcagagaactacacaccctcgccttcagaggactacacgccctcaccttcagaggactacacgtcctcggcttcagaggactacac

SEQ ID NO: 20209 - DNA, 1094 bp, Glycine max
  Peptide Sequence Number=SeqID_111894
atggtcaagcttgggctggtgcggttttcgctgctgctggcttcggcgctggtggtgctggcaatggtggtgcagatggcggtcaccatggtgttgcgtggccacgttgaaagtatcgacgtcgtgcgttcggtgttttttggcctgctgattaccccgtgggcggtctactttctctccgtggtggtcgatcagctggaggagtcgcgccagcggctgtcgaagctggtggacaagctggaggagatgcgcacgcgcgaccttgaactgaatcagcagatgaaagagaccatcagccagctgaaccaggaaatcagcgaccgtattaaagcagagcaggcgcgcgagcaggtgatggataagctgcgcgaagagatgacgcggcgtgaacaggcgcagattgaactggagcagcaatcttccttcctgcgttcgttccttgatgcctcgcccgacctggtgttctatcgcaacatcgacaaacagttctctggctgtaaccgcgccatggaactgctcaccggcctgagcgagaagcaactgattggcctgacgccgcgcgacatttatgacgaagatgccgccaccaaagtgctggagaccgatgagaaggtgtttcgccacaatgtgtcgctcacctatgaacagtggctgcagtatccggacgggcgcaaagcctgctttgaaatccgcaaagtgccgtattacgaccgcgtcggtaagcgcagcggcctgatgggcttcggacgcgatattaccgagcgtaagcgctatcaggacgcgctggagaacgccagccgtgaaaagaccacctttatctccaccatcagccacgagctgcgtacgccgcttaacggcatcgtcgggttaagccgcatcctgctggataccgatctcaaccaggagcagctgaagtacctgaaaaccattcacgtctcggccatcaccctcggcaacatctttaatgatgtgattgaagtcgacaagattgagcggcgcaaagtgcagctggataaccagccgctggatttcaccggctttctcgccgacctggaaaacctctccggcctgctggcgcagccgaaagggctgaa

SEQ ID NO: 20210 - DNA, 1809 bp, Glycine max
  Peptide Sequence Number=SeqID_111895
atgattgatcacatcgacgtgattcgcgggccggccgcggtgcgctacggtaacggcgcggcgggcggtgtggtgaacatcatcaccaaaaagtacagcgatcagcagtggcacggttcgtggaatacctacttcaacgcgccggaacacaaatcggaaggggcaaccaaacgcaccaacttcagccttgaagggccgctgggcgacgacttcaacttccggctgtatggcggcttagccaaaacccaggccgacgcgtacgacatcaatgaagggcacgcggcagcgcgcaccggcagctatgctggcagctacccggcaggccgcgaaggctcggtgaacaaagacatcaatgcgttgctgagctgggcgtttgcccccatgcagacgctggagctgcaggctggttacagtcgtcagggcaacctgtacgcgggcgatacgcagaacaccaacactaacgcgctggtgaagagcctgtacggcgatgaaaccaaccgtctgtatcgccagaatatttcactgaaatggaccggcgcgtgggacaacggcatcagcaccagcagctgggcgcgctacgagaaaacccgcaatacgcgcattaatgaaggtctggcgggcggcacggaagggatcttctccaacagcgggttcaataccatccagctggacgatgtgctgctgcacagtgaaatcagcctgccgtttgagctgggcgtcaatcagaccgcgacgctgggcaccgagtggaaccagcagcgcatgaaagatccttcgtcgaccacccaggccgccagcaatggcgctgtgccaggcatcgccagcaccggccgcagtccttatgcccaggcggagattttctccctgtttgccgaagacaacatggagctgaccgacagcaccatgctgacgccggcgctgcgcttcgatcatcactccatcgttggcaacaactggagcccgtcgcttaacctgtcacaggggctgggcgatgacttcacgctgaagatggggattggccgggcctacaaagcgccgagtctgtaccagacgaacccgaactacctgctgtacagcaacggccagggctgcgccgccagcaccggcgcctgctatctgcagggtaatccgaatctgaaagcggaaaacagcatcaataaagaagttgggctggagtggaagcatgaaggttatcaggccggtctgacctggttccgtaacgactaccgtaacaagattgaagctggctatgcgccttcaggtaaagcctctaacggcaccacggatatctatcgctgggagaacgtgccgaaagcggtggtggaagggctggaaggtacggtcaatgttcctttctctgacagcgtgatgtggaataacaacttcacctacatgctgcagagcaagaacaaggagaccggtgatcgtctgtcgatcattccggagtatacgctgaactcgacgctgagctggcaggcaacgcaggatctgtcgctgcaaaccaccctgacgtggtacggcacccagacgccgaagaagtacgactacaaaggacagccggtgaccggcagcgccaccgacaaagtgagcccgtactcgattgtcggcctgagcggtacttacgatatcaataagtacgccagcgtgacgctgggcatcgataacctgttcgataagcgccacttccgtgagggcaatgcgcaaaccaccggtaacgccaccaccggcgcttatctctacggtgccggtgccaatacctataacgaatcaggccgtacttactatatgagcctcaacacccacttctga

SEQ ID NO: 20211 - DNA, 627 bp, Glycine max
  Peptide Sequence Number=SeqID_111896
atggcacctgccgatgtggcgtcaattgtggtggatgaagacaatcacaccatggatatcgctgttgaagccggcaatctggctcaggcgattggccgtaatggccaaaacgtgcgtctggcatcccagctgagcggctgggagctgaacgtgatgaccgtcgatgatctgcaggcgaagcatcaggccgaagcccatgcagcgatcgatatgttcactaaacatctcgacatcgacgaagagttcgccaccgttctggtggaagagggcttctcttcgctggaagaattggcttacgtgccaatcaacgagctgctggaaatcgacggcctcgacgaagagaccattgaagccctgcgtgaacgagcaaaaaatgcgttaaccaccctggcattagcgaaagaagagagccttggtaatcaggaacctgctgaggacctgctgaatcttgaaggcctggatcgtgcgctggcgtatcgcctggcgtcaaaaggcgtttgcacgctggaagatctcgctgagcaaggtgttgacgatctgacagatattgaagggctggatgatgagaaagccggtgcgctgattatggctgcacgtaatatctgctggttcggcgatgacgcgtaa

SEQ ID NO: 20212 - DNA, 972 bp, Glycine max
  Peptide Sequence Number=SeqID_111897
atgaccttcagccaggctgagctggatgtggcgctggagagctttcgcggcgagacgctgcagttgcccaccatgttctcggcgctcaagtatcagggccgcaagctgtacgaatatgcgcgcgaaggcatcaccgtgccgcgtgaagcgcgaccgattaccgtgtttgaactgcagtttattcgctggcagggcgacgagctggaactggaaatccatgtttccaaaggcacctacattcgcaccatcattgacgatttaggtgagaagctcggctgcggtgcacatgtaatcatgctgcgccgtctgcaggtggcgcgttacccgattgcgcgcatgatgacgctggaacagctgcaggcgctggcggcgcaggttaatgcggcggaaacgccggattacgcaccgctggacgcgttgctgttgccaatggacagcccggcggaagattttccagcggtcaatctgcccacgccgatcgcggcctggttcaaacagggcatgccggtccaggcggaaaacgcgccggccagcgggctggtgcgggtgaccgaaggtgagcagcagaaatttatcggtatggcggaaatcgccgacgatggtcgcgtggcaccgcgtcgtctgatagtggacgtagaagctaaagcagagatcgttgctaaatacggtcgtggcgctaacgacagcggttcaactgaagttcaggttgctctgctgactgctcagattaaccacctgcagggtcacttctctgagcacaagaaagaccaccacagccgtcgcggtctgctgcgcatgcctgatcgaaagcctgggtctgcgtcgctaagtctgaagaatctgatcaacgatgtagcgcatgcacaatccggaccaaactcatgtattgttgctgagagtgatctttgcttgcagaggttcgcgcggctaatgagaggctttaccgcaggggcggttaagggttgtcattag

SEQ ID NO: 20213 - DNA, 1606 bp, Glycine max
  Peptide Sequence Number=SeqID_111898
atgactgatattcaaaccacttttgctgatctgggcctgaacgccgacatcctcgaatcactgaacggtatgggctacgttaagccatcgccaatccaggctgagtgtattcctcacctgctggcgggccgtgatgtgctgggtatggcgcagaccggtagtggtaaaacagcagcgttctcgctgccgctgctgaacaacgttgatccttctgtccgcgcaccgcaaatcctggtgctggcgccgacccgcgaactggcggttcaggtggctgaagcgatgacagaattctctaaacacatgcgcggtattaacgtcgtggccctgtacggtggccagcgttatgacgtgcagctgcgcgcactgcgccagggtccacagatcgtggttggtaccccgggccgtctgctggatcacctgaaacgcggtaccctggacctgtccagcctgcgtggtctggtactggacgaagccgatgaaatgctgcgtatgggcttcatcgaagacgttgaaaccatcatggcgcagatcccggaaggtcatcagaccgcactgttctctgcaaccatgccggaagcgattcgccgtatcactaagcgtttcatgaaggatccgcaggaagtgcgcatccagtccagcatcactacacgcccggacatttctcagtcttactggaccgcttacggccgtaagtctgacgcgctggtgcgcttcctcgaagcggaagacttcgatgctgccatcatcttcgtgcgcaccaaaaatgccacgctggaagtcgcagaaacgctggagcgtaacggctacaacagcgccgcgctgaacggtgacatgaaccaggcgctgcgtgagcagacgctggagcgcctgaaagacggtcgtctggatatcctgatcgcgactgacgttgcggcccgtggtctggacgttgagcgtattagcctggtggttaactacgacatcccgatggatgccgaatcgtatgtgcaccgtatcggccgtaccggtcgtgcgggtcgtgctggccgtgcgctgctgttcgttgagaaccgcgagcgtcgtctgctgcgcaacatcgaacgcaccatgaagctgactattccggaagttgagctgcctaacgccgagctgctgagtcagcgtcgtctggcgcagttcgctgcgaaagttcagcagcagctggaaagcagcgatctggatcagtaccgtgcgctgctggcaaaaatgcagccagaagaagagctggatatggaaacgctggccgctgcactgctgaaaatggcgcagggcgaacgtccactgattctgccaccggatgcaccacgtccacagcgtcgtgaattccgcgatcgcgatgagcgtggcggcgaccgtccacgtcgtgacagccgtgacagccgcgaaggtggcgatcgtccacgtcgcgaacgtcgtgacgttggcgaaatgcagctgtaccgcattgaagtgggccgtgatgacggtgttgaagtgcgtcatatcgtgggcgcgattgctaacgaaggcgacatcagcagccgttacatcggtaacatcaagctgtttggtactcactccactatcgagctgccaaaaggcatgccgg

SEQ ID NO: 20214 - DNA, 640 bp, Glycine max
  Peptide Sequence Number=SeqID_111899
atgcggttgcgcctagtccctgcgccacagatttgcaggatcgtgcaaaaagcttgcaggattgcgctaccgcacaaagcggcaacagcgcatgctttactcacccgaaatctcaggtggagagacacaatgcaagcacttgaaggcaaaattgcgctggtgacgggcgcgtcgaaaggcattggcgccgccatcgccatgactttcgccgcggccggcgcccgggtggtggtgaattatcgtcaggatgaagcgggcgcggcggatgtggtgaccgatatctgcgcgctgggaagcgacgccatcgccgtacaggccgatatatcccgtgaagctgacgtgcagcgcctgttcgccagcagtattgcgcagtttggcgcgccagacatcgtggtcaacaacgccggcatgtttcaccatggcgacttcgccagcctcagcgtcagcgacatgcagcagcagctcaacgtcaatctgctcggtacgctgctggtgtgccagcaggcggcgcagcattttccggcgcgcggcggctgcatcataaacctcagcgcgctgaacagccagcgtagcctgcccggctcggtactgtggtcagcgactaaaggcgcgatcgacaccttaacgcaggggctggcac

SEQ ID NO: 20215 - DNA, 581 bp, Glycine max
  Peptide Sequence Number=SeqID_111900
cagcgtgcccgcgatgcggccgatgcggcgcttgcgcagcagcacagcagggcgaacagcacgctgacgcccagcataatccagtaatcccgcgcaaaggcgtgcgcatcgatcgcgccgggatgcaccagcgccggcaggcccagcacaatcgccagattgaagatattggcgccaatcaggttgccgatggcgatatcgtcttcgcctttcagcgcgccggccagcaccgtggccagttccggcagactggtaccgacagcaatcagcgtcagtcccatcaccagttcgctaacgccgaagtaatccgcaaacactgtggcgttgtcgatcaccatgcgcgtcgacatcggcagaataatcagcgccaccgccagccagagaaacgccaccgtgttgccgctttcgtcgcgcggcagctccgccagttgttcacgcgtcagggtgtcattattatcgcgctcggcccgccgggcgatgcggatcgccaccagcagataacccagcgccagcagcagcagtgccacgccatccagccggctgagctggttatcaaacagcatgatgccgctgagcagtga

SEQ ID NO: 20216 - DNA, 1821 bp, Glycine max
  Peptide Sequence Number=SeqID_111901
atgaagtttgttgatgaagcgacgatcctggtggtcgcgggtgatggtggcaacggttgcgtcagcttccgccgcgagaagtacattcccaaagggggaccggacggcggtgacggcggtgacggcggcgatgtttacctgctggcggatgaaaacctcaacaccctgatcgattatcgtttcgaaaaatctttccgcgccgaacgtggccagaatggccagagccgtgactgtaccggtaaacgcggtaaagacatcattgttaaagtgccggtcggtacgcgcgttatcgatcagggcacgggcgaaacgctgggcgacatgacgcgccatgagcagaagctgatggtggcgaaaggtggctggcacggtctgggcaacacccgcttcaaatcgtcagtgaaccgtacgccgcgtcagaaaaccatgggcacgccgggcgagaagcgcgacctgcagctggaactgatgctgctggcagacgtggggatgctgggtctgcctaacgccggtaaatcgacctttatccgcgcggtatcagcggcgaagccaaaagtggcggattatccgttcaccaccctggtgccaagcctcggcgtggtacgtatggacagcgaaaagagcttcgtggtcgccgacattcccggcctgattgaaggcgcagcggagggggcgggcctcggaattcgcttcctcaagcatctggagcgctgccgcgggctgctgcacctcatcgacatcgcgccaatcgacgaatccgatccggtagagaacgcccgcatcattctcggcgagctggagaaatacagcgacaagctgtaccagaaaccgcgctggctggcggaaagccgcgccaaagcgattgccgaagcgctgggctgggatgagaaatactatctgatctccgccgccagccgtgacggtgtcaatgagctgtgctgggatgtgatgagctttatcattgcgaatccaaaagaagcggaagaagaagcgaagcagccagagaaagtggccttcatgtgggatgattaccaccgtgaagcgctggaaaatgctcaggaagtggaagaagacgaagactgggatgacgactgggatgaagacgacgacgaaggccgcagagcaccagcccgtacaatcattccttctccccgcgggagagagcaccaggccgcaccatcattccctctccccgtgggagagggcagggtgagggcatcaggccgcagcggaaccaaacctaccccagcaccgccaccgtcagccgcgaactacagcacaactgatcgcgaccattgcgtatctcaatctgccagctctgattgcgcgcccccagatgcagcggacgacaaacaccgcgcacctcgccgctgctcaccgcccgatgatggctggcgctcacctcaatgcccaccacgcttttaccttcttccacgctcaggtaaccggcaatggagcccatcgactccgccagcaccaccgacgcgccgccgtgcagcagaccaaacggctgctgcgtgcggctgtctaccggcatggtggcctccagataatcgtcaccgatggcggaaacacgatgcccagatgcgccaccagcgagttatcgcccagctgattcagcgtggcgatatccaccgtacgtttccagattgccatgcctcaggctcccagcgttggcgccaccgtccaccacaatatcctgcagcaccacgtggctggcaagatcccgaggccaggaacagatgttgttcacgatcttcctgcggtgggcgatcttacgcagcgggatccccagtttgtactgatccgggaaaccgttaa

SEQ ID NO: 20217 - DNA, 643 bp, Glycine max
  Peptide Sequence Number=SeqID_111902
atggctgtcctgttgttcattttccagtcgctgtcaggaacggcgcgggccgaccagggctggccgcgcagcgtacagggcgcgaccggaacggtaacgcttcaccaggcaccacagcgcattgtctccaccagcgttacgctgaccggctcgctgctggcgattggcgcgccggtcatcgcctcaggcgcgaccgcaccgaaaagccgcctggccgacgatcagggcttcttccgtcagtggggcgaggtggcaaagcagcgccacgttaagcggctgtacattggtgagccgagcgccgaggcgattgcggcgcaagccccggatctgatcatcgtcagcgccaccggtaatgactccgccctgaagctggtcagtcagctgtccgccattgcccccacgctggtggtcaactacgacgataagagctggcaggatgtggttacgctgctggggcaggccaccggccatgaagcacaggcagcgcagcgcgtaaaagagttcgacgatcgcgaagcggcgctgaagcaggccattacgctgccgccgcagccggtctccgcgatggtatggaacggtgatggccgggcggtgaatctgtggaccgccgcatcggcgcagggcaaactgctgcagcagctcg

SEQ ID NO: 20218 - DNA, 904 bp, Glycine max
  Peptide Sequence Number=SeqID_111903
atgcgccagatccgtgcattagcaggctcagggattctgcttttgctcctcatggcgctcagtctgatgctgggtgccaaatcaataccgctttccgatgtgtatcacgctctcaccgcttcctgctccagcgcggagtgcatcatcgtgcgcgatgcgcgcctgccgcgcacgctggccggtttgctggctggcgtggcgctggggctggctggcgcgctgatgcagagcctgacgcgtaacccgctggccgagccgggcattctgggcgtgaacgctggtgccgtggctgacgctggccttcagcggcgcgctgctggcggcgctgctgatgacggtgattggcgcgatgggcggcgggcgcgtcaatccggtgcgtctgacgctggcgggcgtggcgctggcggcggtgctggagggcttaacctccggcctgtcgctgctcaatccggacatttacgatcacctgcgcttctggcaaagcggctcgctggatatccgcgatttcagcgtgttgcgcaccctgagcccggcggtgctggccggtgcggcgctggcgctggggctggcgcaatcgctgaacagcctgagcatgggcggcgatatggcggcggcgctgggcacgcgcgtggtgcgcactcaactgctgggcctgctggcgattgccttactgagcggcgcggcgaccgccgccgtcggaccgatcgcttttatcggcctgatgacgccgcattttgcccgctggctggtgggcaacgatcaccgctggctgctgccggcgacggcgctgatcaccccggcgctgctgctggcggcggatattctggggcggatgatggtggcaggcgaactgcgtgtctcaatagtgaccgccattctcggcgcgccgatgctgattttgctg

SEQ ID NO: 20219 - DNA, 1533 bp, Glycine max
  Peptide Sequence Number=SeqID_111904
atgagcacgcacgttccgtctggcacccggtgtgaacggctgcgcgataaagacagggatcttctcaccggctcgccagtcactccgctgtggcgcagaactggccttccaggaatgaaaaaaatgaatcattactcgcggttaaccttcgctattttgatcgaactggggctcagcgcctcactgctttccggcagcgcctgggcagcagagacttccagcaagacgacttccagcaacgcctcttcttccgacgccagcgcaatggacggtggcaccttaatggtgacggcccagcagcagacgctgcaggcaccgggggtttccaccatcaccgccgatgagatcaaaaagcatccgccggcgcgcgatgtctcagaaattatccgtaccatgccgggggttaacctgaccggtaactcgaccagcggccagcgcggcaacaaccgtcagatcgatattcgcggtatgggaccggaaaataccctgatcatggtggacggcatgccgatcaccagccgtaactcggtgcgtcttggctggcgcggtgagcgtgatacacgcggcgataccaactgggtgccgccggagatgattgatcacatcgacgtgattcgcgggccggccgcggtgcgctacggtaacggcgcggcgggcggtgtggtgaacatcatcaccaaaaagtacagcgatcagcagtggcacggttcgtggaatacctacttcaacgcgccggaacacaaatcggaaggggcgaccaaacgcaccaacttcagccttgaagggccgctcggtgacgacttcaacttccggctgtatggcggtttagccaaaacccaggccgacgcgtacgacatcaatgaaggacatgcggcagcgcgcaccggcagctatgccggcagctacccggcaggccgcgaaggttcggttaacaaagatatcaatgcgttgctgagctgggcgtttgcccctatgcagacgctggagctgcaggccggttacagtcgtcagggcaacctgtacgcgggcgatacgcagaacaccaacactaacgcgctggtgaaaagcctgtacggcgatgaaaccaaccgtctgtatcgccagaatatttcactgaaatggaccggcgcgtgggacaacggcatcagcaccagcagctgggcgcgctacgaaaaaacccgcaacacgcgcatcaatgaaggtctggcgggcggcacggaagggattttctccaacaacgggttcaataccattcagctggacgatgtgctgctgcacagtgaaatcagcctgccgtttgagctgggcgtcaatcagaccgcaacgctgggcaccgagtggaaccagcagcgcatgaaagatccttcgtcgaccacccaggccgccagcaacggtgccgtgccaggcatcgccagcaccggccgcagtccttatgcccaggcggagattttctccctgtttgccgaagacaacatggagctgaccgacagcaccatgctgacgccggcgctgcgcttcgatcatcactccatc

SEQ ID NO: 20220 - DNA, 48 bp, Glycine max
  Peptide Sequence Number=SeqID_111905
gagattaagaattacgagaaatatggaagtcctcctcgacgtcacaaa

SEQ ID NO: 20221 - DNA, 909 bp, Glycine max
  Peptide Sequence Number=SeqID_111906
atggcgagcccgatgacatgcaggggggcaagtgagcccgatgacacgcagagactaacgtcgtcttctgcacctttgtcatccagagacggcgagtccgatgacatgcggggagacggcgagtccaatgacatgcgagggtaccttatggttattcgcaccttttgtcatccagagacggcgagtccgatgacatgcgggggggcaagcgagccctttgacacgctgacactaacatcgtcttctgcacctttgtcattcagagacggcgagtctgatgacatacgggggacatgtatccctctgaaggctcgggcgtgtggccctctcatggcgagcacgtgtagtcctctgaaaatgaggatgtgtagtcctctgaaggtgaagacgtgtaatcctctgaaggtgaaggcatgtagtcctctgaaggcgacgacgtgtacacctctgaaggcaagagtgtgtagccttctgaaggcgaggacgtgtagtcctctgaaggggagcgcgtgtagccccacgaaagcgagggcgcgtagtcctctgaaggcgaggacatgtagtcctctgaaagtgagggcatctagccctgtaaaggcgagggtgtgtagccttctaaaggtgagcacatacagtcatctgaaggtgaggacgtgtagccctctgaaggcggggacgtgtagtcctctgaaggtgagggcgtgtagtcctctgaaggggagggcgtgtagccccaagaaagcgagggcgtggagtcctcggaaggcgaggatgtgtagtactccgaaggtgagggcatctagccctgtgaaggcgaggtcgtgtcgccttctaaaggtgaggacgtgtagtcctctgaaggagaggacgtgtagccctctgaaggcggggacgtgtagtcctctaaag

SEQ ID NO: 20222 - DNA, 342 bp, Glycine max
  Peptide Sequence Number=SeqID_111907
atgagcgtctgtgtggctcagttgattgctgacgccctctatttatttgcaggtatgccacccaccaggcaccctctaaacctggataagtctaacagggccctgggtcagtcggggttccaagcacagggtgatgcaccgcaggccgcacatgcaccgccaccacctcatcaggctgatcctgctgggtcattaggcatggagtggtatctacagcacttggttcgccagcaggcggccaaccaccgagggcaggtgcagatacacgagtgtctctaccagctcagcctcagtcagcagggccagggttttgttccttttgtgtgccctactccagattag

SEQ ID NO: 20223 - DNA, 342 bp, Glycine max
  Peptide Sequence Number=SeqID_111908
gtggcctggcccggagctcaaccctcttttgttagagataatgtaagctctacagcccagaaacctcagcagcaaaagccagagctagaaactgaccaatcctctgaagccactgttcctggagcttttgaggttttagaaggtagattagagatgagatccgatgaggctgcttatcctgagccagtaccagtaccagctgatccatcatctctagtggtggatccatcttttcccacgccagaagcagctctcccatctacacctattattatatctgatgaccctacagtgcaagcacctggattggctcctactcctccagccacacctgagctttag

SEQ ID NO: 20224 - DNA, 105 bp, Glycine max
  Peptide Sequence Number=SeqID_111909
atgaacctcggtcacattgcatgttgcgtttggactgatgaacgtgaacgagagaggtctctaaacaacacgaagaggaattggcggagagctcacgataggtga

SEQ ID NO: 20225 - DNA, 240 bp, Glycine max
  Peptide Sequence Number=SeqID_111910
atgacaaaaagctcaaagatccatccaaagaacaactcaagtaaatccaagaacaatccaagagttcaagttgagaatcaagaagaattcaagactcaagaaaaaagtttagagtcaagagtcaagattcaaggttcaagatctcaagaatcaagatcaagattcaatactcaagattcaagaatcaagagaaggcttaatcaagataagtatgaaaagtttttctcaaaaactgagtag

SEQ ID NO: 20226 - DNA, 399 bp, Glycine max
  Peptide Sequence Number=SeqID_111911
atgaaggaaggcataggtcacatcttagacctcactcccataggagagaaaatgaaagaaagccttaacattaacctctcatacttccatgggaaggacaatgtagaggcttacttagattgggaaataagggtagagcaaaaacttaaaagaaagtctactttaaaatcttatggctctcattcttatccaaataatgaccaaggacacattacttctcaatgccccacgaagaaaaccatgattatgaggagccaagacatttatagtagccaagatgaggctactacttcaccttcctctagtgaaaatgaagaagcaaaaggggaagaatctagtgaagaaatctacccccaagaagaaggacaacctttaatggttcaggaggagtataaggac

SEQ ID NO: 20227 - DNA, 236 bp, Glycine max
  Peptide Sequence Number=SeqID_111912
tccaagtgggtctaatgatcctaaaaagcaacaagcaacaagccatgtgtgcgaagatcgtcattggttcaaggaatttagaccaatcgatgatgactctattgtgaagatgggcaatgttgcaactgaaccaatcctaggattagattgtgtgaatttagtttttacttccggaaaaagtttgtatttggataatgtcttatttgtacctggtattcgtaagaacttattgtctg

SEQ ID NO: 20228 - DNA, 330 bp, Glycine max
  Peptide Sequence Number=SeqID_111913
atggctccgaaaaagctttccacgaatagatataggagggacgccgcgactgaagggactagtgccgctcccgagtttgatagccactatttcaagagcgctgagcaccagcagcgttttgaggccatcaaaggatggtcgttcgacagagagagacacgtccagctcagggacgatgagtacacagattttcaggaggagatagctcgccgacattggacgtcgctggtcactcccgtgactaagtttgacccagatatagtcctggagttttattctaatgcttggcccacagaagagggagtgcgggacatgcggtcatgggtgagg

SEQ ID NO: 20229 - DNA, 366 bp, Glycine max
  Peptide Sequence Number=SeqID_111914
atgcagggggcgaaaaggaagttactacagactgtgggggagagatggaggcagtttaaatcagacctcacgaggaaatttgcccttgcagccgatcaggacggtgtcgaggaagctgtctgtgacaaatacggcatcagcaaggaaaagtgggcccagttttgccagactcgcagagacccttcttgggaggatgtgcgtatcaaggcacaggccatccggaagcagaatactgccccccacgttttgtctcgtgggggttatgattatttggagcagaagctcctggctgagaagaccaagaagaagctgcaggaagctgtacagtcaggaagcgttgatgatgtcatcgaccctccattcccg

SEQ ID NO: 20230 - DNA, 424 bp, Glycine max
  Peptide Sequence Number=SeqID_111915
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccgtatgccttttatagagacttcagtgaaggatccgttatgggattag

SEQ ID NO: 20231 - DNA, 597 bp, Glycine max
  Peptide Sequence Number=SeqID_111916
atggtggcgaatttgcgcatttacctccttttggaagacgcacccgtcagcctcgcctcgcttgcccgcgaaagggcatgttgcgacagtagccttcggaggactacacgtcctcaccttcggatgaatacacgtcctcattttcagagggctacacgcccttgccttcagaggactacacgtcctcgccttcagagggctgcacgtgctcaccttcagaggactacacgtcctcggcttcagagagctgcacgccctcgccttcgatggactacacgtcctcaccttcagaggactacacgtgctaaccttcaaagggctacacgccctcgccttcagaggactatagagggctacacgcccttgccttcagaggactacacgtcctcgccttcagagggctgcacgtgctcaccttcagaggacatcacgttgtcaccttcagagggctacacgcccttgccttcagaggactacacgttgtcaccttcagagggctacacgccctcgcctttagagggctacacggcaaatgaatacacgtcctcgccttcagagggctgcacgacctcgccatcaacggactacacgtcctga

SEQ ID NO: 20232 - DNA, 369 bp, Glycine max
  Peptide Sequence Number=SeqID_111917
atgaggcttaagaatcaaggaagtcactcagtccattatggattccttacaatccacaccataagcccaaatgagaagttcgtcttcatagggaatagagtgaaagctccagtggaagtagtcgagacttatcgtttaaaacttgacactggacatcatttggatttactggaaactctttatgcacctagtatatctaggaatttagtttcattatctaaacttgatgttactagatactcttttaattttgataatagatgtttcagtttatttaagcataatcatctcattggtattggtgtgctttgtgatattttaaccctgcatcataatcctgacactaaatgcagtttaatgaatgaatga

SEQ ID NO: 20233 - DNA, 304 bp, Glycine max
  Peptide Sequence Number=SeqID_111918
gaagcggaagagcgcccaatacgcaaaccgcctctccccgcgcgttggccgattcattaatgcagctggcacgacagcggataacaatttcacacaggaaacagctatgaccatgattacgaattcgagctcggtacccgaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 20234 - DNA, 267 bp, Glycine max
  Peptide Sequence Number=SeqID_111919
atgttgaatccaactcaatttcaggccaaagaagagaaggttaaagctgctgatgactcgctcagcgaggtagatccactcagcgagatgcatccacttagcaaggcatccagcttgcttagcggatgggaaaccctagaagaggataagttagagatctgtatgcccagcacgcagccagcccgcccagcgaggtcgttatttcttctcgcgctcagcgtgcccactctcgctaagcaaaaattcactaactctcgcttagcatga

SEQ ID NO: 20235 - DNA, 2070 bp, Glycine max
  Peptide Sequence Number=SeqID_111920
atgcacgaacacatcggccagcggctcgcccgccagtggactgctgtcggccagcgcatacggaatgtgctcctcctcgccgccgcgaccgccgaacacggcttccaggtacggcacatagggatcgatgtccggcgccagcaccgcgatctcgcgcgcctgcagcggcgggtcgaagcgcggatcctgcagcaggctgcgcagctggtcgtgcagcacctgcagctcgcgcagccgggtatggcaggcgtgcacctgcaggctggggtcgtcactgcgcaggccttcgcgcagctcgcccgagggcagtgcgcggcggtggaacagatcgcgctgcaggcgatgcagcaggctgtcggacaggccgccttcgtccagggtcggccgggtgtcctcctccggatcggaataggcggcgatctcgccggccggatgcaccacctcgtaactgccgagcaccgccatgaagtcgcggccggccgcaccccaggcttccagcaggcggttctcgccggccgcttcaccgaagggatcgggcgcgccgctgcgcaggcgctcggccagcgtctgcaggtcgccccagtaagactgaaccggggtgggcatgtagaagtgcagctcgcccacccgggcctgggtggccatcacccgcagcacgtcgggcgagatgttgagcgtcgcaaacgcagacatgcgcggcggcaggccttgcggcagcggctggccggcgccttcgaagcggtccaggtactcctggatgcggcgggcgcgatagtcgtggccccgggtgatggtgcgccacaggattgcctgcggatcggccggatcggccccggccgcccagcgcaacagccagtcacgccgccaggcctggtacttctcgaacaccgaggccagctcgccggccagcgcccacggcttcagagcatcatcgccggcaagatacgactgcagcgcgcgcatcggtggctgcgccagcagcgacggatcgcgcagcgcctggtacagcttccagtgcaggccggcggcgtccagatcgtcctgctcaccgctgacgttggccttcagcgcgcgcgccacgaactcgcccggggtcaggaattcgaggttggcagcaacgccgaactcggccgccagtgtcgcctgcagccaacgccgcatcgccacctgcgggatcagcaccacttccggcgccagcagcggctggcccggtaccggcgcacgcacgttgcgcgccagcagcgcggccagcacgtccagggagttggaatggtagaggcggaaatcgctgcctgggtcactcatcatgcacagtgtgcaggacggcaggcagtattcaatggtcagcccatcgccggtacggattgttccgggctgccgggcgattgtcccggcctgcgcgaggccttgccgtgcaacaatactggaccgtccagtctgcttatgttcagccgacgggcccatgtagctgtggtgaaggagttttatgctaatttatacaccacagaggagcaagcacccaagcaagccagagagattgaagctaggctctgtattccccgcaaggggtttgttttgaatgctgagggtcagccatggaagcttcttagaaaagatctgaagacactggccaagacatggagtgtcttcccttactccaacctagctcccacatcccacacctcagatctagatatggatagaggtaggttggtctatggcttagtgactaacagggacatgaacattagagcccttatcttaggtcagatttattctattgctcagagtaactcctctaggctcagatttccagccttgatgactgccctatgcagagctagaggagttacctctcacagtctgacctatgagagcctgagcctggccattaacttggcctacattaagaaaaactgttggaatgtggatgatctaacagttaacttcagaggggtgaggaaggcaagggtgagaccaactcatgttccttcttctactctaccagctccttccacttctgctactcctacaccagctcctccaggctcatctactaaggactcttag

SEQ ID NO: 20236 - DNA, 498 bp, Glycine max
  Peptide Sequence Number=SeqID_111921
atgtcaagggagtcgcgccccctacgagtttggcgtattaggaaaatagaaagagtatggctatgtcgggagacatgcatgtcagtttacgcatgtcacactttggtgcacatggtgccggtagatagaccagatgccactcccatcaccattgatcaccatcgatttcagagctcatttagagcacaaaatttcatgctcttctctccctctcccttcattcatctccttcttcttccaagctcttatccatggcctcctatggtggaatccattgatgaagaagatcctaggcctacaagctcaaatggagcttacatcaatcggtactactacattccttggggatttatgtctcactggaaactagaatggtttgaagacattagtttttatctaggtatggaagtgccttatgatgctcaagaatgcaacgtgaccctaatgaggtttgatgcgaaagttaatgtcctaagttggagattcgagttagtgtaa

SEQ ID NO: 20237 - DNA, 411 bp, Glycine max
  Peptide Sequence Number=SeqID_111922
atggctcttttcactggcaaaactcatatctctcctcttaagaagtgtctagttccttcaacacaactgtgtccacctccatccctcatccatcttgagaagtttagaagagcggttcaacaaaaggaaccattgacagatgatcagaggtttcctctagcatttgttaacagtaatcgactgcctgaatcttgcttctttgagtctgtctctactaaacctatccaaagaaaaaccataattgttcaatccccagcatggatgagttcatctaccaccaccacaatggactcgtctaatgcagccacaagtcatcaagatgcaaccgcattggcttacacctggcagccaacaataatttcatccatcaatagaggtttcacgagcaacaacttagcaaaaccaccataa

SEQ ID NO: 20238 - DNA, 1000 bp, Glycine max
  Peptide Sequence Number=SeqID_111923
cgcacgttggcttcgtggattctgccgttgaccgtatcgttccgccgtcagaatctgcaactaacgacccgctggaagtgacggtagaaaccttcagcgagtggatcgtggacaaaacccagtttaaaggtgcgctgccgaccattccaggtatggaattaacggataacctgatggcatttgtggaacgtaaactcttcacgctgaacacgggtcatgctataaccgcgtacctcggaaaattggccggtcatcagactattcgtgatgcgatcctcgacgagaagatccgcgcggtggtaaaaggggcaatggaagagagcggcgcggtgctgatcaaacgctacggttttgatgctgataaacacgcagcatacatccagaaaatcctcggtcgttttgaaaacccgtatctgaaagatgacgttgagcgcgtgggccgccagccattgcgtaagctgagcgcgggcgatcgcctgattaagccgctgctgggtacgctggaatacggcctgccgcacgccaacctggtgaaagggattgccgccgcgatgcactaccgcagcgagcaggatccgcaggcgcaggagctggctcagctgattgatgaccagggcgcacaggctgcgctggcgcagatttccggtctggacgccaacagcgacgtggttgcggaggcggcaacaatggaacaaacccaggcctttgaaaaccgtgtgcttgagcgtctgaatgctggcaaaaccgtgcgaagctttctgatcaccgccgtcgagctcctgaccgaggcggtaaatcttctggtgcttcaggtattccgcaaagacgattacgcggtgaagtatgctgtagaaccgttactcgacggcgatggtccgctgggcgatctttctgtgcgtttaaaactcatttacgggttgggcgtcattaaccgccaggaatacgaagatgcggaactgctgatggcattgcgtgaagagctaaatcacgacggcaacga

SEQ ID NO: 20239 - DNA, 354 bp, Glycine max
  Peptide Sequence Number=SeqID_111924
atggagaaaggacaaggccggtcttgcttggcgcaaaggctgctgaacttcgattcgcccggccagcaggcgggcggcgtgcttatcttgtgtgacaacactacagagcgagtggctcttctaggcgggcagctgtgtgacaacactacagagaaagcggcgctttcgtttaacatgctatggtctcaacgcccttacgagatagtgatgagtttcacgcgctctaagcccggcccgcgcgcggttaggaagattggccgcaatctgagcggtaccacccaccctaccctaccacctataggcggccgtccgttctacagccgcccgaaaaggaactgcagtgatcttgaatag

SEQ ID NO: 20240 - DNA, 177 bp, Glycine max
  Peptide Sequence Number=SeqID_111925
atgaagatcctccagaagaagtcaaatcaaatgatgaacttccaaaagaatggaaagcttcaaaagatcatccccttgacaacattattggtgatatctcaaaaagggaaccctcaacaaaatggagttgttgaaaggaaaaataggtctagttggaagagtgctagaagccattga

SEQ ID NO: 20241 - DNA, 645 bp, Glycine max
  Peptide Sequence Number=SeqID_111926
atggaacggtgggaaggaagtacaaagtacaaaagtaacagagtaacctggaagatgagttttctcgcgggaaggttagctgggaaagaagctgcgtactttttccaggaatccaaacaagccgtgggaaaattagcccaaaaaaaccctcttcccaagaccaacaacaacaaccttaactttcacgaaggatatgatcatgcggatgtacttcccgaggttctaaggcactctcttccttccaaagtgtttagaaatgatgaagccacctccttttccttctctgcctccaaatgggtccttcattccgaccccaaaacccaatcttccgtatcccctgatgctctcaatcctctgcgtgcttacctttccctgccccaagtcacctttggccccaaaaggtggcaactgcctgaagcagcaaacacggtttcagcctcaacagctaatgaatcgcgtctagacagatatgccacccatgttaacccggagaagttgaaagctgcaggtgaagggcttgcacatgataatggtttatggaaaactgagggcgtagtcaaggcccaccataacttacggtcatcctgtgatccctctatagaatgtgatactctgttcaactttgataaaatatgtcaaagttga

SEQ ID NO: 20242 - DNA, 1238 bp, Glycine max
  Peptide Sequence Number=SeqID_111927
atggaacctctccaaatgcaagccttccgcaagacttacggaaagatcttagatttgaccatagcagaggtattcatagaggccattgcgtcactcacccaatactacgaccagcctttgagatccttcacgttcagagacttccaattggtaccaaccattgaagaatttgaggagattctaggatgtcctctcgggggaagaaaaccatatcttttctctgggtgtctcccctctttgagcagaattgcaactgtggtcaaggattcagcaagagatggtttggtggacctagcagcaatcggcgctttccttgcataccaccatagcaaggaaagtccggtggtagctgtcttggcagatttatttgacacatttgaccgaaggtgcgagaagagtagcgcacggatcatctgttgcttgcccgctctctgtgtttggttgggttcacacttgttccagcaaaacacgaggcatccatgtccgctccaaagccatcgctcgtgtgctgaaaagagaggaatagattgggaccaacttttggccgggataggaggtagaacaatcagttggttcccccgatggaaggaaggaaaggagggagtccttttctcatgtggagggtacccaaacattccgctgataggaacgaggggttgtatcaactacaatcccgcgctcgctataagacaactagggtaccccatgaggggagcaccgatgaaagaaagcatgtctcctttccttgtgagagatttcggcacgcaaaatttcaaggctatacaaagaatccataaggcatgggaaaccccgttaaggaaagatcaagaacttaggggcattcgtaacggcatcattggtggttatcatgaatggctgaaagttcatatacgaggtttagattggctcgccaagttaaaagtcgtcagcgaagacagttttgaagcaccggaagaagacgaagaagtccaagctctcataaatgagttaggaaaagcgaaacttgccaaagagaagttcaagttagccgctacacacatccggaaggagtgtgccgaattacaggaagagaatgcaactaccgcaagagcccttgaacaagagaccaagagggctcgcaaggaagagtatggccgtaacaaatttcgcggagctctgtggagtagcaacagtgaactcaagctgcgaagggaagagagggaccagtcgcgagcacatagcatggtcttgaaagagga

SEQ ID NO: 20243 - DNA, 291 bp, Glycine max
  Peptide Sequence Number=SeqID_111928
atggccaagttcgacccagacatagtcctcgaattttatgccaatgcttggcctatggaggagggcgtgcgcgatatgagatcctgggtgaggggtcagtggatcccgttcgatgcagatgctatcagccagttcctgggatatcctttagtgctggaagagggccaggagtgcgagtatggccagaggaggaaccgggaggcgagtgcgaatcatgcgcaccaacatgaccaccctgacccagatatggatgacgttgctcctcagcaacatcctgcccagcgatcataa

SEQ ID NO: 20244 - DNA, 357 bp, Glycine max
  Peptide Sequence Number=SeqID_111929
atgaagaacaaaaagaatagacctcaacatcggggaaaaccgtactcgaccctttctaaggaatatggtaatcgctctaacaatcagaggactgttgctatagggttggttggtggtagtggtagcaaacccactaatttctcaactcatgtcacttgttacaagtgtggtaagctaaggcacatctcctcaaattgtgccgagaaagacatgacttatttcaactacagacaaaaggagcatattaagagagattgcccatatcccaagaaagagcaaaatggtgggggtctgaatgactattggaggctcgcaacttacttccattgtcttgtggtttggtgctgtttagagtag

SEQ ID NO: 20245 - DNA, 832 bp, Glycine max
  Peptide Sequence Number=SeqID_111930
agattggctcgccaagttaaaagtcgtcagcgaacagaattttgaagcaccggaagaggacgaggaagtccaagctctcaaaagcgagttgggaaaggcaaaactcgccaaggagaagttcaagttggctgctacacacgttcggaaggagtgtgccgggttacgggaagagaatgcaattaccgcaagagcccttgaacgagagaccaagagggctcgcaaggaagagtatggccggaacaaatttcgcggagccctatggggtagcaataatgaactcaagttgcgaagggaggaaagggaccagtcgcgagcacatagcatggttttgaaagaggagttagttgcctgttcaaggtccaaaagaagcttgtctcagcgtttatgcgagacggagaccaacatgctagctatcatcgccaagtaccaagaagagttaggtctagccacagcccacgagcatagaatcgcggatgagtatgcccaagtatacgcggaaaaagaggctagaggaagggtgatcgactctttacaccaagaggcaaccatgtggatggatcggtttgcccttaccttgaacgggagtcaagaacttccccgattgttagccaaggccaaggcgatggcagacacctactccgcccccgaagagattcatgggcttctcggctattggaaacacaccataactaaacgcgccgcaagggatccctatcgcaccagatccaaatctagaacgatgggtgatcaagaggagacgcaggaacaggatgaaagccgacatgtcggctctgaaagaacaaatggcctccatgatggaggcggatgttag

SEQ ID NO: 20246 - DNA, 182 bp, Glycine max
  Peptide Sequence Number=SeqID_111931
gtgttgagggaaggagcccagagtatgaagaacctcaggatttgaggtcaaatcctttccaagctctagcttctcatctcaaggaggtgagcttagctattagagagcttctcaaggaagttttctcaaagaagcttctcaaggaagttttctcaagaaagcttctcaaggaagctacctag

SEQ ID NO: 20247 - DNA, 643 bp, Glycine max
  misc_feature (26)..(26): n is a, c, g, or t
  Peptide Sequence Number=SeqID_111932
cgccacgcttcccgaagggagaaagncggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccttctctattccactaccatgatcttcaagaagcaaaggattccatttgatgaagaagatccaaggcctacaagctccacatggagctacatcaatcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 20248 - DNA, 75 bp, Glycine max
  Peptide Sequence Number=SeqID_111933
atgacatggctggactttgtggagtgtccaaaggttcaagatgaacaaatggaaaaccttgagatggacttgatg

SEQ ID NO: 20249 - DNA, 390 bp, Glycine max
  Peptide Sequence Number=SeqID_111934
atggtgctcaaccaaatcatgatgaaggacaattaccagttgaaggggactcttctctccttcaatgtattttggacaggtatgatggactccaaacctatgttggtgagaggtttgatgctttggaacaacaggtggacatgcgattcaatgcaatggactcaaggatcacaaaagttgaagaagatgattgtcatcatcaaaaagggggagattgtggaagcaatgtcttccaaggttattttgatgatgccaaagaatcaagagttaaacaaagttttcaagcaaagattcaagaaccaagtttcaagattcaagactcaagaatcaagattcaagaataatcaagactcaagattgaagaatcaagagaagactcaatcaagataa

SEQ ID NO: 20250 - DNA, 757 bp, Glycine max
  Peptide Sequence Number=SeqID_111935
atgaattcttcctccatttatattcttgtctttgtccagctttggttgttgagcttaccatgcagagagagtgtgtgcatcccaagtgagcgtgagacacttttgaagtttaagaataatctcatagatccttccaataggctttggtcttggaatcataataataccaactgttgccactggtatggagtcctctgccacaacgtcacttcccatgttcttcagcttcacctcaacacttcagattctgttttcgagtatgactatgatggccactatctcttcgataacaaagcatttaaagcattcgatgaggaagcttataggagatggagctttggtggagagataagtccttgtttggctgatttaaagcatttgaattacttggacttgagcgccaattatttccttggagaaggtatgtcaattccttctttccttgggacaatgacttccttgactcacctcaacctctctcatactggattcaatgggaagattcctcctcagattgggaatctctctaagcttcgatatcttgacttgagcggcaattatttacttggaggaggtatgtcaattccttctttcctcgggacaatgacttccttgactcacctcgacctctctggtactggattcatggggaagattccatctcagatttggaatctctccaatttggtgtatcttggccttggaggtgattctgatgtcgaacctctgtttgctgaaaatgtagaatggctatcaa

SEQ ID NO: 20251 - DNA, 333 bp, Glycine max
  Peptide Sequence Number=SeqID_111936
atgtgtagtcctctgaaggcgaggacgtgtagtcctctgaaggcgagggcgtgtagtcctctaaaggtgagggcatgcagccctctgaaggcgaggacgtgtagtcctctgaaggtaagggcgtgtagccctctgaaggcgaggacgtgtagccctctgaaggcgaggacgtgtagccctctgaaggtgaggatgatgacaaaaagcccaaagaatgatttcaagattgagtcaacaagttcaagatcaagtttaatttcaagtttcatgagaagaaatcaagaagattcaagaatcaagaaaagtttgatttcaagattcaagagaagatga

SEQ ID NO: 20252 - DNA, 303 bp, Glycine max
  Peptide Sequence Number=SeqID_111937
atgcccaaccacaatctagccgacttcgagccttgcctcggatatgccactgaagggcaagcagttggtggtatacccctgcaaaacactttggagagccctcagtatcacccacaaccacacccatcacattccacagcgattaaaaaccctcatgctatggcggaagtgggaaagttggatcatctagaggaaaggctcagggccattgaaggaggtaaagattatgcctttgctaacctagaagagttgttcctagtactcgaacatggtcattcccaagttcaaggtgccagactttga

SEQ ID NO: 20253 - DNA, 466 bp, Glycine max
  Peptide Sequence Number=SeqID_111938
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtcgttcgctccaagctgggctgtgtgcacgaaccccccgttcagcccgaacgctgcgccttatccggtaactatcgtcttgagtccaacccg

SEQ ID NO: 20254 - DNA, 327 bp, Glycine max
  Peptide Sequence Number=SeqID_111939
atgcaccgcaggccacagacgcaccgccaccacctcatcaggctggtccagctgggtcatttggcatggagcggtatttacagcacttggttcgccagcaggcggccaaccacagggggcagcctcagtcagcagagccagggtttcgctccttttgcgtgccctaatctagatcacttcagggctgaggttgcatggcccagagattggcctgaggcccaggtaggggaggcgcccgtagaggctcccggcgacgcggaggaggcccgcacggatgaggagatgatagatttactcggtttcttgggagggagtggagccatgtga

SEQ ID NO: 20255 - DNA, 438 bp, Glycine max
  Peptide Sequence Number=SeqID_111940
atgagtgaaatagaggaggtgcaagagcagatgaaggctgacatggtggccatgaaagagcaaatgaccacaatgatcgaagccataatgagtatgagaaaaatgatggaggtcaacatggatatagttgttgccacaagtaccaccactgaggtggacccgactcacccatctggcctcaatcaagtaaatcctccagtctcggatatggtagggctgggaggcaaagcgttaggaagtacaggcggcccccattttgtgcaagttcaaaacaggcattccttcccaccatatggcttgcctcccaactatacagcacccaatgttgcacacgctcctgatgagaatgtcaataactccactcccatactaattgagagccaacaacctcaatctggtcaggcacaggtccctcaacccatggggggagacacatga

SEQ ID NO: 20256 - DNA, 443 bp, Glycine max
  Peptide Sequence Number=SeqID_111941
tcacggaagcgcagcccagtttgcgacaaacaataactcaggcagaaggagaaacaacaagaacgccatgggagtacccttttcgagactctttcctttcctacttttcttcgacctgcgaaagtgagcaaatgttaaaacgacgaatgcctaatgttaaaatgaaaggatgtacctcaatcgataagtggcaaagacgatctccacaaacacaatctccacaatgtggttgcagtcacggaagcacaggccagtttgacacaaagacgatctcaggcagaaggagaaagaagaagaacgatagggttcaagtgcgctggttgtgcaatttcataagtttaatatataatgataacaacatcggttttttaaaaataaccgatgttaacatcaactacgtaacatcggttttcttaaaaccgatgttaacatcaactcgataa

SEQ ID NO: 20257 - DNA, 333 bp, Glycine max
  Peptide Sequence Number=SeqID_111942
atgcaaaatagtggggtcaccctaagggctgaatctcaacacttcaccagtgtacatgatgacaatccctgtgtagctttcatcctttactttgggttcattgaagaaatttgggagcttaactatgtcaaatttattgtttgtgttttcaaattggttctacacggaaaaacaattggtgttaatgttgaagatgatgattcatacattgatacttatgttagtcctttgtacatacaaatgtcgcctaacgtcgtcagagaagaagaagctgaagacattcatgctaatcataataatcatgatgaaggagaattaattaacatcgtataa

SEQ ID NO: 20258 - DNA, 230 bp, Glycine max
  Peptide Sequence Number=SeqID_111943
gacaccctgtggacccaaagaagtccaacagggtcttggggcttccagctctgattacgagcctctgtcagttttacggagtgtctgtcaaccccaacaagctcattaggccccgcattaaccgggctttcatcaagaagtactgccccccaagcaggcgcaaggcgagacaccacaacaacctggggatggccggcagcgggcaacagacgcaccgccaccaccactag

SEQ ID NO: 20259 - DNA, 348 bp, Glycine max
  Peptide Sequence Number=SeqID_111944
atggattgccccctatatataagagctggaagtggtatctgtgtagatgtaggaggaataactgtagttgaggaaggtactggagctgtggaagaagaaggagctggtgtctcaggtggtgctgaagtagtggggacctctgatctcttacccctggccttccttggccctctaaatgtcactgttggatcatcaagattccaacagttcttcttaatatatgtcaagttaatggtagggctcaagttctccagggatctagaatctgactggactcctctggccttgcatagagctgtgatccaggcagggaatccaagtctggatgtatcatgctgtgcaatctaa

SEQ ID NO: 20260 - DNA, 407 bp, Glycine max
  Peptide Sequence Number=SeqID_111945
cgtctcgatatattacgggactcaaccggacatccgtgtataaagttattgtcatttcaatttgctcagagcttgctattctcaatttcgagcgtctcgatatattacccgattcaatcggacatccgagtaaaaagttattgtcgtttgaatttcctacgagcttccgttttcaatttggagcgtctcgatatattacaggactcaaccggacaccgtgtataaagttattgtcaattcaatttgctagagctccggatcaaaattttgagcgtctcgatatattacgggactctatcacggacatccgagtaaaaagttattgtcgtttgaatttgataccagcttccgttttcaatttggagcatctcgatatattacatgaccttcatcgaacatccgagtaa

SEQ ID NO: 20261 - DNA, 372 bp, Glycine max
  Peptide Sequence Number=SeqID_111946
atggctaacataatgatgaagattaacaaaaaacagaggaaatgttcaacactgttcatgttattgaccaggtcattcgttgtaagatggaaggatgaactagagcctacttggcatttgctacactctagtggcaacatgcactttgtcacatatagccaagatctggtgagctcaactctacttgttggatggacagaactcagagagttctatgggctcactggaaatcatcagttcctaactcagccacttaaagtcctactgactgagtacaaagtgacttgcaacagatgtgctgagtaccatgtactcattgatgaaagctacaagattcacccatctgaagttggaagggactacagagtgtag

SEQ ID NO: 20262 - DNA, 540 bp, Glycine max
  Peptide Sequence Number=SeqID_111947
atggagagaagtatgatagatgctgccagtggtggagcccttggagacatgactcctgctgaagccagaaatttaattgtgaagatggcttccaactcccagcagtttagcgccataaatgatgctatagtcattagaggagtgcatgaggtagctacaaactcaactgcatcatctgaaactaagaagcttgaaggcaaactggatgcattggttaacttggtaacccagctggccttgaaccaaaaatctgtacctgttgcaagggtctgtggtttgtgctcctctactgaccaccatacagacctttgcccttccatgcagcaacctggagcaattgagcagctcaaagcttatgctgctaatatttacaatagacctcctcaacctcagcagcaaaatcaaccacagcagaacaattatgacctctccagcaacagatacaaccctggatggaggatcaccctaatcttagatggtctagcccttagcaacaacaacagcagcctgctccttccttccaaaatgctgctggcctaa

SEQ ID NO: 20263 - DNA, 369 bp, Glycine max
  Peptide Sequence Number=SeqID_111948
atgttagacatcatcagcaagtatcaagaagaactaagcctagccacagcccacaagcatagggtggcagatgagtatgcccaagtgtacgcagaaaaggaggctagaggaagggtgatcgactcgttacaccatgaggcaaccatgtggatggaccgatttgcttttaccttgaacggaaatcaagaacttcccggattgctagccaaggccaaagcaatggcggacacctactccactcccgaggagatccacagacttctcagctattgtcagcataggatagacttaatggcccatatgattagaaaccgccaggaagtttgtattgtcgctcaaatcttgactagttataaactttctgaataa

SEQ ID NO: 20264 - DNA, 360 bp, Glycine max
  Peptide Sequence Number=SeqID_111949
atgacgttgctacttagcaacattccacccgacgaccacaatgccgatctccctcctgtggaagtatcagttggtctgtgccatcgtgacatagggattgcacccacaaggcacccagtggacctggagaagtccaacaggaccctggggtttccagctttggtttcgggcctctttcattcctacagggtgcccgtccccctaacaaggtcatgccatcgtgacatagggatcgtgcccacaagacacccaacggacccggaggagcccaacagggcccaggggtttccagctctggttacaagcctctgtcagtcctacagggtgcccgttccccccaacaaggtcacgccatcatga

SEQ ID NO: 20265 - DNA, 393 bp, Glycine max
  Peptide Sequence Number=SeqID_111950
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtgtaaaacgacggccagtgccaagcttgcatgcctgcaggtcgactctagaggatccccaatggctcgcaatcatgggcgccaatccgagcgcctatcaggggtaccgagctcgaattcgtaa

SEQ ID NO: 20266 - DNA, 165 bp, Glycine max
  Peptide Sequence Number=SeqID_111951
atggcttatggacatgtacctgatagatgggtatggaaacatgagcctaatggactttattcgactaggactgtatataaattgctgcaggggaagccaggatcgcagaggtacatgggaagccaggatcgcagaggtataactgatggaagacttggtggatag

SEQ ID NO: 20267 - DNA, 272 bp, Glycine max
  Peptide Sequence Number=SeqID_111952
aagaggcagaggagacacaagtgagacaggtagctgctgccacacctgagcgatcccttgaggctactttagagccttctgcacaaggggaggacacaccctcacctcagcctgtagcaaaccccttcattcctcttctagagatgccagaggactcgactacatccgtcctggctatggacacttctccaccagctactctagtattgcatctgacaaatgaggaggatgttcagacacaggacacccaggaccagtcacaggaattttga

SEQ ID NO: 20268 - DNA, 123 bp, Glycine max
  Peptide Sequence Number=SeqID_111953
atggctttgtggagaggttcaacaaaatcatacttaaaagagttaggtgataagttggaaccaagggccttgaagtgtatcctcataggctatccacaaggagtaaagggatacaagctatga

SEQ ID NO: 20269 - DNA, 378 bp, Glycine max
  Peptide Sequence Number=SeqID_111954
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtcgactctagaggatccccgaatgttcgaggtaagggtgacaaagatgatgaggtacaagttggggtcaaggtgccattagagggtatgggcaacgtgcaagatgggggtatcgaccgagtacatattgaggtgctgatgtactatgtggaggggcccgtaaaaaattttgaaaatctcattgccatttccttgctcccaaaccacgaaagggtatcaggaatctaa

SEQ ID NO: 20270 - DNA, 591 bp, Glycine max
  Peptide Sequence Number=SeqID_111955
atggggacaaatcaaactggcaaaaggttttatcaagtcaaggttaaaggcctagatgttaccagcattaaggaattggggcggttgatgagacctctccaaatgcaagccttccgcaagacttacggaaaaatcttagatttgaccatagcagaggtatccatagaagccattgcatcactcacccaatactacgaccagcctttgagatgcttcacgttcggagacttccaattggtatcgaccattgaagaatttgaggagattctgggatgtcctctcgggtggagaaaaccatatcttttttccgggtttctcccctccttgagcagaattgcaactgtggtcaaggattcagcaagaggtttggaccgcgtaaaacaaactcgaaacggcatagcgggcctaccacggaagtacctagaagacaaggcgagggatatggcaaatcaagaagagtgggttccgtttatggatgtgttagaattgctaatctttggggtcgtactctttcctaacgtggatggtttggtggacctagccgcaatcgacgctttccttgcataccaccatagcaaggagagcccggtg

SEQ ID NO: 20271 - DNA, 591 bp, Glycine max
  Peptide Sequence Number=SeqID_111956
atgctaacatctctagaaaggttgcagatgaccacattggtctctgcttgtcaatcggacttggggtctctgaataacgaggtgcggataaccgtaaggtgtctccgcatgctaccggactcacagagaaaaaggtgtgcgcggataaccatcgggtgtctccgcatgccaccggactcacgagtcagaacaacaaaacgtggggtggtcaacaaaagtgaggcttttgctcctacatatcctttatctgtgatgaggaactcagacctacgtagttcttgcaaaagcggtgcggataaccgtaaggtgtctccgcatgattctggactctcgggtcatgatagcaaaagttgtgcatggataaccattggttgtctccgcatgccaccggactcacagtgtgttagcagctcaacagtgagtgactcttctttcttgggagatcctactgttccttctttcgagggcaaggatggaaattctcatcctgggtcaaggtttatggtgagttgggattttggctcaaggcttgtagaatggctggacatgatgtatgtcagggtgtcagtttggccagcggttcagggataa

SEQ ID NO: 20272 - DNA, 129 bp, Glycine max
  Peptide Sequence Number=SeqID_111957
atgaatttattgcctagcgctgttcatgcatcctccaccaacgagtctggagccccgcgaatttattgcctagcgctgttcatgtgtcctccgttatcaagcgcggagcctccgaaaaagaaggagtag

SEQ ID NO: 20273 - DNA, 216 bp, Glycine max
  Peptide Sequence Number=SeqID_111958
atggcttcctatggtggtgagcttcttcttgactcacttctccttgaagtggcatctccaatcatctttcttccttctcgattccgctgccataatcttcaagaagcaaacgactccattgatgaagaagatccaaggcctacaagctccaaatggagatacatcatgtggtatcaagagcatcttcctctaggttctatcatttttcagtcataa

SEQ ID NO: 20274 - DNA, 894 bp, Glycine max
  Peptide Sequence Number=SeqID_111959
atgctggaagtgaagcaggaggttgcgccgtgggtgacgctgcaaatcgtcgcgttcccgcaggaaggtatcctctcttacccgaacggcgcggcgctgctggaagaggcattacagctgggtgcggatgtggtgggggcgatcccccactttgagttcacccgcgagtacggcgtgcagtcgctgcatatcgcctttgagctggcgaagaaatatgaccgtccgctggatattcattgcgatgaaattgatgacgagcagtctcgctttgtcgagacggtggccacgctggcgtatgaggccggtattggcgcacgggtaacggccagccacaccaccgccatgcactcctacaacggcgcctatacctcgcggctgttccgactgctgaagatgtcggggattaacttcgtcgcgaacccgctggtcaatatccacctgcaggggcgctttgatgattatccgaagcgtcgcggcatcacccgggtgaaagaactacaggcagcgggtattaacgtctgctttgggcatgacgatgtctttgacccgtggtacccgcttggtaccggcaatatgctgcaggtgctgcatatggggctgcacgtctgtcagatgatgggctatccgcaaatcgacagcggcctgaacctgatcacccataacagtgcccgaacctttggcctgagcgattacgggattgagacgggcaacccggcgaacctgattattctgcctgcggagagcgggtttgaagcggtacgctgtcaggtgccggtgcgctggtccattcgtcagggacgaattattgccaccacacagctggcgcagacctggatccagatggataacgggggagaagaggtgagctttgccagaaacaccccctctgcgtag

SEQ ID NO: 20275 - DNA, 669 bp, Glycine max
  misc_feature (217)..(217): n is a, c, g, or t
  Peptide Sequence Number=SeqID_111960
atgacgcccgtcgcacttccccctgtcgcatttgtcccacgccgcctccccgccttccgcctgaccctcgccgccgccctgctggcccaggccggcctgcccgtcctggcccgcgccgccgacgaggtgccgcaactgagtcccgtgcgagtcaccggtgccgccgaaaagctgtcggaccccggccagaccgagggttcgcagtcctacaccgccnataccgtcaccatcggcaagaccggcgccaacgtgcgcgacatccccaactcggtgtcggtggtgacgcgccagcgcatggacgaccagaacatggtcacagtggaggacgcgctgcgccagaccaccggcgtcagcgccatgacctacggcgacggcaccgcctacttcaccgcgcgcggctacgagaccgacgtgcagttcgacggcgtgccggccaacggcgcgctgcagtacctgccccagttcgacctggcgctgtacgaccgcgtcgaggtgctgcgcggcccggccggcctgctgcagggcttcggcagccccgccggcaccgtcatcctggtgcgcaagcggccgcaagacgccttcagcctgaccggcgcggtgatggccggctcgtggaacaactaccgcaccgaactggacgcgaccggcccgatcacggccgacggccgg

SEQ ID NO: 20276 - DNA, 811 bp, Glycine max
  Peptide Sequence Number=SeqID_111961
atgaccggtttccttcggtttttcagacgttttccacaaataaacgttggtggcgactccgcgcattttcctcctttggaaaacgcacccgtgagcctcgcctcgctcgcccgcaaaagggcatgttgcgacaccatgaatcagaaatttgcacttgttgcaagacaatctggagtcaatgagcaacctgaagcttatgctgccaacacttataatagaccccctcagcagcaaaaccaacaacaacagaataattatgatctttcaagcaacagatacaatccaggttggagaaatcatctaaatctgagatgggcaagtcctccacaacaacaacaacctgtccctcttttccagaatgttgctggtccaagcaagccatatgttcctcctccaatacagcaacaacaacaacaacagtcacaacaaagacaacaagcaactgaggctcctcctcaaccttccttagaagaattagtgaggcaaatgaccatccagaatatgaaatttcagcaagagacaagagcctccattcagagtctgacaaatcagatggggcagatggctactcagttgaaccaagctcagtcccaaaattctaacaaattgccttcacaaactgtgcaaaattcgaaaaacgggagtgccatcaccttgtggtcaggcaaccaaattcaagtgcctccaccagtagcagcacctgcacctgaacctgtcaagcttcattctacacctgaaaaagaggatgagatagtttcacaaaagagaaagcttcctaacaaaaattttcgtgcaggtggaccttcttcta

SEQ ID NO: 20277 - DNA, 244 bp, Glycine max
  Peptide Sequence Number=SeqID_111962
ggcgcacgtgcagacccatgactgtctctaccagctcagcctcagcctgcagagccagggtttcgcttcttttccatgccctactccggatcaattcagggcagaggtcgcatggcccggagattggcctgaggccctggcaggggaggcgcccgcagaggctctcgacgatgcagatgaggctcgcatggacgaggagatgacagatttactcgatttcttgagagggagcggagccacatga

SEQ ID NO: 20278 - DNA, 213 bp, Glycine max
  Peptide Sequence Number=SeqID_111963
atgcagatgccttatactaggtatcctatttgtccacagttcaaaaggtgtctttggaactgccttactaggaaccctgttcaacaaatacatggtagttttcaaggcatacatccacaaagatacagtaaatttctaaggcatccattgcctaagaaatctcgggtggtaagtagacataaccataacgtgaataatcatcaacaatggtga

SEQ ID NO: 20279 - DNA, 255 bp, Glycine max
  Peptide Sequence Number=SeqID_111964
atggatattttcaacagggtccatgacatctttgtcaaggtgaaactggaagtaataaggacatcaacagtcctaaatgtgtttgacagtagacgaagcagcgttgtaactcgatccgtcttttgccctaattttttgcaggatggttacttccatacttcaacttttcttgaggaacctttttgtaaaagcatgagcttggttcaaccccataacccaaggaatgaggaaaacgcaaggatcatgcatgagtaa

SEQ ID NO: 20280 - DNA, 267 bp, Glycine max
  Peptide Sequence Number=SeqID_111965
atgatgaaagactatgaaaacggagaagagcaaagtcggtacattgatagcaatttctccaaacacatggcatgcatcaaagtggttgtcatcatcaaaaagggggagaatgtaaatcatgaagattttgatgatgtcaaaaatatcaagccttggataatggttgtcatcatcaaaaagggggagaatgtaaatcatgcaagttttgatgatgtcaaaaagaatttgcttgacataggggagaatgtggatcatgcattgccttga

SEQ ID NO: 20281 - DNA, 347 bp, Glycine max
  Peptide Sequence Number=SeqID_111966
ggataaaccagccttcgcttcgttttacatccggaattgccggtgcgctactggagttgaccgaacttttcccggattactcggtgatcgcgcagaaagcgcacgacgatccgtcatttcaaaaactatcggatgtggtggagaaggatttcaatcaaaattctccttatagctatcttcccctcgaccgccttatcgacaggatgcatgccctggagcataatctcgaagagacacgatcagcattgtctgcaatgcaggatgagctcgtgacgattcgaagaaacctaccaaaagagattctcaaacgacgggtgaggaaaatcaggaccttccttcgattttag

SEQ ID NO: 20282 - DNA, 373 bp, Glycine max
  Peptide Sequence Number=SeqID_111967
acaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctcatttccaaaagcacggagcgtattaa

SEQ ID NO: 20283 - DNA, 884 bp, Glycine max
  Peptide Sequence Number=SeqID_111968
atggggacaaatcaaaacggaaaaagattctatcaagtcaagattaagggcctagatgtcaccagccttaaggagttgggacggttgatgggacccctccaaaggcaagccttccgcaaagtgtacggaaatattttagatttgaccacaacagaggtatttacggaagccattgtatccctcgcccaatactatgaccagccattgagatgcttcacgtttgaggacttccaaatagtattgactgttgaagaatttggggagattttaggatgccctcttggggaaagaaaaccgtatcttttctccgggtttcttccctccttgagcaagattgcagctgtggtcggagattcggcgaaagagttggatcatatgaagcaaactcgaaatggcgtagtgggcctatcgcggaaatacttggaaggcaaggcaagggatatggcgaatcaagaggaatgggtcccgtttgcggatatactagctttgctaatctttgcggaaggaaaggagggagttctcttctcatgtggggactacccaaatgttccgttgatagggacgaggggttgtattaactataatcccgcacttgctataagacagttagggtaccccatgaggggagcaccgatggaagagagcctctcgcctttccttgcgtgggaaagcccgttgaggaaagataaagaacttaggggcatccgtaatggcatcatcggtggttatcatgaatggataagagttcatacacgagggttagattggctctccaagttgaaaattaccaacgaggagaacttcgaagctccggaagaggatgaagaagtccaagctctaaaatcggagctaggaaaggcaagactcgccaaagaaaaattcaa

SEQ ID NO: 20284 - DNA, 165 bp, Glycine max
  Peptide Sequence Number=SeqID_111969
atgttgatgaaaaacctcatcgggcacctaggagtacatgacaagacaaaccacacactagtaagtcaggtcactctcactagaatgctccaaccatgtgggatcggcacaggcttaaaggagcactcaaaccaggtgtatttacccccaaggcctagactctga

SEQ ID NO: 20285 - DNA, 231 bp, Glycine max
  Peptide Sequence Number=SeqID_111970
atgaccaaagtgaaccaagagccatttctagggcaaaatttgggtgttgaagagtcaaattttgattcgcttgggaggattgatggggaaccggtgttgagagaaacgaggatatgggctacgtgggagtacgtgagctcagttggaggtgggcaacaggggatgatgggtttatgcgcgcattgtggatgtggaaaacttgttatgcaccatcgcccgaccgccacctag

SEQ ID NO: 20286 - DNA, 342 bp, Glycine max
  Peptide Sequence Number=SeqID_111971
atggaaaaacgccagcaacgcggcctttttacggttcctggccttttgctggccttttgctcacatgttctttctgcgttatccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaattttatcatggcacgtaagctcaactccattatggacatcactgctcaaaaggagaattggaaagctgataagattgttgctcaaattaaaaatgttgatcttggtaaggggatcctctag

SEQ ID NO: 20287 - DNA, 466 bp, Glycine max
  Peptide Sequence Number=SeqID_111972
atgggtcaacttcaacggcaagccttccgcaaagcctatggtaagatttgggacctagctagggtaaaagtctccatggaaccaattgcatccctttcccagtattatgaccagcccctaaggtgcttcacatttgaggacttccagctagtgccgactatgaaagagtttgaagaaatcctgggatgcccactgggaggaaaggaagccatatcttttctctgggttctatccctccacgacaagagttgccaaggtgtcctctttccaaatatggaagggttagtagacctagcagcgattaacactttcctcgcctttcatcatggcgaggaaagcccggtcgtcgccattttggccatgtatgacacattcgaccggggatgtgaaaagagcggcgcaagaattgtttgttgtgcactggctctctatgtgtggctggtttcacacccttttctccaagaag

SEQ ID NO: 20288 - DNA, 501 bp, Glycine max
  Peptide Sequence Number=SeqID_111973
gcaagagtcttggcaagtcaaggcgaatgggccccgttcatggacatcctggcacttttgatcttcggggtggtcctctttccaaatgtggatgggttggtggaccgagtagcgattgatgtttttctcgccttttacgatcgcaaggaaagcctggttgtcgctatcttagccgatctatatgacacattcgaccgaagatgtgagaagaacaatgcaagggaaggaagaaccgagattcttatttcgtttgggaaatatccaaatgttcccttgatggggacaaggggtttcaatagcaccaacgcgggggtgcttcaaagggtccacaaggcattggaaatgtcgcaaagaaaggacaaggaacttaggggaagcagcaacaagcccgtcggcgattaccgtaggtggctgaaagcctatgcacaagatctggattggctcccgagtttgaggaccactaagggggtggaggttgaaaccccagaagaagacgaagag

SEQ ID NO: 20289 - DNA, 153 bp, Glycine max
  Peptide Sequence Number=SeqID_111974
atgttgagtattctcttgatgtatattgatgcaatcctccctaggaagggaccagtcactagagccatgagaaagaggctccaagaggattgggctagagctgctagaaaaggccctagggttctcatgaaccttaggggctccataatgtag

SEQ ID NO: 20290 - DNA, 386 bp, Glycine max
  Peptide Sequence Number=SeqID_111975
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatccccattgtgttccccactgtcaccagtgtggggaaaggtgtgaacatgaagtccttgctgcttccaaggaaaggttttgtgcttcttcagctgctgatccgcatcaatctagcttgcctccttggttgcagattgcagaatttggctcaacaaaagggttga

SEQ ID NO: 20291 - DNA, 420 bp, Glycine max
  Peptide Sequence Number=SeqID_111976
atgactttgctgctcagcaacatcctgctcatcgatcataattccgacctccccctgctgaagtgtatggcgcctactaggcaccctttggacccagataagtccaacagggccctgggatttccagcactgatcacaggactctgccagtcgtttggagtccccgttgcacctaccaaggtgattcggccgcccatcacccgggcttttattgagaagtactgcacccagagacaggctcaggggaatgctccacaggccgcgggcgcgccaccaccacctcatcaggctggcccggctgggtcattcgacatggagcagtatttacggcatttggttcgccagcaggcagccaaccaccgggcacatgtgcagacccatgattgcctataccagatgagcctcagcatgcagagctag

SEQ ID NO: 20292 - DNA, 192 bp, Glycine max
  Peptide Sequence Number=SeqID_111977
atggtagtagagggctttctttctgggaagttcatgatgcaagctccattggagcttgtaggcctaggatcttcttcatcaatggattcctttgcttcttggaagataaatggcagcagaatggagaaggaagagagagaggagacgccacttcaaggagaagatgagtctagaagaagctcaccaccatag

SEQ ID NO: 20293 - DNA, 501 bp, Glycine max
  Peptide Sequence Number=SeqID_111978
atggataagaagatccgcagtattgtgagtaacattctgaaaaatgcttctgtccctgatgctgatgaagatgttccaacatcttccacccctaatgtttctgttcctgatgctgagaaagatgttccaacatcttccaccccaaatgctgaagtcctctcttcctccagcaaagagagatcaacagaggaagatgatcaagccacagaggagacccctgcaccacgggcaccagaacctgctccaggtgacctcattgacctagaagaagtggaatctgatgaggaacccattgccaacaagttggcacctggcattgcagaaagattacaaagccgaaagggaaaaacccccattaagagacaacatctcattagactcactccatatgcaaatgttgatgatgaaatttgtgtatcaacggcagttgcctggaaagagaacgggaatagagatgccttttgcaaggcattggacctcaatcaggctttgaaaaactga

SEQ ID NO: 20294 - DNA, 267 bp, Glycine max
  Peptide Sequence Number=SeqID_111979
atggcaaccatggctgaagaagaaaaggatgagaagatagtggatggagataatcaacaactggtaactgaacaagcatctaaaccagaggacaatttttgtgaacttgaggagatagaagatgaagaggatgaccaggagaatgagaatacaataagcaagaatgagaatgaaataaatgatgagaaaaagaaagaaaaagaaaaagaaaaagaaaaagaagaagaaaaagaaaaagaaaacaatgaaaaaattgaaaaaaaatga

SEQ ID NO: 20295 - DNA, 264 bp, Glycine max
  Peptide Sequence Number=SeqID_111980
atgccgggagcagacaagccccgtcagggcgcgtcagcgggtgttggcgggtgtcggggctggcttaactatgcggcatcagagcagattatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 20296 - DNA, 831 bp, Glycine max
  Peptide Sequence Number=SeqID_111981
atgtttatagatgggttgagaccacaaaccaagcaactgttagatgctttagcaggggaaaaaataaagttgaagaccccagaagaggcaattgagctaattgagaatatgtcagccagtgatcatgctattttgtgcgacagagttcatcaacccaaaaagaaaagcttgttagaactatcatcacatgacactttattgacacagaataagttgctttctaagttacaggttgtaccatctgtggtgaggctcatgaaacatgccaatggtccttataatcaacaaggacagtggagatcacaccttggcaatcaattcaacaaagaccagggtggaccttcgaacaggccaatccaacaagggcctaacatctttcagaggactactaagctggaggagactttgactcagtttatgcagttaacgatgtcaaatcataaaagcactgagtcagcactgaaaaaccttgagatccaggtgggacaattggccaagcagatagaaaagaatcccaaggaggaatgcaaagctgtgatgacaaggagtaagaggtttgtggaggcggaggatgaggaaagtgttgtgcccaagaagaaagctgttgaaaagaaaggcagtgatgaaaagaaagatgatgcgataggtgaaagtaatcaggaaaaagaaaaacaaataatggtcaagaaaaaagaatttaatgaccaagaaaaagaaaaagaagtagaaaaagaaaaagaaaataaaaaattgaaaaaaatgaaaaaaataagaatgacgagaggagtagaagtgaacaagctagagagaagaaaagagaaaaagctatga

SEQ ID NO: 20297 - DNA, 276 bp, Glycine max
  Peptide Sequence Number=SeqID_111982
atggtaggaggaacatggggagtgatgaattttaaaggagaagtgatccaacctgttgcggaacaaacgaattccgtagaagttaatgggaaattttatccaaacccattcaaatataatgagaaggagaaactctcagcagagggccaggaaatttttgcactggactatgataatgaaaaggttccttttgaaaagtggcttaagagagaaatcggaaaagctcagaaatatcaggaagaacatcctgataatcctaataaaataagtaaataa

SEQ ID NO: 20298 - DNA, 336 bp, Glycine max
  Peptide Sequence Number=SeqID_111983
atggtttgggcaccttcgcaacaaagctttgaatctcttccatgtatcacggagaggttcatcagacccttgggaaaaactctactgagttttaaaagattggctaagattttgttaaaacataagcacttagacaatgaaggaaagctggagttgctgcacatgatgtccaacgttatgtcaaagaataagatcgggctgcacaatgcacaaggcaagatgaaatgtcaaatgaagaattgtagctgcaggattcacgatgtcggatacaatgtccaggacatcctgcccgagaatactggagttgctatacaatgcaagataaaagtcaagtag

SEQ ID NO: 20299 - DNA, 586 bp, Glycine max
  Peptide Sequence Number=SeqID_111984
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccaatattccattcgctgaggcaattgctcaaatgccaaatcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 20300 - DNA, 408 bp, Glycine max
  Peptide Sequence Number=SeqID_111985
ggcgcgtcccattcgccattcaaggctgcgcaactgttgggaagggcgatcggtgcgggcctcttcgctattacgccagctggcgaaagggggatgtgctgcaaggcgattaagttgggtaacgccagaattcgatcagaacctgaagacgctggaggagggcgcggccagcctgggtgcgacgtttgctcagcgctttcgcaccatcgtgctgccgaacgtgcagcccggcatcctggccggcgcgctgacggtggtgacatcaagcttatcgataccgtcgacctcgagggggggcccgcggagtgtatactggcttactatgttggcactgatgagggtgtcagtgaagtgctttcatgtggcaggagaaaaaaggctgcaccggtgcgtcagcagaatatgtga

SEQ ID NO: 20301 - DNA, 1177 bp, Glycine max
  Peptide Sequence Number=SeqID_111986
agcttgccgtaggcgatcacggcgaaacgcggttcggcgcccgcgaccttgttcaccagcggccaggtgcggcggatggtttccgtcagcagcaggtcggccagcgcggatagctggtcggcgagcttttcgaccgtcagctcgccctccaggtcctgcgccaacaactggaagctggcctggcgctgcacgtcgcgcatcaggttcatctggcgctcgatgtcgggatcgccatcgggcaggcggcaggcgtcgaggtcggcggacaactggcgcgcgatctgggcgaaatccagcggttcgaacagcgtgcgccagtcgatcaggctgtccagcagcagcggatgctgcgtcaggtactgggccgcccacgggctggccgcgaccatgcgcgcgacccgcgccagggtgtcggggtattccgccagcagggccagataggcgctgcgctgggcgattttctcgatcaagtcgaacaggcgcacggccgcgtccagcggcgcgtcggtctggcgggcggcgcgcagcgcggccggcaacagcgtttccatgcggcgccggctgctttcgggcaggctgcgcacgcgatggctgcccagcagcgtttcggtgcggcgcaggcgcaggtcgtcggcctgctcgccgaaggctggcggatctgctcggccagttcgcattgctcgtcgctttcgtccgcggtggtttcttcggcgcgtggcatcggcgctgtccgccttgtccatgccgaccatgcggaatacttgcggaaggtctgcggaggacgaactggcgatgcgccgccagcgtggtttcaaatcctgccgcatcaatttgccgagggcaggcggccaatccggcgcgcagcgccgggtccccggcaggagatgggtctgttcgtcttccggtattgccacgcgtgttcgatagtgcggcggccagaaccggtaggcatcctccagcggcgcgcgtcttgcgccggccaggccggcaccttcgagcgtgcagggccgggcaacaggtccgcgtcaggcggatgtccggcgcgctcggggcccagcttgcagtgcgctgtcagccgttccgcggacggagttcccgccgctgccaccaggtcctgggatgggcatcgagacgcgcaggtggccggaccaggcaagggcggcgcagggcggcatga

SEQ ID NO: 20302 - DNA, 337 bp, Glycine max
  Peptide Sequence Number=SeqID_111987
atggtgaaagttggaacctcttacgtgccgatcaacgtctcattttcgccaaaagttggcccagggcttcccggtatcaacagggacacccaggatttatttattctgcgaagtgatcttccgtccacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgcca

SEQ ID NO: 20303 - DNA, 474 bp, Glycine max
  Peptide Sequence Number=SeqID_111988
atgatagatcaaggtcgactggaagtcggcagtgaaggaaaagaagagcagcatatatgcatgcagtctacggaggggagcagtgtcgcgaagcccaaacccttggtgatatacttcactaaaagcgcagcttcgcaaaagctcggacaccccttagtagccaaacctgttcctttcccgtaccaaaatagccacgcagtcccgtggagatatacacctccgagggagaaggaagaagaagccactgacgtcagctcgctgtcagctaaagtaacaaatatcacggggctgagcggtgtgacccgtagtggtcgtgtgttcgcacctccgaacctaccagtccaacccgccgacgtcaagggaaaaaggaaaagtgggtgggagggaacaagatgggcgaaagcacccccacgctttcgaaataaagaaaattccgggcaaaagggccctcccgggagaaaaaaggatgggtaa

SEQ ID NO: 20304 - DNA, 454 bp, Glycine max
  Peptide Sequence Number=SeqID_111989
taccttcacccttagagggctacacgccctcgccatcagagggctacacaccctcaccttcagaggactacacgtcctcccttttagagggctacacaccctcgccttcagaggattgcacgtcctcaccttcagagggctacacgccctcgccttcagagaactgcgcatcctcaccttcagagggctgcacaccctccccttcaaagggcgacacgtcctgaacttcagagggctgcacgctcttgccttcagagagctgcacaccctcgccttcaaaggactagatgtcctcaccttcagaggattacacgtcctcgcctttaaagggctacgcatcctcactttcaataggctctgtcataccctaatttcgtctggggattattacttgatgacatgcaacctttgggtagccgctttgagatactttgcgtcctttgttgcacaataa

SEQ ID NO: 20305 - DNA, 651 bp, Glycine max
  Peptide Sequence Number=SeqID_111990
atggggacaaggggttgcatcaattacaatcccgtccttgctataagacaacttggctaccctatgagaggggcaccactagaggaagagctcgcacctattattgcacgaagtttcaatagcaccaacgcggaggcacttcagaaggtctgcaaggcatgggagatggtgcaaaagaaggacaaggaactcagaggcagtaacaacgagcccatcgatggctaccgtaggtggttgaaagcacacatgcaaggtctggattggctctcgagtttgagaatcactaagggggtggaagttgaagctctggtggaggatgaagaggtgcaggccctcagggcagaactcgagaaagcccaaacaatcaaggaaaagttcaaatcagcagctcttaagatccgaaaggagaatgccaaactgagagacgtaaatatagccgccaccaaggccttggaacaaaaggaccaaaaggcaatgctgtggatggaccgatttgctcttactttgaatgggagtcaagaacttccccaattgctggccaaggccaaagcaatggcggacgcctactccgcccccgaggagatccacagacttctcagctattgtcagcatatgatagacttaatggcccatataattaggaaccactag

SEQ ID NO: 20306 - DNA, 192 bp, Glycine max
  Peptide Sequence Number=SeqID_111991
atgggtgttaaacattttgaggtggtcaaacgaaggtcgcatgtcgacaaacaatggtccccaaatgaaattagggaaagttcaccaatagaaggcataaccttggaagctaagggtagccaaaggaaccttcctttcctcacttgtatgatggcatgcaaagagttgctcaaccttcattttctaatctaa

SEQ ID NO: 20307 - DNA, 207 bp, Glycine max
  Peptide Sequence Number=SeqID_111992
atggtgaaagttggaactctacgtgccgatcacgtctcattttcgccaaaagttggccagggcttcccgtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 20308 - DNA, 632 bp, Glycine max
  Peptide Sequence Number=SeqID_111993
atgggaacaaatcaaatcggaaaaagattctatcaagtcaagattaagggcctaggtgtcaccagccttaaggagttggaacggttgatgggacccctccagatgcaagccttccgcaaggcgtacggaataattttagatttgaccatagtggaggtattcacggaagccgttgtatccctcacccaatactatgaccatccattgagatgcttcacgtttggggacttccaaatagtaccgactgttgaagaatttgaggagattctaggatgtcctcttgggggaagaaaaccgtatcttttctccgggtttcttccctccttgagcaagattgcagttgtggtcagggattcggcgagagagttggatcgcgtaaagcaaactcaaaatggcgttgtaggcctactgcagaagtacatggaaggcaaggcaagggatatggcaaatcaagaggagtgtgtcccgttcacggacgttttagctttgctaatctttggggttgttctctttccaaacgtggacggtttggtggacctagccgcgattgatgctttccttacatatcaccatagcaaggagagtccggtggtagctatcttggcgaacttattcgatacatttgaccgaag

SEQ ID NO: 20309 - DNA, 204 bp, Glycine max
  Peptide Sequence Number=SeqID_111994
tcacgaaactttatggattacgcaaccatcccctcttcggcttctggagtgttacggaactttacggattgcgcaataatgtttcctttcgactcccgacatgtcacagaacttcacggattgcttaacgatgagtgtcaagtccctcgaagcggtcaaacgaaggttgcatgccatcaaacaatgatccccggacgaaattag

SEQ ID NO: 20310 - DNA, 453 bp, Glycine max
  Peptide Sequence Number=SeqID_111995
atgccaatctccccctgcagatgtaccgggatcgcgcccacaagacgcccagtgggcccgaagaagtccaacagggccctggggtttctagctctggttacgggcctctgtcagtcctatagggtgcttgttcccccagaatcgcacccacaaagacacccagtagacccggagaagtctaacagggccctggggtttccagctctgggatcgcgcctgcaggacacccagtggacccgaagaagtccaacagggtcttggagttgtcaagctctaattacgggtctctatcagttctacggagtacctgtcacctccagcaagggcatcaggcccctactaatcaagctttcatcaagaagtactgcgtccccaggcaggcgtagggcaaaataccacaacagcctagggatggccggcagcgggcaacagatgcaccgccatcacctctag

SEQ ID NO: 20311 - DNA, 189 bp, Glycine max
  Peptide Sequence Number=SeqID_111996
atggggggtgcagtgaccttgttggatgtccctggtgggggaaatagagtgggtgacctcgacacttactgcctagttttcctaagtgagagtgtcgtgtcgacatgcttagactatttccttggggatgatatcatgttgcatttgagagttgaggtcaggtgcatgcatcatactgagcatgattga

SEQ ID NO: 20312 - DNA, 3312 bp, Glycine max
  Peptide Sequence Number=SeqID_111997
atgaagagaaaagctgcagcatacaacaataaagcaggctccaccaatgttcagtcttcaaagaagcctgttgaaaatcctaaagttattgcaaagtttgagtggagaacaaaagtgaattctcctgttgttgaggatgcaattgataacttcaccagacatttaatttctgaatgggtgacagatctatggtattctcgcttaacaccagacaaagagggtcccgaggaggatcttattaatctcatttgctcacacttggagctgtttcgtgctgcccactcaaaaattgaaaaacgacatacaggttcattaacaatcgaaagtcgagacatggaactaaaaaatgttttggctgctgagaacaaattgcatcctgctttattttctgcagaagctgagcataaggttttgcagcatctgatgacaggtcttatgcatgttactttcaagtctgaggatttgcagtgttctttctttcgatatactgtcagggagcttcttgcatgtgctgtaatacggcctgtcctaaacttagcaaatccaagatttattaatgaaagaattgaatctgtggtagttaacaagacaaaggttaacaagggggttgctgcagctcaagaggcatctcacactaaagcagatgagatacaaatttcatctgatgatttcttcaagtcttcagatccttctgttactggtgttgagcttgtgcagctaagaaatggtcaatccaaaaatgcagagtcatctgcagaaaataatggccgtgataatattactaaagatccattgctttcaattgatgctcgaccttcccgtacatggaactcaatgcctgcaaactccctaactaatgataacctaggtcttcaacgacatcgctcaggaggagagtggggagatattttagatgtcatctctcacagaaagacccaagctcttgctccagaacattttgaaaatatgtggactaaagggaaaaattacaagaaaaaggatggcgagaaccagtcaaatgagcatgtttcacagcattcccaggtaggaaaactgtcgatggtagatcatatgaaggaaatatctggaccaaacgaaagagatactaattccaagcttatgcttccgcctaagggacgccacattaattctgggcacaacagtcaattctctgtagaaaatacctccattcatgcagacaagaatggatcaacttcagttacctcatacaaagatgataagtcagttacctcgtataaagatgatgagcacagccacatttatgggcagatgagtgattcagcgagcagtacttcttattcctctgaagataacgaaagtagtactgtcactggtcttgattcccctgtcactaaggtttgggatggaaaaagtaatagaaaccaggctgtttcttatgttcatcacccacttgaaaattttgacaatcacagtgcaaagaaaaggaataagagccattctcggtatccaagattatccagagcccaatctggcagtaaaaggtcttggccaggtggtcaaaaaatacaaacgtggcaggaagttgagagaacaagctttttatctggagatggtcaagacatacttaattcttcaaaatcacatataaattctgaggagtccagtgatgatgctgatatggaaagtttgggtagactttatagtggagcagctgcctcctcttctgcctactctatttctaaatcagaatcttgtagtttgtctgttggtcccctgaaaaattcctctgctgtagattccttttacaagttgagatgtgaggtcttgggtgcaaatattgtgaagagtggctcaaaaacctttgctgtttactccatatctgttacagatgtaaatcacaacagttggtcaattaaaagaaggtttcgccattttgaggagctacatcgacgcctgaaagagttcgccgagtataatcttcatttgccaccaaagcattttctgtcaactggtttagatgtaccagtcattcaagagcggtgtgaattactggataaatatttgaagaggaaaaaattatctgcttttggtactgtgatagaaccacgatcaccaatactctgttaccagcaggatagatattggatattaaaacttatgcaattaccaacagtttcggaatcaattgaagtatgggactttctcagtgttgattctcagacatacatattctcaaattctttttctatcatggaaacattatcagttggcttgaattcaaaaccatttgagaagactaaaaacacttccaacttgtctgcacctgcaagcgatcctgtttccttttggagagaaaactgtagtgctgaaagtaaagaggctgttttgggagcaagaaataatgttgtggccaatggaatgaggtcaaaagtaaacagcacacctctttctctaccaaaaaagagtacacacgaacctagaaagtcatttgacaattctagcagcaatacaaacattctagcacggaagagtgtaccttctcccaagacagtgaaaggaagaaataattcagatgaggtttctgaagtgcaccatgatacttccgatgcttttccaacagagtgggtgccaccaaatttgagtgtacccatattggatctggttgatgttatcttccaggttcaagatggtggatggattaggcggaaggctttttgggttgctaaacaaatcttacaactaggaatgggtgatgcctttgatgactggttgatagagaaaattcagcttctccgtaagggatcagtggttgcttcaggggtccagcgagttgagcaaatactatggcctgatggaatattcataaccaagcatccaaatcgacgaccaccgccacctactagtccatctcagaattctcctcatggcaatcaacctacacaagtgtcttctccaaggttggatgatgagcagcaacaggaggcagatcggcgtgcaaaatttgtatacgagctaatgatcgatcatgcaccgccagcaattgtaggtcttgttggtcggaaggagtatgagcaatgtgcaagggatctatattttttccttcagactctatgctcaagcaagactcacttccgtcattctctctgtctctccataatttggtcgtgtaaatacttcctattgacttccttgcagtcatccgttatcttgaagcagctggtttttgacatcttggagctgctgctgacatcggcatttcccgaacttgataatgtgttcaagcagctgcatgaagaaaagcataaatttggagagttcagaacagagtaa

SEQ ID NO: 20313 - DNA, 528 bp, Glycine max
  Peptide Sequence Number=SeqID_111998
atggcaactgtaagtggctatattccggttggtgtgttgacttttgaaattcttggtgtgattagaatgtcttctaattatggaaggataatgctttggtcgagtggttacatgtctctagagtatgcaatcaatggtgttgtgccggtcaaaacagatgtatatggctctggcgagggtaaggtcgcgttgtgttgcgtcgtgtcgtgcgctgttcctctgtttctcgtttttgtgttcagaccgaaccctagctccgcatcgcaaccatgtcgaccaagcaagactaagattctttggtttgcaatttatctgatcgatttcttttttccctctttgggacttttaggtggaaaagctaagcctttgaagaaacccaagtctgataagaaggattacgacgagattgatgtggctaacattcagaagaaaaaggaagaggagaaggcgctaaaggagttgaaagccaaggcgcaacagaagggaagctttggaggttctgggctcaagaaaagtggaaagaaataa

SEQ ID NO: 20314 - DNA, 822 bp, Glycine max
  Peptide Sequence Number=SeqID_111999
atgattcaaaatggttgcattgtatcccaagggtgtgcccctctgaattctaggtcacgcaaccatggcatacctagtacctctgcctttcgttgcgcttctctaatgcctcccaaggttgccgtctctaacatccggagcttttggggacataatctggaatgtaaacccttgttgccaagaggaatgacattgacaaacacgtttgctgtatcaagcctgcgtgtaagggagggtcaaaatcatctctttcgtgctctccctcttttaccccggttgcgcaagtctaatatggcccctcgagcatcaaaggatgtcccaactagcttccgttatcctccaatgaccaagaaaccgcaatggtggtggagatcattagcatgcctcccttacctcatgcctctccatgagacatggatgtatgccgagacagcatacaatcttcacccatttttggaatgctttgaattctatacttacccttttcttatggccattggaagccttcctagctggtttctcatggcatacttctttgttgcatatcttggaattgtgaggagaaaagagtggcctcatttcttcagatttcatgttgtgatgggaatgttattggagattgccctgcaggttatagggactgtgagccgctggatgccgctatcactctactggggtaaactgggaatgcatttttggactgccgtatcatttggttatctatttaccgtcttggagtccataaggtgtgctcttgccggtatgtatgctgacattcctttcatctgtgacgcagcatatatccagataccatatgattaa

SEQ ID NO: 20315 - DNA, 5175 bp, Glycine max
  Peptide Sequence Number=SeqID_112000
atgacaggtgggatgtttggaaggaaggggcaaaagataaaggggacagtggtgttgatgccaaagaatgtgttggacttcaacgccataacctccgtcggaaaaggcagtgctaaggacaccgccaccgatttcttgggcaaaggcttggacgcattaggtcatgcagttgatgctctcactgccttcgctggccatagcatctccttgcagcttatcagtgctactcagactgatggtagtggaaaaggaaaagttggaaacgaagcctatttggaaaaacatcttccgaccttgccaacgttgggagcaaggcaggaagcattcgatattaactttgaatgggatgctagttttggaattccaggagcattttacatcaaaaactttatgactgatgagtttttcctcgtcagtgttaaactcgaggacattccaaaccatggaaccattaacttcgtttgtaactcatgggtttataacttcaaaagttacaaaaagaatcgcattttctttgtcaatgatacatatcttccgagtgctacaccaggtccactagttaagtacagacaagaagaattggaggttttaagaggagatggaacagggaagcgcagagactttgacagaatctatgattatgatatctataatgatttgggcaatccagatggtggtgatcctcgcccaatcattggaggctctagcaactatccttaccctcgcagggttagaaccggtagagaaaagaccaggaaagatcccaacagtgagaaaccaggcgagatatatgttccaagagatgaaaacttcggtcacttgaagtcatctgatttccttacatatggaatcaaatccttatctcagaacgtgatacctttgttcaaatctataatatttgacttaagggtcacatcgagtgagttcgatagcttcgacgaagtgcgtggtctctttgaaggtggaatcaagctgccaacaaatatactgagccaaattagccccttaccagtcctcaaggaaatcttccgcactgatggtgaaaatacccttcaatttccaccacctcatgtaatcagagttagtaaatctggatggatgactgatgatgagtttgcaagagagatgattgctggtgtaaatccaaatgtaattcgtcgtcttcaagagttcccaccaaaaagcactcttgatcccgcaacctatggtgatcaaactagtaccataacaaaacaacagttggagattaacttgggtggggtcacagtagaagaggcaattagtgctcacagattattcatattagattaccatgatgcattcttcccgtatttgacgaagataaacagcctacctattgcaaaagcttatgccacaaggacaatcctgttcttgaaagacgatggatctttaaagccacttgctatcgaattaagcaagcctgcaacagtgagtaaagtggtgttgcctgcaacagaaggtgttgagagtacaatttggttgttggccaaggctcatgtcattgtgaatgactctggttatcatcagctcataagccattggttaaatactcatgcagtgatggagccatttgccatagcaacaaacaggcatctcagtgtgcttcaccccatttataaacttctttatcctcactacaaggacacaataaatatcaatggccttgctaggcagtccctgattaacgcaggtggcattattgagcaaacatttttgcctggaaagtactccattgaaatgtcatcagttgtttacaagaattgggttttcactgaccaagcattaccagctgatcttgtcaagagaggattggcagttgaggatccctctgccccacatggtcttcgccttgtgatagaggactacccttatgctgttgatggacttgaaatatgggatgctattaagacatgggtccatgagtatgtctctgtgtattacccaacaaatgcagcaattcaacaagacactgaacttcaagcatggtggaaggaagttgtggagaagggtcatggtgacttaaaagataagccttggtggcctaaactgcagactgtggaggatctcattcaatcctgctctattatcatatggacagcttcggctctccatgcagctgttaattttgggcaatacccttatggaggttatatcgtgaaccgtccaactctagccagaaggtttatcccagaagaaggaaccaaagaatatgatgagatggtgaaggatcctcaaaaggcatatctgagaacaatcacacccaagttcgagacccttattgacatttcagtgatagagatattgtcaaggcatgcttctgatgaggtctaccttggccaaagggataatccaaattggactacggattcaaaggcattggaagctttcaaaaagtttggaaacaaactggcagaaattgagggaaaaatcacacagaggaacaatgatccaagtctgaaaagccgacatgggccagttcagcttccatacacattgctccatcgttcaagtgaggaagggatgagtttcaaaggaattcccaacacaaagatgtttgggatcttcgacaaggggcaaaagataaaggggacagtggtgttgatgccaaagaatgtgttggacttcaacgccataacctccatcggtaaaggtggtgttattgacacagccaccggcatcttaggccaaggcgtcagcttagttggtggagtaattgatactgccacttccttcttaggccgtaatatctccatgcaattgatcagtgctactcagactgatggcagtggaaatgggaaagttggaaaagaagtctatttggaaaaacatcttccgaccttgccaacgttgggagcaaggcaggatgcgttcagtattttctttgaatgggatgctagttttggaattccaggagcattttacatcaaaaactttatgactgatgagtttttcctcgtcagtgttaaactcgaggacattccaaaccatggaaccattgaatttgtttgcaactcatgggtttacaacttcaggagttacaaaaagaatcgcattttctttgtcaatgatacatatcttccaagtgccacaccagctccactacttaagtacagaaaagaagaattggaggttttaagaggagatggaacagggaagagaaaggactttgacagaatctatgattatgatgtctataatgatttgggcaatccagatggtggtgatcctcgcccaatccttggtgggtctagcatctatccctaccctcgcagggttagaacaggaagagaaaggaccaggacagcggtaacagatcccaacagtgagaaaccgggcgaggtttatgttccaagagatgaaaattttggtcacttgaagtcatcggatttccttacatacggaatcaaatccttatctcacgatgtgatacctttgttcaaatctgcaatttttcaattaagggtcacatcgagtgagtttgaaagcttcgaagatgtgcgtagtctctatgagggtggaattaaattgccaacagatatactgagccaaattagccccttaccagccctcaaggaaatcttccgcactgatggtgaaaatgttcttcaatttccaccacctcatgtagccaaagttagtaagtctgggtggatgactgatgaggaatttgctagagaggtgattgccggtgtaaacccaaatgtgatccgtcgtcttcaagaattcccaccaaagagcacacttgatcccacactctatggtgatcaaaccagtaccataacaaaagaacaattggagattaacatgggaggggtcacagtagaagaggcacttagtactcagagattattcatattagattaccaagatgcattcatcccatatttgacgaggataaacagcctacctactgcaaaagcttatgccacaaggacaatcctgttcttgaaagatgatggtactttgaagccacttgctattgaattaagcaaaccacatccagatggagataatttgggtcctgagagtatagtggtgttgcctgcaactgaaggtgttgatagtacaatttggctattggccaaggctcatgttattgtgaatgactctggttatcatcagctcgtgagccattggttaaatactcatgcagtgatggaaccatttgccatagcaaccaataggcatctcagtgtgctccaccctatttataaacttctttatcctcactaccgcgacaccataaatatcaatggacttgctaggcagtccctgattaatgcagatggcattatagagaaatcatttttgcccggaaagtactccattgagatgtcttcatccgtctacaagaattgggttttcactgaccaagcattaccagctgatctcgtcaagagaggattggcaattgaagatccctctgcaccccatggccttcgccttgtgatagaggactacccttatgctgttgatggacttgaaatatgggatgctattaagacatgggttcatgaatatgtctccttgtattacccaacagatgcagcagttcaacaagatactgaactacaagcatggtggaaggaagctgtggagaagggtcatggtgacttaaaagaaaagccttggtggcctaaaatgcagacaactgaagatctcattcaatcatgctctattatcgtttggacagcttcggctctccatgctgctgttaattttggacaatatccttatgggggcttaatcctgaaccgtccaactctagccagaaggtttatcccagctgaaggaaccccagagtatgatgagatggtgaagaatcctcaaaaggcttatctgagaacaatcacacccaagtttgagacccttattgatctttcagtgatagagatattgtcaaggcatgcttctgatgagatataccttggagagagggagactccaaattggactactgataagaaggcattagaagctttcaaaaggtttggaagcaaactgactggaattgaaggaaaaatcaatgcaaggaacagtgatccaagtctgagaaaccggactgggccagttcagctgccatacactttgctccatcgttcaagtgaggaagggttgactttcaaaggaattcccaacagtatctctatctaa

SEQ ID NO: 20316 - DNA, 909 bp, Glycine max
  Peptide Sequence Number=SeqID_112001
atggggaatcagaagcagaagtggacgcaggacgaagaagacgctctcatagccggcgttgaaaagcacggccccggaaagtggaagaacattctcaaggatccccaattcgccccttttctcacttcccgttccaacatcgacctcaaggataaatggcgcaatttgagcgtcagcaacggtgctcaaggctccaaagaaaaatctagggttcccaagcctaaagccttctctgctcctcctgctactaccgccaccaccgccactcctcagaacgcttctcctgctcctcaaagcgcatcgtctgatgctgctgttgcccctgacgcttctcagaatgaccaagatgccaaaaaccctccaaggtataatgcattgatttttgaagctctatcagcactgaaagatagtaatggatccgacatgaatgccattattaaattcatggagcaaaaaaatcatcaggtaaaccaaaattttaaaagggcattaagtacacggttgaggaggcttgttagtcaagggaaacttgaaaagttgagggtgagccttgggacaatggtgaagttgttgtcttatgacctaaaggtaccaaatggttacaaggtgaaaaaggaagcctcctcggggacaaagtcaccttcaccaaaagcaaaggatgtccggcctccacaaccacaacggcaatctccagcttctctctttatgactaatgacacattaaaggaagctgcggatactgcagcctacagagttgctgatgctgaaagtaaatcatatctggctgcagaagcagtaaaggaggcagaaaaaatatcattgctggttgaacatagtgattcaatgttacagctagcaaaagatatatatgaacaatgttcccgtggtgaaattatcctcttggcttaa

SEQ ID NO: 20317 - DNA, 354 bp, Glycine max
  Peptide Sequence Number=SeqID_112002
atggcagattcaacgatgacggataatgaggttgctgaagctgcgaggaaaaaggaatacgtgaagatgaaggaaactgggggagtgaagagaacacatttgactgaatcaagctatacagacattcagtcaccattctcgaaaatctcatcccaacaaccactcccagcacctccttgccactctacttgtctctcacagctgatggatctaaaacctgtagttcatcctatgcagaaggcccagaacaacaccttgggtacaggttcaaagaactgccactctaaaccaagacagagtctttgtaatgcaagaaactggagccccaaaatccaagtagccaaccccggatag

SEQ ID NO: 20318 - DNA, 405 bp, Glycine max
  Peptide Sequence Number=SeqID_112003
atgggaccctatcaagcccattttatcatttgtattatcgaagccccttatcaacaacacgacgccgttttccgccaagaagacgacaacgttttgcccgacgacgaaaaaaacgtgcactctccctccaccgctctcgctgtcaccctccaatttcgacgccaaccgccaccaccaccatcatcgtcctcgccgactcgtggagaagatctaagggccctgggagcgagagggttttcgttgaacttgaaccctatgccttttatgaatttgagttttggaggtggggaaatggaggaagcaacacatattggagttggaactggtgcaggatcagatcaaggttgctatggaggagttgcggggaagaaggagaagatacttttttttaataataataaatga

SEQ ID NO: 20319 - DNA, 366 bp, Glycine max
  Peptide Sequence Number=SeqID_112004
atggcgtctctgaggagtggagcttcttcgttgttgaatcgcctttcgaaatcgcttcttcttcattccaacaaaaaccctaatcctcaatctcagttattactcccttctctctctagactccccggtgcgatttctccccaaaacgacgccgaattcccccacacacaaggctttctctacccctgtggcctcccctctctccgcttcttcttacctcatggggaagctccttcgtcagatgatcctatgcttttattccccaaaaggacatatcaaccaagcgttattcgacgaaagaggaaccatggattttttgctcggttaatcccttatcttttttggttatatgctcatttatcatga

SEQ ID NO: 20320 - DNA, 957 bp, Glycine max
  Peptide Sequence Number=SeqID_112005
atggtaaactttaacatctgtagaagaattttggttaccacaagtgaagtttccatagtagttttcaggagtgtgtatctggtgcatgcttgctttttcttgtttgcatgtttgtttaaggtttgtgctgtaaaagctcctggttttggggataatagaagagcaagtctagacgatcttgcaattcttactggaggagaggtcatcactgatgagcgtggtttggctcttgataaagtccaaccagaaatgcttggcactgcaaaaaaggttactatcaccattgatgacactattattctacatggtggtggggataagaaggtcattgaagagagatgtgaacagctgaggacagctatggaaaagagttctgccacatttgataaagaaaaagcacaagaacgcctatcaaaactatctggtggtgtagctgttttcaaaatgcaaccaaatcttcaggttgggggggctagtgaggccgaagttggggaaaggaaagatagagtaacagatgctttaaatgccactagagcagctgtggaagagggaattgttccgggtggtggagttgctctcctatatgctaccaaagtcttggataaccttcaaacccaaaatgaagatgagaaaagaggagtacaaattattcaaaatgcactcaaggcaccgacgattacaatagcttcaaatgctggttttgatggtgctttggtccacagcaaattgttggaacaagatgatcataatttaggttttgatgctgctaaaggtgtctatgctgatatggtaaaggctggaataatagatcctctcaaagttgttagaactgctttggtagatgctgccagtgtgtcattgctactgacaacaaccgaggcagctgtggtggataattcacatgacaagaataaacctcctagtcgggtgccagatatggatgatttggatctctaa

SEQ ID NO: 20321 - DNA, 267 bp, Glycine max
  Peptide Sequence Number=SeqID_112006
atgtacacacaaaacaaggccaatgagaggcagccacttataggtggggaagaagcagcttcttcagagagtgagtgctttttctggacccgtgagattccatggcttcagttggtgcagtcaattgcaaattcttcttgtgtctacttctatggctctggaactttctacctccttctcaagatatatataagaggagttctcatttctttcaaggctaaaaatcaggctgaaatccttttgaatctcaatttttttatttgctaa

SEQ ID NO: 20322 - DNA, 2517 bp, Glycine max
  Peptide Sequence Number=SeqID_112007
atgtggaatgtgccactactcttggtggtggtggtgtttgcatgctcactgattggtcatgcttcagcttctgtgtcctatgaccataaggctatcaccatcaatggacaaagaaggatactcctttctggctccattcactatcccagaagcacccctgagatgtggccagatcttattcagaaggcaaaggaaggaggtttggatgtcattcaaacttatgttttctggaatggacatgaaccttcacctggcaaatattattttgggggaaactatgatctggtgaggttcataaagctggtgcagcaagcaggcctctatgttaacctcagaattggtccttacgtttgtgctgaatggaactttggaggtttccctgtttggctcaagtacattccaggtatcagcttcagaacagacaatggaccgtttaagtttcaaatggaaaagtttaccaagaagattgtggatatgatgaaagcagaaaggttattcgagtctcagggcggtccaataattctgtcccagattgaaaatgaatatgggcctatggagtatgaaattggtgctcctggtagagcctacactcaatgggcagcacatatggctgtaggacttggcactggggttccatggatcatgtgcaagcaagaagatgctcctgatcctatcattaacacttgcaatggtttctattgtgattatttctctccaaataaggcttacaaaccaaagatgtggacagaagcttggactggctggtttactgagtttggaggtgcagttcctcacagacctgctgaggatttggcattttcaattgcaaggtttatacagaaagggggatcatttgtcaattattatatgtatcatgggggaacaaattttggtcgaactgctggtggtccctttattgctacgagctatgattacgatgcgcctcttgatgaatatggattgcccagacagccaaagtggggtcatctgaaggatttacatagagcaataaaactctgtgaacctgctttagtatctggagatcctactgtacaacagcttggaaactacgaagaggctcatgtttttagatcaaagtctggggcttgtgctgcattccttgcgaactataacccacaatcttatgcaacagtggcatttggaaatcagcgttacaacttgcctccttggtctataagcattcttcctaactgcaagcacactgtttataacactgcaagggttggttctcagagcacaacaatgaagatgactcgtgttcctattcatggaggactatcttggaaagcatttaatgaagagacaaccactactgatgatagttcgttcactgtgactggcctgttggagcagataaatgcaaccagagatttatctgattacttgtggtactccacagatgttgtgatcaattccaatgaaggatttttgaggaatggaaagaatcctgttcttacagttttgtctgctgggcatgctttgcatgtttttatcaacaatcagctgtcaggaactgcatatggaagcttagaggcccccaaactaacctttagtgaaagtgtgaggctcagagctggtgttaacaaaatttctcttctaagtgttgcagttgggcttccgaatgttgggccacattttgaaagatggaatgctggtgttcttggcccaattacattaagtggtctcaatgaggggagaagggacttaacttggcagaagtggtcatacaaggttggtcttaaaggtgaagccttgaatcttcattctcttagtggaagttcctctgttgagtggcttcagggctttttagtttccagaagacagccattgacttggtacaaaactacctttgatgccccagctggagttgcaccattggctttagacatgggcagcatgggcaaaggtcaagtgtggataaatggacaaagtctgggccgctattggcctgcttacaaagcatccggttcttgtggttactgtaactatgctggaacttacaacgagaagaaatgtggaagtaactgtggccaggcttctcaaagatggtatcatgttcctcactcatggctgaagccaactggaaatttattggttgtgtttgaggaattgggtggggatccgaacgggatctttttggttagaagggatatagatagtgtatgtgctgatatctatgagtggcaaccaaatcttgtaagttatgacatgcaagcttctggcaaagtcagaagtcctgtgagaccaaaagcacatttgtcatgtggccctggacaaaaaatctcatcaatcaagtttgctagctttggcactccagtagggtcttgtggaaactaccgcgaaggaagttgtcatgctcacaagtcatatgatgctttccaaaagaattgtgttggccagagctggtgcacagtgacagtgtctcctgaaatttttggaggagatccttgtccaagtgtcatgaagaaactctcagtggaagccatttgcacctga

SEQ ID NO: 20323 - DNA, 1950 bp, Glycine max
  Peptide Sequence Number=SeqID_112008
atggataatggaaaaccaaacccaaaacttaaattgaagttccagttatggttcaagccggcagaattagaaccaagttgggcgaagatgttgagcaatgactgggaatttcaagggctgagggaggctaccttcccactaaggtccaattgtcaggtcaaactttaccatgatgctcaccattcttctgcttttcaacctccatttgatctatgtggagctccaaaaaagctatgggaggatgtctataaagccattgagggtgcaaagtatttagtttatattgcagggtggtccttcaatcccatgatggttctggttagagatcctctcacagaaatcccacgtgccagaggaataaagttaggtgaactattgaagaagaaggcagaggaaggagtggctgtgagggttatgctttgggatgatgaaacatctttaccctttgttatgaacaaaggtgagctgaacaaccaagatgaggaagcttttgcttatttcaaccacacaaaagtaatatgcagaaagtgtcccaggtcacaccatatgttccccacactctttgctcaccatcagaagactataacagtggacaccaaagcacccaaatctgtcggtgacagagaacttatgagctttctgggtggattagatctgtgtgatggaagatatgactcagagcaacattcattgtttcaaacactcattagggaatctcattgttatgacttctaccaaacaagcattgaaggagctagcctcaacaaaggagggccaagaaaaccttggcatgatgctcatgcttgtgttactggtgaggctgcttgggatgtgttaaccaattttgagcaaagatggacaaagcaatgtgatccttcttttctagtcccttctagcaccttagcaaatcttatgcctaggacaagctcaagcactcctacggagaggaattggaaagttcaagtatacaggtcaattgaccatgtctcagttggtgagttgtctacaaagttaaatgtggagaggagcatccatgaggcttatgttgaagcaattaggcgtgctgaaaggtttatttacattgaaaaccaatgtttcattggggggtgccattggtggaagaaagataggcacagtggctgcactaatctaattccaattgaaattgcactaaaggtggtaagtaagattaaggcaaaggagagattttccgtgtacatagtcataccaatgtggccagaaggagagcctgaaagtgaacctgttcaagatatactgcattggacccgagaaacaatggcaatgatgtataggttgattggagacgcaatacaagaaagtggagaaccagcacaccctagagactacttgaatttcttctgtcttgcaaatagggagcagaagggacaaggggagtatcttccactagattctccccaacctgaaactcaatactggaatgctcaaaaaaataggagattcatggtttatgttcactccaacttcatgatagtggacgacctgtacatattgataggatcagctaatgtaaaccaaagatccatggacgggcaaagggacactgagatagccattggatgctaccagtctcaagatggagatgataacaaccaaatgaacctagatgatattcaagcatatagaatgtctctatggtatgagcacactgttagtgttgatgagttgttcttagagccagaaagattggaatgtgtggagagaatgcgctcaataggagatgaaatgtgggaaatctacagcagtgaagaaattgtggacatggaaggtgtgcaccttgtaacttaccctgtgagagtaacacaagaagggtatgtgaaagacctcactgatggagttcactttcctgatacaaattctttagtgaaagggaaaaggtctaaaatattgccccctatctttaccacttag

SEQ ID NO: 20324 - DNA, 147 bp, Glycine max
  Peptide Sequence Number=SeqID_112009
atggaggaaactcctaagctcctccatggaacaattgaagctactatcttcaatgcgtcaccttactcacctttatttcccttcaattgcatatgtgcaaatggaaatcctgcttatgtgactataaagatagacagccagaagtag

SEQ ID NO: 20325 - DNA, 225 bp, Glycine max
  Peptide Sequence Number=SeqID_112010
atggcaaccggaatcggaagcgctgaaattgccgatggaacgatgtttgcaatggagctcggaatcttgtcggagaaagcatttaacaagaggtcgagggttttgaggctaatagggagttcgtcggagatgcttccagagaggtcgagatgcgctttggaagagcagttcgccagggatgcttccagatttatcaacggaatgacgtcggtggaagaacaataa

SEQ ID NO: 20326 - DNA, 1251 bp, Glycine max
  Peptide Sequence Number=SeqID_112011
atggaaggtggaaaaattactcaatcgggtaattacgacaatctcctgacatctgggacagcctttgaaaaacttgtgagtgctcatgaggaagcaattacagagttggaacaaagtaatgaaatcaaaactcatacggaagagtctcaagatttttatgtcgctaaaaacgaaagtgaggaggagatttcaactgagggtcaacttgaggcacagcttacacaagaagaagaaaaagagaagggtgatgttgtctggaagacattctgggattatatttcgttttccaaggtttcattcatgctgtgttggatcatattggcacaatctgcttttgttgctttgcagactgcatcaatgttttggcttgctctagccattgaagttccaaaattaactagtgccaccttgattggagttgactcattaatttcatttgctagtgttgcgtttgcttcagcagatttgagtattttgaactttgatataccttattccatcacctttgtagtatctgtagcaattgatattgtggtgacgatttatataatggttttagtaacatggccagtactcattgttgccattcctgcaatggttgcatcaaaatatgttcagggatattatcaagcctcatcaagggaattaatgcggatcaatggaaccacaaaagctcctgtcatgaattttgcagctgagacatcacttggtgtggttactgtaagagcatttaacatggcagaaagattttttaagaactacttaaagcttgtggacacagacgcaacactgttctttcattctaatgtggccatggaatggttagttttaaggattgaagcacttcaaaatttgacggtcattacttcagctttgttacttattctagttcctcagggatatgtgacctcaggccttgtgggactgtctctctcttatgctttctccttgacaggatctcaaatattttggactcgatggtactgcaacttattaaactatattatctctgttgaaagaatcaagcaattcattcaccttccagcagagcctccggccatcgtgcaggaccaccggcctccatcttcatggccttccaaaggcaggattgaccttcatgccttagagattagatatcgtcccaatgctccattagtgcttaagggtatcacttgtacgtttaaagaaggtagtagagtgggagtcgtaggaaggacaggaaatggaaaaagtacactcataagtgcttag

SEQ ID NO: 20327 - DNA, 693 bp, Glycine max
  Peptide Sequence Number=SeqID_112012
atggatgggggggttacgccacgtgttgcgggtgacattggccatgctgaggtggggatgcaagacccaacagcattccaaggagtgaagccaccccagtttcctgaacaagaacaactcaagtgtccacgttgtgactccaacaacaccaaattctgctactataacaactacaacctctcgcagccacgccacttttgcaagaactgcagaaggtactggactaaaggtggcgctttgagaaacatccctgttgggggtggaagcagaaagaccacaaaacgttcttcatcaaccttatcaaaacgctcttctgcaccatcttcttcctctgcagtttcggatcctgacccgacccggatttgcaccaacccggttgatcaagaccaaagggtgctcaacattggtggtggcagtttcagttcccttctagcttcatctgggcacttcggaaccctcttggagggtctgaatccatctgggtcgggtctcaaaatgggtgaatttgtggagggcgtgagttctgacccgggtctgaatctggattcgggtctaaacccggatttgcaggttcagagcaatgagaattcagagagttttctaggtttgcagaatggtgattcaagctgttggaatggtactcatggttggtctgatcttgcaatatacacacctggcccaagttttcaatag

SEQ ID NO: 20328 - DNA, 1749 bp, Glycine max
  Peptide Sequence Number=SeqID_112013
atgaaaaagcatggaaatgaagaacatgtttttgaaattggggtggtgattcctaggagagtggttcaggaaaaagatgaatcatgtgactgtgcatacgtccttgtaaaggagtttgagaaggtgggatttgtagttgagagagttattggcattgcagatgagttcatcaagttggctgcacctttggagacgttggggagggctgcagctgaactacaaatcaagaaacggactcttattggtatatgcgattccctcaaagggggcatctgttctgcctgttacgatagtatggatttgcaatttgaggttgaggaggttgaagcttttgtgaaacaacctgatggttctgttttcagttggtatgagcgttttcagtgctactgtcacttgatatatggaatagtaaacaacagcaagtcagtaaaaacccttaaatttgatggaaaagaaatccattgggaaattggggagaatctgcttctaaaattggaatcagtggaaattgttaagcaagtctttcctttgcatgatgaacagaagagaaagaaacttcttagaagttgggcacttcaatggtgggacttcactagtcagccaatcgatgagatttattcatattatggggcaaagttctggaaacgtaaaaattctgcacttttagccagatggcctattagttctatagttgcagctgaccaaggatacaagatttcaggcaggaagtcgagctcctggcagcccccaatggaactcatgaaagtatttgagactgatagagctaaagagaaggaaatattccagagacatgagtggcttgggcgtcttatgcgattcagaaatgatgctatcattatcttcagcatcatatgcctccagttaccatttgagttggcatatgctcatctttatgaagttcttgattctgatataattaagtttgggctcactgctgtataccttttcgccattcagtatattaccaagattggtggcaaggtgtctgtcaaacttatcatgaatgaaaacaatgagaacacagaaaaacgggctgatagcttggtctacaaggtgttggaaaacttggtggaaaattcattgccttatctcaagtatagctataaaaagtacagggttcgacacaagaagaatgagaaaggagaagcaagagaaaagttccagtttacttctagagtagaaaaagaatacctgaagctctcttactctgctagcattggtgaggagcttgaagatgggttatttgatgatttcttagaattggcattgcagtttggaatgattttgatgtttgcttgcgcattcccacctgcatttgcttttgctgctgtgaacaaccttatggagatcaggacagatgcattgaagctgctagtgattttgaggcggcctgttcctcgtgccgctgcaacagtaggagcctggcttaacatatttcagtttcttatattgatgtctatatgcaccaactgcgctcttttagcatggctatatgatgaggagggaaaatggaaaatagagcctggacttgcggcaatattaatcatggagcatgtcctcttgttgactaagttcggtctctctcgcttcattcctgaggaacctgcttgggtaagagccaaccgtgcaaaacacactacacaggcacaggatatgtgttctaagaagcttttaaggactatttccggaggagataagacatttagagaggggaaaaaattggaatga

SEQ ID NO: 20329 - DNA, 567 bp, Glycine max
  Peptide Sequence Number=SeqID_112014
atgaaagataggaaattactagaaaaactccacttcttataccacaagcatttaccagtttggttgaatgcagatctcggcaaggtgctgaatttgcctagttttggaggacttcctcaatgggctgtagtaggggacacattcccagttggttgcagatttgatgaatccattgttcaccataagtattttaaggaaaatccagactacaacaatccagcatacaacactaaatatgggatttactcagagagatgtggacttaacaatgtgatgatgtcatggggacacgatgactacatgtatctagtggcaaaggagaatagtactacactgccctctgcggctttgttcattataagataccattcattctatgcattacatagggaaggagcctataagcacctgctgaacgatgaggatgttgagaatctgaaatggctccacattttcaacaaatatgacctttacagcaagagcaaagttcgaattgacgttgaaagggtcaaaccatactatctctccctcattgaaaagtacttccctgcaaagctgaagtggtga

SEQ ID NO: 20330 - DNA, 1674 bp, Glycine max
  Peptide Sequence Number=SeqID_112015
atggccagtattctgtgtccttctttaaccatagtcacgtcctatgcattcagcaatgaaccaaaacttgtctctaaattcactgcagtaacaggaaactcttactcaccactatggctttcttgcacacgccctggaaatccagctagaaaccattttcagctcaaatcctcaaatgggcttccgcaaaatgctgtttcttctaatgacggtttagctggaagttcattggccaaagaagatggcaagccccaaccacttgaaggaccatttccctttccagattcagaatataccggatccaaccttagtataactgttgttggagcttctggagaccttgctaaaaagaagatttttccagcactctttgctcttttttatgaagattggctacctgagaattttcttgtgttcggatttgctcggactaaaatgaccgatgaagaattaaggaacatgattagcaagacactaacatgcagaattgataagagggaaaattgcgaagataaaatggatcagttcttaaaaagatgcttttaccattctggtcaatacaattctgaggaccacttttcagaattggatagcaagctgagagagaaagagggtggaaaactgtcaaacagattgttttatttgtcaatacctccaaacatatttgtggatgtggtgagatgtgctagtcttaaagcttcttcaaaagatggatggacaagggttattgttgaaaagccatttggtcgtgactcagaatcatctagtgagctaacaaagagtttgaagcagtacctcactgaagaccaaatattcaggattgaccattacttgggtaaggagcttgtggagaatctatcagtgcttcgcttttcaaatcttgtttttgagcctctgtggtcccgaaattacattcgcaatgtgcagataatattttctgaagattttggaactgaaggaagagggggttattttgatcactatggaatcattcgtgatataatgcaaaatcatcttctgcaaatactagcattgtttgcaatggaaacacctgtaagcttggctgctgaggacatcagaaatgaaaaggtgaaggttctgagatcaatgagaccactggagcttgaaaatgttgttgttggtcaatataagggccacagcaagggtggtaaatcacatcctgcttatacagatgatccaactgttccaaagggtagtcttactccaacatttgcagcagcagctctttttattgacaatgccagatgggatgggaggaattttggaactgatctggacaaagccacaaatgagcttgtgcttcgtgtacaacctgatgaagctatatatttgaagatcaacaataaagttcctggtcttggaatgagattagacagaagtgacctgaatttgcttttccgagcaaggtatccaagagaaataccagatgcatatgagaggttactcttagatgccattgaaggtgagcgaaggctgttcattagaagcgatgagcttgatgcagcttgggcactattcactcctttgctaaaggaaattgaaaacaagaagattgctccagagctctacccctatggtagcagaggaccggttggagcacattacctttctgcaaagcacaatgtaagatggggagatcttggcgaagactaa

SEQ ID NO: 20331 - DNA, 162 bp, Glycine max
  Peptide Sequence Number=SeqID_112016
atggcagtgcagcagaaggaaatcgccattggtgcaggcgatttgcagagaggaaatcgccattggtgcaggcgatttgcaggtgaagttttgaatcttagttccactgtcctaacactacactgtgtattctccatacgtgctttggattgctattcttaa

SEQ ID NO: 20332 - DNA, 1473 bp, Glycine max
  Peptide Sequence Number=SeqID_112017
atgatgaacgccgcaacagcagctaacagcagtgtttactcacagacacagtgcagaccactttcctcggatgttcgaggttcgattccttacttgaatgaacggaagtctcggttggtggtgagggctggtggcggtggtcgtcctcccaaggaggatggtgaaaagcaacagcaacaacaacaacaacctgtgtctcttaggcttgacgacgtgaaccctgtgggactgggtcgaaggtcgcggcagttatttgatgaggtttggagaaagttctcgggattgggtcagatttctggcactatccggtcggatgatcaggaggctttggatgcccttctggtccgcgaaggtccgatgtgcgagttcgcaatccctggcgctcagaacactactgtactcgttgttggtgccaccagccgcatcggtcgcatcgtcgtgagaaagctcatgctcaggggctacgctgtcaaggctttggtgaggagggcagatcaggaggttgtagagctccttccaaggtcagtagagatagtcattggggatgttggtgatcccgccactgtcaaggctgctgttgaaggttgcaacaaaattatatactgtgccactgctcgctctgctattactggggatctcttcagggttgatcatcgaggagtttctaatctaactaaagcttttcaggatcacaataataaattggcccaatcgcgtgctgggaaaagcagcaaaagtaagctcttgattgccaaattcaaatctgcttcttcactcaatggatggcaagttcgtcaaggaacttacttccaagatgtagttgccacaaaatatgatggaggaatggatgctaaatttgagttcaatgagaatggagatgctgttttctcagggtatgtcttcaacagaggaggctatgtggaactatcaaaaaagctttctctgccactaggttatactcttgataggaaattctatcatgcattcaagcataatgagttcatctgtaatgataggtatgagggtttggttctttctgttggtggcaatggaaggtcttatgtattaattctagaagctggtccttcggcagatccaagtcagagtagattgtattttgcaagaattagtacaaaagtgggattttgtagggttagagtaccattttcatcattccgcccagtgaaaccagatgatccagtgttagatccttttcttgtacatactttgaaaatacgctttgagcctagaagacagcgagctgtgggtcaacaacatctagtggaggcagaactacagcaggagttacagctagatcctattatttacttgccagctaaggtttttgctgagagtgtggtcatgcagaaggatgagcagatacctcaagtcctaattaaattaaatggcaaggaaaaactgaggaagaggcggcatggaagatgtacaagtcattcaggactatttccctga

SEQ ID NO: 20333 - DNA, 1332 bp, Glycine max
  Peptide Sequence Number=SeqID_112018
atggaacatcccagagagacgcagcagcagcagcagcagcagctagcttctaaaagaatgaagttagaagtggaggtaatctccaaggaaatgatcaaaccctcttctccaacccaggaccatcttcgtcactatccactctcttttctcgatcaagtctctcccatggtgtataaccctatggttctcttttactcttgctacggtatcactcaaactcaattcaccatttccgaaaagctgaagaaatctttgtctgatgttttaacccatttctaccctcttgccgggcgagtcaatgggaacagtactttcatagactgcaacgacgagggtatcccctacttagaagcaaaagtgaagtgcaaagttgtcgacgttattcacaaaccagttccaggagaactcaaccatttggttccatttctactagatgatatcaccaatatcacatttggtgttcagcttaatgtttttgattgcggcggtattgcaatcggagcttgcctttctcaccagattgcagatggtctgtcatttttcatgttcctcaattcttgggcagcatttgctagtaggggggaacaagctgtgttgccaaacccgcagtttatttcagcaaagctcttcccaccgaaaaatatatctggatttgatcctcgaagtggcatcattaaggagaacatcatctgcaagatgtttgtgtttgatgggtctgttgttgaaagtcttagagcaagatatgcagcaacaagctttgaaaacgagaagcaccctacccgagtagaggctttatctgctttcatttggagtcgttatgtggctgtgactggtccacagagaacatatgctgtggttcacgcagtgaaccttcgtccaaagatggaaccaccactgcctccagattcctttggcaattactaccgaatctctttgacgattccctcgttgaacactgaagagcacctagtgaaacaggcaagggatcagataaagaagattgacaaggattatgtgagaaaacttcaatatggaaacgaccatttggatttccttaaggatagctcatatagagtgcttctgaagggggaactagtcccatttaatattactagtttgtgtaggtttcctctctacgacgctgattttggatggggagaaccaacatgggtaggttcacctgctttaacttttaaaaatctggttgtctttatagacacaaagaatggcggtggcattgaggcttatgttagcttaaaggtggaggacatgacaaagtttgaagcagatgaggagttacttgcctgtgtgagtaaagcacgggtttgttga

SEQ ID NO: 20334 - DNA, 2076 bp, Glycine max
  Peptide Sequence Number=SeqID_112019
atggttaaggctcgaagaatggaggataagaacagagttttagggatattacccttgagtaatagccagggtaaggtagctgatcctactaatgttgctaaaacaggatccagtggatggcaaggtagaagaatcttccataatttgtcatccgcggaagtaaatgagaaaatgaggaaaggagaatgtttcacctgtgaagaaaagtataatcccgctcgcgtgtgtaagaataaacagttcagattgatgattatggaagaagaggatgaaggggagacccttgcttatgaaatgcaggctgttttcctcaacttgaccttgaggacaagggagaccaaggaaaaaaatggcgaaaccattaagaaggatttagagattcctggagctgaagctcttgttataagagttgtgtcatctgttgacaaaaagttagaagtgaaaccgcggtttctggagatttttcaggaagagaattacccaacagaatttccatataaatcaaaggtagttttgttgtttcaaaggatagaaggtgtggaagtttgcctatttggcatgtatgttcaagaatttggatctgaatgtcaatttcctaatcagcgccgcgtgtacctttcatatttggattctgtgaagtattttaggcctgaggttaaagcagtgacgggagaggctcttcggacttttgtttaccatgaaattctgattggatatcttgaatattgcaagaaacgtggttttacaagctgctatatctgggcttgtcctccattaaagggggaagattatattttatattgccatccagaaattcagaaaaccccaaaatccgataagctacgtgaatggtatctggccatgttaagaaaagctgcgaaggagaatattgtggtcgacctcaccaacttatacgatcatttctttgtatctactggtgaatgtagggctaaggttactgccgcaagactcccgtattttgatggtgactactggcctggggctgcagaggatttgatttatcagcttcgccaagaggaagatggaaggaaacaaaataaaaagggaacaactaaaaagactataacaaaaagggctttgaaagcgtctggtcagtcagatctttcagcaaatgcctcaaaggacctgctccttatgcacaaagttttgttagccaacgtcgcccttgtgaaagtaaaatgtccctatggcaaaatgcaaatggaagagctgaaggtcggtggtggcatgagggtggctggagagtgtcggtgttacgaagcagaactaaagcgtgaagagagagaaagacatcctattaaccagagggagaaacatactctttatcctgttgaaattactgatgttccttctgatacaaaggacaaagatgatattcttgagagcgaattctttgacactagacaggcatttctgagtctctgccagggaaatcattaccagtatgatacactaagacgggccaagcattcctcaatgatggttctctatcatcttcataatccaacggctccagcatttgtgacaacttgcaatatatgttatcttgacatagaaactggtcaaggatggcgctgtgaggtttgccctgagtatgatgtatgcaatgcttgttatcaaaaggatggaggtattgatcatcctcataagttgacaaatcatccatccatggtggatcgtgatgctcagaacaaagaagcaaggcagcatcgagtatcgcagctacggaaaatgcttgatctccttgttcatgcatcccaatgtcgttctgcacattgccaatatcccaattgtcgcaaggtgaagggacttttccgccatggaatgcactgcaaaacacgagcttctggaggttgtgttctttgcaagaaaatgtggtatttgcttcaacttcatgctcgtgcttgcaaagaatctgaatgccatgtaccacgttgcagagatttaaaagaacatctaaggagacttcagcaacagtctgattcacggcgtagagctgctgtaatggaaatgatgaggcagagagccgcagaagttgctaacaatgctggatga

SEQ ID NO: 20335 - DNA, 1581 bp, Glycine max
  Peptide Sequence Number=SeqID_112020
atggactctgacaaagaggcaagaggtgtgaagggatcaagtgaggaagaagagagtgggaggtgggaaggaagaggaaaggaaggaaggaaggaccgaaggaagggtgtgaagaaggggactggggctgaaggcccaagctacacagtagatgatgctcttgtggctttgggttttggaaatttccaaattctcgtgcttgcttatgctggtgtaggttgggtttcagaagcaatggaaatgatgatcctctcttttgtaggccctgcagttcaaactgcatggaatctttccgctcatgaagagagtttgataaccagtgtggtttttgctggcatgctaatcggtgcatactcatggggcattgtttcagataaacatggaaggaggaaaggattccttatcacagcgatagttactgctttggctggttttcttagtgcatttgctcctaactatatattattaattgccctccgttctctggttggtcttggtttgggaggtggccctgtattatcatcttggtttctagagtttgttcctgctcccaatagaggtacctggatggttgtcttttcagcattttggactcttggtacaatttttgaggcctcacttgcatggattgtgatgccaaaactgggttggagatggcttcttgcactgtcgtctcttccctcatctttccttcttctgttctacaaagtgactcctgagtcacctagatacctgtgcttgaaaggtagaacagctgatgcaattaatgttttggagaaaatagcaagagtaaatggaagagaacttccttccggtaaccttgtttctgaccatgaaattgagttacacaaaattgataacccttcagaggacacacgcttgctctcaccaagaacaaatgaagttgaacatcctaaaggaacagtctccaatttaggtggtatttcatcattgttagtgcttctctcaccaaaattggcaaggccaacccttctattatgggctgtgttctttggtaatgctttttcgtattatggccttgttttgttgaccactgagttgaacggacatagtaaatgcatgccagataaattgcagacagagaagtcccaggatgttaaatacaagagtgtttttattgctagttttgcagagctacctgggctcctcttgtcagctgcggcagtagataaactcggtcgtaaactctcaatgtcaaccatgttcttcatgtgctgtattttccttctcccattattattctatctgcctgaaggcctaacaacgagctttttatttctagctcgcatatgcatcacagcaaccttcacaattgtgtatatatatgcaccagagatgtacccaacatcagtcagaacaactggtgtgggaattgcaagttcggtgggcagaattggtggaatgatatgtcctttgatagctgtgggtttagtacatggatgtcatcaaactgcagccgtccttctgtttgagatcgtagctcttctttcaggaatatgtgtcatgttcttcccaattgagaccatgggccaagaactgcgagatagtgtgcaagtctaa

SEQ ID NO: 20336 - DNA, 2253 bp, Glycine max
  Peptide Sequence Number=SeqID_112021
atggctcttgtaggagttgaactgaagcatgcggcggagggcgtaccggaggcgaattgctccgccaagcccaccaagcagggcgagggcctccgccactactattctctcaacatccacgagcatcagctccttcttcgccaaaagactcataacctcaaccgtctcgaggctcagagaaacgacctcaattctagggtgaggatgctgcgcgaagaattacagcttctgcaggaacccggctcttatgtcggtgaagttgtcaaagtaatgggcaagaacaaagtccttgtcaaggtccacccagaaggaaaatatgttgttgacattgacaaaaatattgacattacaaagattactccatccactagagttgcactccgcaacgacagttatgttcttcacttagttctgccaagtaaagttgatccattggtcaatctgatgaaagttgagaaagttcccgattctacatatgacatgattggtggtttagaccagcaaattaaagaaataaaagaggtactttgcttgacattctttcaatgtcaggagttagatgcttttatctatccatgcatcactcgtgtgttacctttccgtgtgcatgtcattgagctaccaatcaaacatcctgagctgtttgaaagtcttggaattgcacaaccaaagggtgtcctgctctatgggccacctggtacaggtaaaacattgttggctagggcagtggctcatcatactgactgtacattcatcagggtgtctggttctgagttagttcagaaatacattggagaaggttctagaatggtcagggaactttttgttatggccagggaacatgctccatcaattatcttcatggatgaaattgacagtattggatctgctcggatggaatctggaagtggcaacggtgatagtgaggtacagcgtactatgctggaacttctcaaccagttggatggatttgaagcttcaaataagatcaaggttttgatggccaccaatcggattgatatcctggatcaagccctccttagaccaggacggatagaccggaaaattgaatttccaaaccctaatgaagagtctcggctggatattttgaaaatccattctagaagaatgaatttaatgcgtggcattgatttgaagaagattgccgagaagatgaatggagcatctggtgctgaacttaaggctgtttgcactgaagctggaatgtttgctttgagggagcggagggtacacgtgactcaggaggattttgagatggccgtggcgaaggtgatgaaaaaggagactgaaaaaaacatgtcattgcggaagttgtggaatggcgtggaaggcgaatcagccactggcactgaacaattaaccattaacaagaacaagaacatttcaagggaggacatagtaatggacatggttctgcattcagccttgtacccaccatctctgtcttgttcctcttctactactggaacaagatggcccaattcccgggttggtgttagtttgagttggaggagcttgtccttggtgccttgtgcactgaaggcatattatgattctgaattggagaataaaaagcatctacttctgacctctgtccaagacacgcaaaggggcctcttaacaactcctgatcaacgctcttgtatcgaggaggctctggtgagtctcgaaggatgcaacattggctctcaccctatcaatctctccaacttggatggaacatggcgcctccagtacacttctgcctctgatgttctcattcttctccaagctgctgctactcttcctttctttcaagttggacagatctttcaaaaatttgaatgtcgtgatcaatctaatggaggtgttatccgcaatgttgttcgatggagcattccaaatttgttagaggaacaagaaggtgctacactgcttgtatccgccaagtttaatgtagtatctgtccgtaatatctaccttcagtttcaagagatcacaatccaagatataaatattagtgaagagctgcaggctctaatagctccagcaatactaccaagatcttttataagtcttcagattttgcaatttctccgcactttcaaagctcaaatccctgtgagggatccaggaaggcaatcagttggaggactatattaccttagctatttggatgataatatgcttttgggtcgtgctgttggtggaggaggggtatttgtgtttacgagagcccaatctctctactga

SEQ ID NO: 20337 - DNA, 2061 bp, Glycine max
  Peptide Sequence Number=SeqID_112022
atggcggcaacccaaccaacgcagggtccggatcgtaccaccggtaccaacgctgtaatccctgatgggatgggatcatcgtggtctcaagcgtttatagtgtgtgtggctgaagagataccagccgaaccagataacttgaaggagcagggtacggcaattataggtcattcaagggagaccacaagtcaatcaggatctttaggttcaagtggagattgtcctctgtatcctcctaatgtgtatgctccccaagcccaggctttctactatagaggttttgacaacggcaatggtgaatgggatgaatattcttcatatgtcaattctgagggattagacattggatctcctggtgtttacaatgaaaacccatctcttattttccattctggttatggcttcaaccctcaaatgccttatggaccatattccccagttaccacacctttgccttctgtaggtggagacacacagttatactcccctcagcaatttccatacactgggccaccttattatcatcagctggttcctcctagcttaccatatcttaattcacctactccagtttcacagccagagctcaccagcctggtaggtattgaccaacaagttgataacatgttttttggaccaagagcgggctatccgtcagtgggatcttttggtagaggcaactttcctgtagcacctggttcctttggctttcatgaatcccaacaaggatttgaaggatcaagatctggtggaatctggtcagactgctcaaaaccatctgaaagacagagatctttgatgcctctatcgccatctgtttctccacagccaatgggctcacttgggtcatttgggccgagtgttggaatggcttctcatcaacagcaatcattgtatgggtttggatctgcttcaaactcctatggtagaggctacctgccgaaccagggctctagctttggaggcacttctatttccaatcttaatgataggaggtttgcttctcttgaaaatagcaggcggcaagggaggccaactgcttctctttgcaattgtaatggtactcttgatatccttagtgagcagaaccgaggaccaagggcctcgaagttgaaaaatcaaatttcagctgaaagtaattctgtggatggcagtaaaaatagtggatctactgctaagttccaaaatgaatcactcaattggtcagattttgccacagattacaaggatgccaaattttttgtcatcaaatcttacagtgaagataatgttcacaagagcattaaatatggtgtctgggctagtacaccaaatggaaacagaaagttagatgctgcatatctccaagcaatggagaagcaagatgccttgactctatatttctgttgtccggtgtttgcagcaaaccttggttcagaggtaaatgctagtgctcagttctgtggggtagctgaaatggttggacctgtcaattttgacaagagtgtggacttttggcagcaagacaagtggagtgggcagtttcccgtgaagtggcacataattaaagatgttccaaacagtcagtttcgtcacattgttcttgaaaataatgataacaagcctgtgaccaacagtcgagatactcaggaggtgaagttgacacagggggttgaaatgttgaccatttttaaaaactatgaaactgatgtgtccatcctggatgattttgatttctatgaagaccggcagaaggctatgcaagaacggaaggcaaggcagcaaagcagcatggtggctactggattggttggagaaaatgaacatcggagttctgctaacactaccggtgatttcatgaagcagatgtcgaagagctttgctctagttgtccgcttagatgagaataacaaggaagttgttgttgcagatagagatagtttagtctctcatggtcatggccccattggtaatgtagttaaacctgatgatggtcaatcagtgactgcctcttcaactcaaaccagtagcgttgctgttgttattcaattcaagtcgatggagtccggggtttctaaatga

SEQ ID NO: 20338 - DNA, 3429 bp, Glycine max
  Peptide Sequence Number=SeqID_112023
atggatcatgacttggagaccgctgctttgggggcttaccaggacaagcctagaaccttccccaacatgcgcactaaaccttacacccctctgatatttcgtattttacttggtatcaatgttcgtgtcctcttcattcttttgctcctcggcttgggagctatcttttacgtcggagcttctacttctcctatcattgtctttgttatctctgtttgtattctcagcttccttgtggccatatatcttacaaagtgggtcctcgcaaaagatgaggggcctcctgaaatggttcagatatcagatgctatacgagacggagctgaaggatttttcaggacccagtatgggagtatatctaagatggccatgttgcttgcccttgttattctttgcatatatttgtttcgcagtacaactcctcaacaggaatcttctggcctgggaaggacaacttctgcatacatcaccgtagcttctttccttttaggcgccctttgttccggtgttgctggatatgtagggatgtgggtgtcagttcgtgccaatgtcagagtctctagtgctgcaagacggtctgcaagagaggcattgcaggtagctactcgtgcaggtggtttatctgctatcattgtcgttggtatggccgtaattggtatagctgtcctttatgccacattttatgtttggttgggagtggacttgcctggttcaatgaaggttactgatttgcctcttcttctagttggatatggatttggtgcctcctttgttgcactatttgctcagttgggtggtggaatatacacaaaggcagctgatgttggagcagaccttgttggaaaagtagaacagggaatacctgaagatgaccctaggaatcctgctgttattgctgatctggttggtgacaatgtgggagattgtgctgctcgaggtgctgatctttttgaaagtattgcagctgaaataatcagtgccatgatacttggtggaacaatggcacaacgctatccatctggcttcatcttgtttcctcttgttgttcactcattcgatctgatagtttcatcagctggaatattttctattaggggtacacgtgaaactggaattatagttcccatggaggatcctatgacaattcttcagaaaggatattcttttacaatagttttagctgttctggcattcggtttggtaatgtctacccggtggttactctacactgagcaagcaccttcagcatggttcaattttgctttgtgtgggttgattggtattatcactgcttacatatttgtctggattgccaagtattataccgactacaagcatgagcctgtgcgcatattagccctttccagctctactggccatgggaccaacataattgcaggagtcagtttgggtctggaatctactgctcttcccgtccttgtcatcagtgtgtcaattatctcagctttctggctgggccacacctgtggactagtagatgaaacaggaaacccaactggtgggctgtttggcacagctgtggcaacaatgggaatgcttagcactgctgcctatattcttaccatggatatgtttggcccaatagctgataatgctggaggaattgtagagatgagtcagcagcctgaaagtgtccgagagataactgatgtccttgatgccgtaggaaacacaaccaaagctaccaccaaagggtttgctattggttctgctgctcttgcatctttccttttgtttagtgcttatatggacgaggtttctgcatttgctcatgaaccttttaaacaggttgatattgctattcccgaagttttcgttggtgggctgctaggttccatgcttatatttgtttttagtgcttgggcctgtgctgctgttggcagaactgcacaagaagttgttaacgaagtgagaaggcagttcattgagaggcctggtataatggattacaaggagaaaccagattatggtcgctgtgttgctattgtagcatctgcgtcgttaagagagatgataaaacctggtgctttggcaatcatttcacctattgtagttgggcaacctttactcggggccaaagttgtggctgctttgctcatgtttgcaacagtgtctggtattcttatggcactttttctgaacacagcaggtggtgcctgggataatgcaaagaagtacattgagactggagctcttggaggcaagggaagtgaggctcacaaagcagccataactggagatacagtgggagacccattcaaagacacagctgggccttcaatccatgtcctcataaagatgcttgcaacgattacactgcaaggccgtggttttggagaaaacactaacagtaacaggattaagaccaacaaatctgacaagggattggtgtctcagcaaagcaagggatcagcaaataaacagtctcgccctctatcttctcaggcaccccgtttaagttcacaacttgacggcaaatctaggaacgattttttggatgttgactttgaggaacggctaaaagcagttagaaggtcagcacttgagcagaagaaggcagaggaggaaaaagaatttggagcaattgactatgatgcaccaattccttccgacaatacgacaattggcgttggtactaagattggagttggggtagctgttgcagtctttggtctggtttttgcttttggagattttcttccatcaggaagtgttagtcccactgaagacagtgctgtggtcaatagtaagttgtctgaggaggataaagctactcttcagagtaggctcaaggaatttgaagcaacattaagtaattcctcaagagatccaactgctcttgaaggagctgcaataactttggctgaactaggggaatatgcaagagctgcttctctacttgatgatttgacaaaggaaaaaccaaatgatgctgatgtttttcgtttgcttggagaagttaagtatgaactcaaagattatgaagggagtgttgctgcatataaaagctcagcaagggtgtccaaagatatccaatttgaagttctgcgtggcctttccaattcattacttgctgccaaaaagccagaggaggctgttcaattacttttggcctatcgtgagcatctgagttctgatagcaacccaacagactcacagaagttggatccagttcaagttgaattacttctagggaaagcctactcagattggggccatgtcagggatgctgtagctgtttatgatcagctcatatctactcaccctaatgattttcgtggatacttagctaagggaatcatcctaaaagaaaacaaaaatattggtgatgcagaaaggatgttcatacaagctaggttctttgcaccagataaagccaaagcccttgtggaccgttattcaagatga

SEQ ID NO: 20339 - DNA, 2913 bp, Glycine max
  Peptide Sequence Number=SeqID_112024
atggagagtcttgaagcagccagaaagtgcttgacaactagtttggaaacatcaagtgccatttcctctgcactagatgaatctggatcaaggttggagctacttaaccagagatatctgtccttacaagcttcccttagacccatctcaaagcagaagtgctcatttgtcaacattgaccacggtatagacagtgttctatgttctgctgctgcactcctcaaagtttctgactctgttcatcagttggagcattctctcttaacagacccctcttctgatctttacacctatgtgtcagacacaaagaagcttgaggaagcactgaagcttctcactgataattgcaggttaacagttggctggttgaaggacgtttttgagttcttacaggacaaaccaatcaccaatgagctttacctgttgaatgtgaagaaatctttgagaatattgcaagaattgcaggtcaaggaggaaagtgctcgccttgatggaggccttcttagcactgctttcgacaaactagaacttgagttccagaggcttctcatagcaaactccatgcctcttcctttggtttcattgacatcacacattggccagcaagccagtattgccagacaagctttgccattgacaagttctttagcagggaagttgcatgccatcactgagagattacatgctaatggcaggctagacaagtgtcaatctatctatgttgaagttcgaggtatgaatgctcgtcgaagcttgaatactttagatttgagttaccttgagattccaacagctgaatttgaggctgtacagtgtatggagagctacatagaccaatggggctgccatttggagttggttgtgaagcaactgctcgagactgagtgcaggctctcggctattgtctttgagaaaatcggtccagaagcatggatggggtgttttgcaaagattgccatggaatcaggaattctttcttttattcgatttggaaagattatcaccgataggaaaaatgatcccctcaagttgttgaacctgctgtccatattcaaggtcttaaatggtctgaggctaaaattcaaccagcttttcagtgtgaaagcttgtaaagaaattagaactgtgactgaggatcttataaaaaaagtagtcaatggcaccagtgagatattctggcaacttccagcgcaagtgaagttgcaaagaccaacttctcctccccctgatggcagcattcccaagctggtaagctttgtaactgattactgcaatcagctgcttggggatgactataggccacatttgacacaggttttgggaatacatcttagctggagaaaggaagcgtacgaagagggtattgttttatgccaaatatataatgcaattaaggaggttgcagtaaatttggatacttggtcaaaggcctatgaagatatcacattgtcctacctttttatgatgaataatcactgtcatttctgcaatttgaggggtactgtgcttggaaatatgatgggagattcttggttaagagcacacgagcaatataaggactattatgcagcactttatttgaggaccagctggggaaagcttctatctattcttgtagttccaagggacatactttcaccctccagtgcaagtgtgacaagccaagacttggcaaagagactaaatgctttcaatctagcttttgatgaaaggtacaagaagcaatctaattgggtaatatccgatgagatcttgagggaaaatgtatgcaagcatttggtggaaggtattataccaatttacagggcctatgtcaagaattattgtttgtcaatagaaaatgatgctaaggttgacaagcatatgaaatatagggcgcagagtttggagaacaagattaggtctatgtttcagccgaagcagaggaaggctagtagcattaaacaggcagacttgattagtaaaataaaacaaacgagacgcagcgttttgactctgttatcaagtgatggcgatgatggcggcgacgacactcacactgacaccaccgagatggtcgtggcgtccaactcgtcgttccttttgccggcaaatgcatccagggctgagagaaatggtgggagcaatgaattgaatgtttctgcctgggatgataagccctttgaaatgcttccgagcggtaacaaggcttacttggatgagcaggatgtggtgacgtttcttgatcctcctaaggacttaatccctttcgacccatcttcctataatcccgctgcatacctatggaaaaaaattgaagatattcctcaggaaaggcgacatcgacttctccgattgttgaaacctagacttgtatcaattgcttggcagattgctggtacacgattcgatgatcccaagttagtaaagaaaagtgcatctaccttgctgtctagctccaccaacgatggtatcatgcttgaatgttataactgcacatcaagtggaggtggatcagttttgactgcatttgctgactcctttgctcccttgtactttacggtgagagaacttaaggaagtgatgtcaactgagcagccatgtgatttagcatatgaatttggggatggactacatgatatcaaagagctcccattaggctttccaagaccagttaaacatccttatcctttcaacgatcaaattgttgtgtatgttcgctatctaggacctggggtttcagtagggcaagcatggcaagaggggacaaagttggagcaagtcccacgattgtcggtggaaagtgagtgcatttcagtcataatgggatacttggagttagagggagagggacactgcttttggcaatacgggccaagcgcggtgtcagctttaaagaagggtcccaagattgcacgattatggcagcattag

SEQ ID NO: 20340 - DNA, 1023 bp, Glycine max
  Peptide Sequence Number=SeqID_112025
atggctggcaccggcatccacccataccaccagcaatgggctccggcggctgccgctcctcctcctcctccggcagccgcgggcggtcctcctcctcaccctggggaggaggttcgaacgatattcataactggtcttccggaagacgtgaaagagagagagctgcagaatctgctgagatggctgcccggtttcgaagcatctcaactgaatttcaaagctgagaagccaatgggttttgctctcttctccgcaccacaccaagcactcgccgccaaagacattcttcaggacatgctcttcgatccagacaccaagtccgtcctccacactgagatggcaaagaaaaatctattcgtcaaaagaggaatcggagctgctgatgcgggcggtgcttttgatcaaagtaagcgcttaaggacagccggagattatacacacagtggctatacaagtccatctccttttcatcctcccccgcctcccgtgtggggaccacatggatacatggctccgcctcctcctcctcctccatatgatccatatgctggctatcccgttgcgcctgtaccaatgcccactcctgctcccataccagcacctagcacttatgttcctgttcagaacacaaaagataaccctccttgcaacaccctgtttattgggaacttgggagagaacataaacgaggaagaagtcaggggccttttcagtgtacaacctggttttaagcaaatgaagattttaagacaggagaggcatacagtttgcttcatcgagtttgaagatgtgaatagtgctacgaatgtgcaccataatctgcagggtgctgttatcccaagttctgagttatttaaaggaaatcccgggagttatatgttgtctgatttatacaggatttcaaaacatgacaaagcttcctttcataatgggagatccattactgctgctgccatatcattgcaggttggaacttctgtcgattatcaagtgaagcagcctttcaattatatgatgccctga

SEQ ID NO: 20341 - DNA, 2127 bp, Glycine max
  Peptide Sequence Number=SeqID_112026
atggcaagtatctcagaggacactggagaagagactccgttacaggtacgtttgaatggagtagcaacttttattggtgtagttgggcttactgtagctgttttagtgcttgctgtcctcttgggcagatacttttccggccataccaaagatatagatggaaatgttgaatttgttgctggaaagactagtgttagcaatgcagtagatgatgtcatcaaaatttttaccatcgcagtcacaattgtggtcgtggcagtccctgaaggtctacctttggctgttaccttaaccttggcatactcaatgcggaaaatgatggcagacaaggccttgatgactgtagttgaggcatatgttgggagcacgaaagtatattcaccagatgactcatcaaagttgcatccaaaagcattgtctctgataaatgagggcattgcacagaatacaaccggaaatgtttttgtacctaaggatggtggagaaacagaggtgtctggatctcctacagagaaggcaattcttaaatgggcagtaaagttgggtatggattttgatgttataagatcaaattcaacagttctccatgtcttccccttcaattctgagaaaaagagaggtggtgttgctttgaagctgggggattctggagtacatatacattggaagggagctgcagagatagttctaggaacatgtactcaatatcttgattcagatggtcaattgcaatccattgaagaagagaagggttttttcaaggatgctattgatgacatggctgctcgcagcttgcgttgtgtagccattgcatacagatcctatgaattagacaaagttccatctagtgagcaggatttagaccaatggtccttaccagaacatgagcttgttttgcttgctattgttggaataaaggatccttgtcgccctggtgtcaaagatgctgtaaaagtatgcactgatgctggtgttaaggtacgcatggttactggagacaaccttcaaacagcaaaggcaatagctttggagtgtggcatactggcttcaattgaagatgctgttgagccaaatataattgaaggaaagaaattccgtgaactatctgaaaaggaaagagaagatattgccaagaaaataactgtgatggggaggtcttctcctaatgacaagcttttgcttgtgcaagctctacgtaaaggaggggaagttgttgcggtcacaggagacggcaccaatgatgctcctgccctacatgagcaacagattgttgcaattaacatagagatacctacggctgatattggtctttctatgggcatccaaggaactgaagttgcaaaagaaagctcagatattataatcctagacgataactttgcatcagtggtaaaggttgtccgatggggccgctctgtatatgcaaatattcagaaatttatccagtttcagctcacggttaatgttgctgctcttgtaataaatgttgtggcagcaataacttctggtgatgttcctttaaatgcagtgcagcttttgtgggtcaaccttatcatggatacacttggggcgcttgcactggctactgaaccgccaacagaccgcctaatgcacagatcaccagttggccgaagagaatctcttataacaaatatcatgtggagaaacttgatcgtacaggctgtctatcaaatcgcagttcttctcgttcttaacttttgtggtgaaagtattctaccaaaacaagataccaaagctgatgcctttcaagtgaagaatactttaatattcaacgcgttcgtcctgtgccaaatattcaatgaattcaatgctcggaaacccgatgaaatgaatgttttccgtggagtgacgaataacaaacttttcatgggaattgttggagtgacctttatacttcagataatcatcatcgagttccttggaaagttcacctcaacagtgagacttgattggaagctatggcttgcttctcttggtattggccttgtcagctggccccttgctatagtcggcaaattcattccagttcccaaaacaccattggctcgttacttcttgaaaccactcaggcgattgaagaggtctaggtctcgtgctacgcaatag

SEQ ID NO: 20342 - DNA, 204 bp, Glycine max
  Peptide Sequence Number=SeqID_112027
atggataagatcttgaaggtaggaaaagatgagtggagggagagggagagacggggacacggaatttatgcctcaaatgaggtgatgcaatcctaccccgcaagggcattggctagaagactccaagtagattgggccagagatccaagggaaggccctagggttctcatgagccttagggtagatttcgagcccatgggctaa

SEQ ID NO: 20343 - DNA, 339 bp, Glycine max
  Peptide Sequence Number=SeqID_112028
atgttaccaacattcaacacaagacatgtgaggaaatacatggagaaaaatgaagaaacaacaatggaggagaaggtaatgctgaaaattaatggaggtttaaggagcacttacttgaagctcttgtgctctgattaccacttgatggaagcttgcttgagaagcttctatagagtggaaaataaaggagaagaggtgagaggaggcgccatccacttgggaataagccatggaaggaggagcttcaccaccaagagagtgccttggataagaagcttaaagagaaaacttcaatggaggaaaagaatgagagagagagagagagggcagaaggcatga

SEQ ID NO: 20344 - DNA, 324 bp, Glycine max
  Peptide Sequence Number=SeqID_112029
atgggggaggaggttgccgcccagctcgcccaggctacctgggttgcttcctccttaagtaacccaccttccaaaatgttctggaaggactttacggattacgtaacgacacctattttctttccggaatgttgcgaaaccttacggattacgcaacaatgctcgttttcctcccggaatgttgtgaaactttacggattacgcaacgatgcttgtttcgagggttccaaagggagcaaacaaggttcaaggaccgatcacaagtactcccggacgaaattagggtatgacaacccaaaacaagttgctatccaagccacttga

SEQ ID NO: 20345 - DNA, 231 bp, Glycine max
  Peptide Sequence Number=SeqID_112030
atgggagctggccatgcccgaagtcgttaccttaaccgcaaggagggggatgccgaaggcagggctagtgactggagtgaagtcgtaacaagccacatggatagtttaatgtgctcatcggcgcctgaccctgagatgtggatcatccaaggcacattagcatggcgtacttctcctgttgaaccggggttgaaaccaaactatcctcaggaggatagatgggcgattcag

SEQ ID NO: 20346 - DNA, 287 bp, Glycine max
  Peptide Sequence Number=SeqID_112031
atggccctgaatttgccttgcaaaatttctatggttcccaaggctgttcatataatatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 20347 - DNA, 354 bp, Glycine max
  Peptide Sequence Number=SeqID_112032
tggctctgtttctatcagctgtccctcctgtcagctactgacggggtggtgcgtaacggcaaaagcaccgcctggacatcagcgctggcaagtgtagcggctgcgcaactgttgggaagggcgatcggtgcgggcctcttcgctattacgccagctggcgaaagggggatgtgctgcaaggcgattaagttgggtaacgccagtgttttcccacggagtgtatactgggcttactatgttggcactgatgagggtgtcagtgaagtgcttcattgtggcaggagaaaaaaggctgcaccggtgcgtcagcagaataatgtgatacaggatatattccgcttcctcgctcactga

SEQ ID NO: 20348 - DNA, 498 bp, Glycine max
  Peptide Sequence Number=SeqID_112033
atgatctcttggggtggtcgacaaaagcggggctttgctcctacgtatcctcaattgcgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgggaccgctacacttgccagcgctgatgtccggcgggtgcttttgccgttacgcaccaccccgtcagtagctgaacaggagggacagctgatagaaacagaagccactggagcacctcaaaaacaccatcatacactaaatcagtaa

SEQ ID NO: 20349 - DNA, 336 bp, Glycine max
  Peptide Sequence Number=SeqID_112034
atggctaccgtagatattactggctcgaacagcaatgacctcaacaaaccttttaggtttgaagggtatcctttcaaatgttggcaacaaaagatgatgttttctttaactatgaggaaagttgcctatgttttgaacactaatattccaatggtacttgaggatgctgagaaggaagtgaaggataaaatgattatggaattagctctttggaatgaaaatgattacctatgcaagaatttcattttgaatgagttagctgatgatctctatgattattatagcccatataagtttgccaaaattagtttggctggctctggaaaagaaatatga

SEQ ID NO: 20350 - DNA, 441 bp, Glycine max
  Peptide Sequence Number=SeqID_112035
atggctttctctgataggggctcgcttcttcaagctccgcccaacctatacaaggtgctgctcgctgccaccagtggcttatgtagtggtcggcattcctacgtgctcctctttgccccctacttaagaatccaaagaaaagaaagtaggtttcggggggtgggttcattgattagtacacctccggtgctgataaggtcgggaccgtggtcgtccgtctccggtttgccggccgataagatctctgagattgaccagccagctgggttgtcgtaccggcatggccccactgatttgttttcgatcggagcatcaagcagcgcaacccggttctacttgactaagccccgtgctcgtccaaggagggagtttgctttacccaactccctttttgataacaaggcagaaacccccgacccgacattcattagtttcgaatga

SEQ ID NO: 20351 - DNA, 207 bp, Glycine max
  Peptide Sequence Number=SeqID_112036
atggtaacagtgtttggcatgtcagagattggaccatgggcattgactgatcctgcagtgcaaagtagtgatgtggatcaagcttatcgataccgtcgacctcgagggggggcccgctgcattaatgaatcggccaacgcgcggggagaggcggtttgcgtattgggcgctagcggagtgtatactggcttactatgttggcactga

SEQ ID NO: 20352 - DNA, 135 bp, Glycine max
  Peptide Sequence Number=SeqID_112037
atgggtgaccaagaggaggtacaggaacagatgagagtcgacatgtcggctttgaaagagctaatggcttccatgatggatgccatgctaggaatgaggcaactaatggagaaaaacgcggccaccgctgccgca

SEQ ID NO: 20353 - DNA, 370 bp, Glycine max
  Peptide Sequence Number=SeqID_112038
ggctcccggtatcaacagggacaccaggatttatttattctgcgaagtggatcttccgtcaccaggtatttattcggcgcaaagtgcgtcgggtgatgctgcccaacttactgatttagtgtatgatggtgtttttgaggtgctccagtggcttctgtttctatcagctgtcccctcctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 20354 - DNA, 771 bp, Glycine max
  Peptide Sequence Number=SeqID_112039
atgggtgactcagacaagtgcgggttgtacatcgaagcaaatcctccccgcctggttgccttaggaagagtttatgagggatcaacaattcacaacattcctttgttgcctggccaagtgaaggttggtgttgaggaggttaaagatgcacaggctcccgttcctgtacccactgatgaggttaccttagtggggcaggcacttaacaccttccttgcttggccgacacatctcgtgaagcctttatcagaacatgttaactgggatgctaccatgttcgaggtgtttaatccaaacttcctgttgtacataaagcatgaagatctctctgaaatcgcacacggtagtcaatgtctcagcatatttgtcatacagttgtggattgtgcatttgactaaaacaactatgcgagcggggaattccgatgtgtatggattactggatgcacagtctattcagagatctgggcaattgcagtttgactccgaaaagttacatcaagagttggatgcagagttcaaaacgcgatgtctaccttggagcctactgaatggcggacacaggaaaatggtctttattctgcctaaggaaaaccttgttgtctggttttgttccttgcataacaggtcagacaactaccttaagggaataattaacagtgctttgaaaggacttgatgatactccacaatctaaatccaaggctggtgctaggtggatcgttgttaagtattttaacgatgttaaaccattggaagcaaagagattgaag

SEQ ID NO: 20355 - DNA, 897 bp, Glycine max
  Peptide Sequence Number=SeqID_112040
atgacggaagacaccatctatgctgtcagccgccgtgacgatctggtggcgattgcgatggagccacgttccaacgtcgcagagcagaggcgcctgtcgccactcgcggagctcgagatcgccgttcgcaaacgggaattcatcgttcattaccagccgatcgtggaattgaagacgggcatctgcgtgggggcggaagcactggtgcgatggaggcggccggacggtacgcttgtccgccccgacctgtttatccccctggcggaagaaagcggcctgatcatgccgatcaccgatcaggtcatcgacgccgtcatcgccgatcttcgcaaggtgcttgtcgaggaccgaaccctgcacatcgccattaatctctgcgcggacgatatcaagtctggccgtgttctcgcggtcatcgccagcaagcttcagcatacagacatccggcctgagcagatctggcttgaggccaccgagcgtggcttcatcgacatcaacgcggcaaaggtcacccttgccgaggcgcgccagcgcggccattcggtggcgatcgacgatttcggaaccggctactccagccttcaatatttgcagggccttcccctggacgcgttgaagatagacaaatcctttgtcgacacggtgggcaaagataccgcaacgagttcggtcacatcacacatcatcggcatggcgaaagcgctgggcctgttcaccgtggcagaaggtatcgaggcggaagaccagcgggactatctggaaggtcagggtgtggacttcggtcaaggatggctgtttgcgaaagcgcttcccgccagcgaattccttgcctaccaccgtcacacgaagcagaaatacggcgcctctcccgaaatcatcaaggcggcgggcaaatag

SEQ ID NO: 20356 - DNA, 450 bp, Glycine max
  Peptide Sequence Number=SeqID_112041
atgaaaagatggtgggctatgcaccctcaaagctttgcggatttggtcttcgccagtgaaaggatcgatgtgggtccgaaaagaggcaaatttgatcatcctactaggacgactgagaaaactggggcaaataaagagggtgaggatgagggagaaacccatgctgtgactgccattcctatacggccaagtttcccaccaacccaacaatgtctttactcagctaataacaaacctcctccttacccaccacccagttatccacaaaggccatccctaaatcaaccacaaagcctatctaccgcacttccaatgacgaagaccacctttagcacaaaccaaaaaacaccaacaaaaaggaattttgcagcgagaaagccggtagaattcaccccaattccagtgccctatgctgacttgctcccatatctacttgatattcaatggtaa

SEQ ID NO: 20357 - DNA, 144 bp, Glycine max
  Peptide Sequence Number=SeqID_112042
atgagagtcggtcttttaccggtcttgcttccagttattctctcaaataaacgttggtggcgactccacgcgtattcctttcgtggaacacatcctgcgagtcacgcatcgccctccaacgccgaaggtggtgaagtcccttaa

SEQ ID NO: 20358 - DNA, 394 bp, Glycine max
  Peptide Sequence Number=SeqID_112043
aaacaacggcggcataactagcctgataaatacccaaggaaatcgtgggaagtatggtttaggctataagcccactcaggcggacgtgaaaagaagcatcgcgggaaggaagaacagtggtcaaagttcgcgttggagacaagaaggtgaaggaagcccgccctgccacataagtagaagctttataagcgcgggtttgggagacaaaggtcaagcatccgatgacgagtcccccgaaggtactaatacctgggacccgcctatcgacttcgagcaagaaatgaatcaaacggaagatgaaggaaatgaggatgtgggacttcccccagaactagaaagaatggtcgcccatgaggaccaagaaatggggcttcatcaagaagaaacagagcta

SEQ ID NO: 20359 - DNA, 219 bp, Glycine max
  Peptide Sequence Number=SeqID_112044
aataaggtttggaaaccagagaactttgaaagcttttggcaaaggaacaagaagaaagatgagaagcaaatgtttcaagatttctcaaaggttgttaaagaagttgaaactggtaatcgattaccagagagtaaaaactctgcttgcttctacacgtgcgctaagccaagctttcctgagctaagcgcatttcgtcgcggcatccatcgagttaagtga

SEQ ID NO: 20360 - DNA, 1005 bp, Glycine max
  Peptide Sequence Number=SeqID_112045
agaggatcccggactacacgtctcaccttgagagggctacacgctctcgtattcagagggctacacgccgtcaccttcagagtgctgcacgccgtcaccttcagaggactacacgtcttcgccttcagaggcctgcacgtcctcgccttcaaagggctgcacgccctgcccatcagagggctgcatgccctcaccttccgagaattacacgtcctcgccttcagaggactacacctcctcgcctttagaggactgcacattcttaccttcagaggacctcacgtcctcactatcagaggattgcatgtcctcgcctttagaggactgcacgttcttgccttcagaggactacacgtcctcactatcagaggattgcatgtcctcgcctttagagggctacacgtcctcaccttcagagggttgcacgccctcgccttcagaagagggctgcacgccctcaccttgagaggactacacgtcctcgccatcagagggctgcacgccctcaccttcagaggactagacgtccccaccttcagaggactaaacttcctcgccttcagagggctgcactcactcagctttagaggattacacgttctcgccttccgagggctgcacgccctcaccttcagaggagtacacgtcctcgccttcagaggagtacacgccctcaccttcagaggactacacgtcctcgccttcagaggactacacgttctcgccttcagaggactagatgtcctcatctttagaggactacacgtcctcgtttttatagggctacaagccctcgccttcagagggctacacctcctcgccttgagagggctacacacccttgccgtgagagggctacacgccctcacctttagaagactgcttgccctcaccttcagaggacttcacgtcctcgccttcagaggactgcacgccctcacctttagaggactacacgtcctcgccttcagaggggtgcacgccctcaccttcagaggacttcat

SEQ ID NO: 20361 - DNA, 189 bp, Glycine max
  Peptide Sequence Number=SeqID_112046
atgacgtctgaggtagcaaaggaaattgcttacaagattgatgtattaaatgcttccattggacaaccagaacaccctgatcatgtgcgtgctacgggagccaatgtcacaatcaaaaatacattggaccgactccaaggtcttcccacacttctttgtccatggctctcgaagaactggagcaactga

SEQ ID NO: 20362 - DNA, 363 bp, Glycine max
  Peptide Sequence Number=SeqID_112047
atggagcagtatttacggcatttggttcgccagcaggcggccaaccaccgagcacatgtacagacccatgattgtctgtaccagatgagcctcagcatgcagagccagggcttcgcttctttttcatgccctactctagaccagttcagggcagaggtcgcatgtcccggagattggcccgaggcccaagcaggagaggcacccccagaagctcccggcggtggagaagaggcccacgaggacgaggagatggtcgatttgcttgacttcttaggagggagtggagatacgtcactgggagatccccagattcatggtgaatgctgtaaaatttccccggacgcccgaaatggactaggatga

SEQ ID NO: 20363 - DNA, 384 bp, Glycine max
  Peptide Sequence Number=SeqID_112048
atgtggaccaccacaggggaggagcttgccacccagctcgcccaggcgagcaaggttgcttcctccagaagcaacagctttctggaggaaggatctggaaggcccaagtggggcagattgctatttgtacccccttttttactaaatgcaccccccttctatttttttgttttcgaagaagttacggaaactcacggattacgcaaaaacaccttttttcgatttccgccacatcacggaatttcacggattgcgctagcctgcttccttttgatttctgacacgtctcgggacttcatttattgtgcaacaaaggacgccaagtatctcaagcggctaaccaaaggttgcatgtcaacaagtaataatccctggacgaattag

SEQ ID NO: 20364 - DNA, 777 bp, Glycine max
  Peptide Sequence Number=SeqID_112049
gaacgacccgatctgaagttggtctcccatgatagaaaagtagataaaattgggagaccagcgcctgagatcgaagggttgattgctggcaccagattgagtccactgatcaggtgttttgttatcaccactaatcctggactcatattcgccttcgtcgagaggtggcatcgcgagactagcacgttccacctgccaataggcgagttggcaatcacgttggatgacgtggtgtcacttctacaccttcccatcactggcgcgctgcatacgttcaagtcgcttgttacttcagacgcgattggtctactgacggagcttcttgaggttagtcatgaggaggctacatttgagacccgacaggctggtgggcctcatgtacggttggggtggcttcgggacttgtatcaaagccagtgcagggctagacgatgggttgtagcagcccgcacgtatctgctccacttggtgggttgtactcttttcgccaacaagagttcaacccattgctggatatacgagcactttcctacagtgcatacatccgtcgttcatgatgcttatgataaggggagcccacaggcatgcaaatggcttacgggtaaggctcatatgacggggatcaagggagacccgtatcagagacgtttggatgccctgactgtgactgacatgtgctggatgccctatggtgagcaccggggagtcaagggctttgacttgatatcgtcgtacaccggccagctcagatggggtcagattgtggtgtacgtttga

SEQ ID NO: 20365 - DNA, 704 bp, Glycine max
  Peptide Sequence Number=SeqID_112050
ttggcccagagcttcccggtatcaacagggacaccaggatttatttattctgcgaagtgatcttccgtcacaggtatttattcggcgcaaagtgcgtcggctgtccctcctgttcagctactgacggggtggtgcgtaacggcaaaagcacccgccggacatcagcgctggcaagtgtagcggctgcgcaactgttgggaagggcgatcggtgcgggcctcttcgctattacgccagctggcgaaagggggatgtgctgcaaggcgattaagttggaagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatgggcttacgaacgggggcggagatttcctggaagatgccaggagatacttaacagggaa

SEQ ID NO: 20366 - DNA, 426 bp, Glycine max
  Peptide Sequence Number=SeqID_112051
atggctgcaagtgacattgctattcttagagatagagcccacataccaacaaagaaaagtcttctggaacttacatcgcaatcggcgttgctggcacagaacaagttgttgtccaaacaattggaagcattgatcgaaacactaaggtgtcccatctgtggtggagctcacaattctagctgctgtatccccaatgaagaaccaactcatgaagtcaattatatggggaaccaaccaagacaaaatttcaatgaagagtgtaaagttgtaatgaaaaggagcagaatggaaattaaggctgatgaaggtagagctgaagagaaggtggagggatataaacaacagtcgacaactaagctgacacttgaaccaatttctgattttgttgaacttgaggaagttgtggaagatgaagatgaccaatag

SEQ ID NO: 20367 - DNA, 333 bp, Glycine max
  Peptide Sequence Number=SeqID_112052
cgagcattcactaagtgcaacattcaatggctaagcgcgaggaagaatccagaagaagatgagctgtcaagttcgctaagcgcaccgcttgatgtaagctccattggagcttgtaggcctaggatcttcttcatcaatggattcctttgcttcttggaagatgaatggcagcggaatgaagaaaggaagagagagaggagacggcacttcaaggagaagatgagtctagaagaagctcaccaccataggaggccatggataagagcttggaggaagaaggagatgaatgaagggagaggaagagaagagcacgaaattttgtgctctaaatga

SEQ ID NO: 20368 - DNA, 287 bp, Glycine max
  Peptide Sequence Number=SeqID_112053
gtctctttgtatgtgttgtctggaaagaggaggactcaatgattattcgttcaccggaaccagaagtgaaaattttggtagatagagatcccataaaaacttctttcgaggaatgggcaaaaccaggtcatttctcaagaacaatagctaagggacctgatactactacttggatctggaacctacatgctgacgctcatgattttgatagccatactaatgatttagaggagatttccccgaaaacatggttaagtgatcctactcacattaggcctagtgctcag

SEQ ID NO: 20369 - DNA, 696 bp, Glycine max
  Peptide Sequence Number=SeqID_112054
atggaagggttagtggacctagcagtgattgacgctttcctcgcctttcatcatggcgaggaaagcccggtcgtcgccattttggccatgtatgacacgttctaccggggatgtgaaaagagcggcgcaagaattgtttgttgtgcattgcctctctatgtgtggctggtttcacacccttttctccaagaaggtaggcccgtctatccgctacaaggtcaccgcttgtgcgtcgaaaaaggaaaggcgaattgggaccaactcttggctagcatggaggggcgtctgttaattggttccctcgctagaaggaaggaaggatcaggattctatcttcatgcgaaagatgagtgccatcagacgaaagcatcacgcctttcatcgcacggggttttagtgaccacaaacgtgagggacagagagcttaggggaagcagtaatgggatcatcggcggctatcataagtggctgagagtccaaacacaaggattggattggctcccaaatctaaagactgtgagagacgatgaggttaaagcttcggaagaaagtgatgaggtacaagccctaaaggcagagcttgaaagagcccgggtagtcgaagagaagttcaaggcagcaatagtgagctcaagctccgaagaggtgaaaggaatcatcacgggtcaaaggcatgatcttgaaggacgagctaag

SEQ ID NO: 20370 - DNA, 285 bp, Glycine max
  Peptide Sequence Number=SeqID_112055
atggctgcatgccctcaccttcagaggactacacgtcctcaccatcagagggctgcacgccctcacctccagaggactacatgtcctcgccttgagagggctacacgccctcaccttgggtactacttaccctcaccgttgagaggactacacgtcctcgccttgagaggactacacgtcctcaccatcagagggctgcacgccctcacctctagaggactacatgtcctcgcattgagagggctacacgccctcacattgggtactagttaccctcaccgttga

SEQ ID NO: 20371 - DNA, 339 bp, Glycine max
  Peptide Sequence Number=SeqID_112056
atgcatgctttgttaggatcattcaatagtggaaactggtctgactctaaagtccttgatagtgctgggctgagttgtcatggtttcacgaggaattggggtgcgataatattgtatatgcatagatctcccacaggcaatttagttcctttggacttagaaattgaagctacgttgcgaaggaacagggccgagaggaaaaggaaatttttggaagacagaacagttgcatccattcttgaggaggagactcatttttctgacttattatcacctgattcaccatcatcaagggaatctgcactcaattacctgaagccattacatgcgagagcatga

SEQ ID NO: 20372 - DNA, 330 bp, Glycine max
  Peptide Sequence Number=SeqID_112057
atggaaaaccatagatttataagcaagtctgattcaacaaaagccaggagcaacagaaagcatattagacaacaaaaagtccaccttgatgttcagcatagtgtccatgcaagtctcaatccagcttcatcccacactgaagatgattataaccaaccaaagacaccacctcatagtgttcatgcaactgtcgatcgggctccacacgatgctgaagatcattttaatatctgcgattcatctaagaatgagacttctggattagcagaaggtaggattacaaatctccttcatttgcttattaatttcacttctaatcataatacctaa

SEQ ID NO: 20373 - DNA, 683 bp, Glycine max
  Peptide Sequence Number=SeqID_112058
gggaggagcttgccacccagctcgcccaggcgagcaaggttgcttcctctagaagcaacagccttctagaggaaggatctggaaggcccaagagtcaatggggtaggcacttatatcacattagcgttgaccctttgagggaagtggaaactaccttgcacatcaagacgtcatcattagagtacaagttatgggtagggggtatccttgatgccatctacgaaagggtgtcagtgaatggcatcattatggatgctcaacaatacaagtctggagtggattggatgttcctcatggtgattataggaggagagttgagtgtgactttcctgggtggagttggtggtggtggaggtgggtgttggattgtaagccatgctctgaggttcacgctctcccttcccttaattgtcacatgtccacctcatgttgttgcctcgaggcctccaaatcgacctccatttttctgtaattgttccatctattcaaattcccatattactgatgtctcagctcgtgtggagcatgcagacgaactgggattgcctttccttgctcctaccatcttgcgaccaaaggaaaaattttccttgactccacagtgggccccaaattttcctactgaattccggcaagctctaaacaagttgcctaattctcctcattctcagcagagtctctga

SEQ ID NO: 20374 - DNA, 366 bp, Glycine max
  Peptide Sequence Number=SeqID_112059
atgttggatgaatacaatgctcatgctaaaatttttaggatggttagagatagattggcaaatagtgatgtagataatgtcagattaagattgatagctactcgtgaaaaggatggtcgtacatacaatgttccaactgtttcaaaagttgctacacttattgtagacttcagtccagaccaaatgaagctcaaactttatcgcattctagaagactatttcaataattcattgctgaagcatataccatgggttgaatcggaaagacttaactacatcaggaacaaccaaaagaaactcagagttgacaagtattgtagcttacaaaattcactagatgctgggacaagccaagggtttaaataa

SEQ ID NO: 20375 - DNA, 292 bp, Glycine max
  Peptide Sequence Number=SeqID_112060
gggatggtgggtttatgtgcgcattgtggatgtggaaaacttgttgtgcaccatcgcccgaccgccacctagtaccacatatgatggggtgaaacttcctgcctttattgttgaccacagagtggtacctggagatatgtcgcgggggtcaggagaccttggggacgtcaggcgagctcctggcagtcaacagataaaaggaaaacaagaccacaaagcaaggaggcttgtgggggctaagatggtctctggtaatcgattaccaggggatgtaatcgattaccaggcttga

SEQ ID NO: 20376 - DNA, 699 bp, Glycine max
  Peptide Sequence Number=SeqID_112061
atgtcgttatcgcggcgaataagggaggcggtaatgcgtcccagtttcgccgccggaaacagctcactatcctgcgggcaggccagcgaaatattggcgcttacccggcttcagcgtgccctgatggatagattcggcaaaactgtccgccagctgctgctacgttacggtgatgtcgattacaccgggtccgaacaatctgttactggccacgtccggcgtcaattttggcttccgacgcacgctgccgatgctgtttggcatcctgctcggctgtgcgttacagatgctgctggcgagcgtggcgctggagctgctattgcactggatggcgtcggtgcggttgccgctgacggtggtgggatgcagctatttgctgtggctgtcgtggaaaatcttccgcgccggtgcgccgcagttgcgcgaacgtccgcgtccgatgaccctgctgggcggcgtgtgtttccaggcggtgaatcccaaagcctggctgatggtcaccaacgtggcgctgatgtacgccaacagcaacggtgtgctggcggtgctgctcggctttgccgccctcaacctgccgtgcattttaatctgggcagcgctaggcgatcggctgcgccatcacctgcagattgcgtggaaacgtcaggcgttcaatacgctaatggcgctgtcgctggtggcgaccaccggctggatgct

SEQ ID NO: 20377 - DNA, 743 bp, Glycine max
  Peptide Sequence Number=SeqID_112062
ttggaactcctacgtgccgatcaacgtctcattttcgccaaaagttggccagggcttccccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatccaagcattaagccagggtatcacatgaataaaaagcactggatttcagtgtatcccggcgaagaaatctccgaagcgttacttcgcgatctgatcaacgattcgtggaatctggtggttgatgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 20378 - DNA, 165 bp, Glycine max
  Peptide Sequence Number=SeqID_112063
acttatcaaggtaatccttgtggcgtctaccctgacttatcttccttcaccggaagtggcgtctaccctgtcttatcttccttcattggaagtggcgtctaccttgacttatcttccctctttggaagtggcgtcacccaaaccttcgtagcctgtatcaaatga

SEQ ID NO: 20379 - DNA, 384 bp, Glycine max
  Peptide Sequence Number=SeqID_112064
atgggatcaagtcaaaaccttcgtttaaaaagaggttctatcaagtcaaatcaagagcttagagtcactagtttacgaaagttggggcaattaatggtcaacttcaacggcaagccttccgcaaagcctatggacttccagctagtgccgattgtgaaagagtttgaagaaatcctgggatgcccactgggaggaaggaagccatatcttttctctgggttctatccctccacgacaagagttgccaaggtggtgaaaatctcagcacaagagttggaccgtgtaaagcaaaacaggaatggggtagtcggagtaccaaggaagtgtttggaggaaagggcaaaggccttggcaaatcaaggcgaatgggctttcttttattga

SEQ ID NO: 20380 - DNA, 273 bp, Glycine max
  Peptide Sequence Number=SeqID_112065
ctgggttgcttctggaggaagcaacccaggtcgcctgggcgagctgggcggcaacctcctcctcctttttcctataaaaaggctgaagggggctgttctaaggatcccggagccccctggctatgtatttcagctgttttgggtgaaaaaaattgtttccgtgaagaaaatccaagccgaggtgcttccgtaacgcttccgagatgtttccgtaagcaaatccgtgaaggttttcgtccgttcttcatccgttcttcgttcttcaacgggtaa

SEQ ID NO: 20381 - DNA, 384 bp, Glycine max
  Peptide Sequence Number=SeqID_112066
atgacccaagagctggtagcccgcggagataccttacggttatccgcacctcgtcattcagtgaccccaagtgtgattgatgagcagaggccaatgtggtcatctgcgccctttccggagatgtcagcatcttccggtggagactttctcaagtctcacaagttatctagaactacaggcggcgggcccgatgatacgcagagataccttacggttatctgcacccttgtgtcatccagaggcggcgggcccgatgatgcacggagataccttacggttatccgcacccttttgtcatacagaggcggcgggcccgatgacaagcagagacaaaatttggttattctgcacccttgtgtcatccagaggcggcgggcccgatga

SEQ ID NO: 20382 - DNA, 879 bp, Glycine max
  Peptide Sequence Number=SeqID_112067
atggactttcatagacatcggttccggggtgcggaacaccagcaacggtttgaggccatcaaaggcacggctaagttcaatcctgagatagtcatggagttttatgctaatccctggcctacagaaggagtcaaagacatgcactcttgggtgaggggccagtggattccttttgatgaagatgccatcaatcaatttctggggcatccgctagttttggaggaaggccaacgctgtgagttctcccagtggaggagtcaggcctccggctttgatgaggaggctatcagccagttgctatgcattccagggcaggactttgcctggaccgcagcggggagacgggtgagtgtccatgtcgcccagctgatctctgacgctatttaccagtttgcagggattacggctccaagacacccaatggacccggagaagtccaagagggccctggggttccctgctctcatcacaggcctctgtcagttctatggagtggcggtcacccccaccaagctcatccaacctcctattaacaaggctttcattgagaagtactgcgttcccaggcaggtgcaggatcaggcaccccagcaaccagaggaggaccagcagcagcctgttgcagatgcgccaccatcgcctctagaggaggtaccctttctcaggtccatctccaaccacttgcggaggatagaactccaaatgcacaggtatatgcagcacgtgactggtcagcaggcggctaatcatagaggacaggaccccagtcctttcccttggcctacccccgagaagttcgaggcaacgatggactggcttgaggacgagaccaattttgagacacgggcaggacctgcagaagctctaggggatgactag

SEQ ID NO: 20383 - DNA, 720 bp, Glycine max
  Peptide Sequence Number=SeqID_112068
atgcaagagttaggttggctcccgaagataaaggtttcaagtgaggaagaggctgaaacccctaaggagagcgaagaggtgcaagccttaaaggtggaacttgaaagggcacaagcggtcaagaaaaaattcaagacgacagccatcaaggcagtaaaaaccataactaaacacactttaagtcacccctatcgaacccgttctaagactagagtcatgggtgacgtagaagaggtgcaagaacagatgaaggctgatatgttggccttgaaggatcaaatggcttccatgatggaagccatgttgagcatgaagagaatgatggaaagcaacacggccacagttgccgccgccaactccgccgctgaggcagatcctacccatccatctaccacaaaccaagcacaccaacccatcccggacatggtggggcaaggaggagaggtgttgggcagcaccggttgtccacacatggggtataacaggaatgcttacccttacgacttaccccccaattatacgccgcctaccatgcacatgctcaacgagaacactaatcatgtcattcctgttgagggtcagcaaccccagcctatgggaggcacccgtgaagaacctcgggagcgtgctcaaggtgacttcgacccatatcccactttcaccaccaagggacccgtatataatgctatgcctcagcctgacaccaagggagctccttaa

SEQ ID NO: 20384 - DNA, 516 bp, Glycine max
  Peptide Sequence Number=SeqID_112069
atgaagcacttcactgacaccctcatcagtgccaacataggaacaaaagctggtaccgggccccccctcgaggtcgacggtatcgataagcttgatcagcaacttctctcagcttccaaccctctctcaagttgtctacaaggactagccagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcacgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcgggcttttgcggttacgcaccaccccgtcagtagctga

SEQ ID NO: 20385 - DNA, 156 bp, Glycine max
  Peptide Sequence Number=SeqID_112070
atgaagtcgctgagaggaaaagagatcgcgttggtgaaagtgcagtggggacccgacgagggtgattcaacctgggagttagaggataggttaatttcggggacgaaattccttaaagggtgggagtattgtgacatcctagaatttctaccctga

SEQ ID NO: 20386 - DNA, 466 bp, Glycine max
  Peptide Sequence Number=SeqID_112071
gtcgactctagaggatccccaaatcccagggctcaaccctggacaggcggtggaaactaccaagctggagtacgagacgaaagctaggggagcgaatgggattagataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggacaaaggatcgcgatcccgcgagggtgagctaactccaaaaccgtcctcagttcgattgtag

SEQ ID NO: 20387 - DNA, 1854 bp, Glycine max
  Peptide Sequence Number=SeqID_112072
atgctgcgctataccgatcgtgacgcggcgctggccgctatcgctgccgaccaggctgatatgctgtttagcaaagccgggaacactgtgcccgccaacgcccagctggacgcctcacagaatctgctgatcaaccgaccggtggtggtgacccagcgcgatcgcgccatgcagccggtgccttatgcagcgccagtcagactggcggtggaccagcactatctcagcgacagcgtaatccgggcgcaatttcctcaggcgcacatcatgcgttatgcctccagtcgcgtcgcgctgtcggcgctggcgaccggcgaggcggattacgtgctcgataatctgacctccgccagctttttaattgaacgcaactacctcaatcagctggcgctggccgacattctcgccccacgcgcgcaggatgccagtcggctactggtcagtcagcgcaggccggtactgctgcgtgcaataaatcgcgtcatcgcggcgatccccgcagagcagcatcgcgcgatctcacgccagtggacacagcgcccggacatctggcgtctgcagcagccgctggcgcttacggctgctgaacagcgctggctacagcagcacggcagcgtgcgcgtgggttttaatccgttttttgcgccactggcactgctggatgggcgtaaccagtttcagggcatcagtgccgaactgctgcaccaaatccacctgcgcaccggtatcaattttgtcgccgtgccggagtatcacgaagacacgctcctgatgcagcttcaacagcataaaatcgacatggtagccgcactctcctataacgcgcagtggccaggccgttttacccagccgtggctgcacacgccgtttgtgctgattactgccgctaacgcgggtgcacccgccgcgctgcactcgggcttacgtatcagcgtaatgaaaggcagcccggtcattggctggctgcagcaacactatcctgaagtacagctacagctggtggacaacgccagtctcggcatgcagcaagtggtggaaggcaaagccgatggcatggtgcataaccagctgggcgccgcttacctgatcaaacgctatttttccggacggatgcgtattgtccagcgcgtcggcacccagcccgctcacatcagtttcgccgtgcacgctggcgatcccgagctgctaagcatcatgaataaagccctgaatgaaatattacccagtgagatctcgcagctcaccagccgctggcagggtacgcccgaggtgacggccagcagctggccactgtatcgcgcgccattttatgcgctggcgggcgtggcagccgtcgtctccctcgcctgcctgctctgggtgtatcagcgcggccgggaaatccgccgccgccgccgggcgcagcggcaattgcagatcgcccgcgatcgtgccgatcgtgaaaatcaggccaaaagccgctgggttgctaccgtgagccatgagattcgcaatccggtcaacgcgatcatcggcctgctggcgctggaagcgcgtaaggccggtgccagcgaggcgctgctgactgcatggcaatcggcacaggcattaagcggcctggtgggcgatattctggatatggcgaagattgagcgcgggcagctgacgctggcaccgcagtggcatagcatcgcgaccctgtgccagccggtactgcagctctatcaggggctggcgcatgaaaaaaaccttacgcttagctatcacactacgctgcctgatcttgaagtctgggttgatgcgccgcgcctgcgtcaggtgatcgccaattacatcagcaacgccattaaattcacgccgcagtgcactggctga

SEQ ID NO: 20388 - DNA, 385 bp, Glycine max
  Peptide Sequence Number=SeqID_112073
atgttggtgcgcatgatccgcactcgtctctttgcaacggcacaggtgaaatcttgccccggtatgcatagtagctgtgtgatagcccccctctctggttgtgctcgcacagttggccctcctccaatatcagggggtggcccaggaaccgtgagggcgagccctgaaatgaggacacgtagccctctaaaggtaagggcgtgtagccctctcaaggcgaggacatgtagtcctctggaggtgagggcatgcagccctctgatggtgaggacgtgtagtcctctcaaggcgaggacgtgtagtcctctcaacggtgagggacgtgtagtcctctcaaggcgaggacgtgtagtcctctcaacggtgagggtaactagtacccaag

SEQ ID NO: 20389 - DNA, 72 bp, Glycine max
  Peptide Sequence Number=SeqID_112074
atggctcaacctccacctcgtgagaggactcttagggaaatggctacacctgacttcacatcattgttgcat

SEQ ID NO: 20390 - DNA, 291 bp, Glycine max
  Peptide Sequence Number=SeqID_112075
atggatggaggatgcatgaatggcaaatccaatttcatggggcttcgaataagattgatggtggaggatgcacgaacagcgctaggcaatcaattcgtgggggtccggactcgatggatgcacgaacagcgcaaggcaatcaattcgtcgggctccggactcgatggtggaggatgcatgaatggcaatcaattcatggggctccgaataagatttgatagtggaggatgcacgaaaagcgctaggcaatcaattcgtgggggtccggactcgatgatggaggatgcatga

SEQ ID NO: 20391 - DNA, 165 bp, Glycine max
  Peptide Sequence Number=SeqID_112076
atggctctgaggaagctttcctcgaagagatctaggaaggacgccgcggctgaagggactagtgccgctcccgagttcgatagccatcgtttcaggagcgctgaacaccaaggagggcgcacgggacctgcggtcatgggtaaggggccagtggattccttttga

SEQ ID NO: 20392 - DNA, 211 bp, Glycine max
  Peptide Sequence Number=SeqID_112077
ttggccagggcttcccggtatcaacagggacaccaggatttattttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 20393 - DNA, 501 bp, Glycine max
  Peptide Sequence Number=SeqID_112078
atggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatggccttgcaggtgaagacctgcacaaacatttgaaggaatttcatattgtctgctccaccatgaaacccccagatgtccaggaggatcacatatttctaaaggcttttcctcattctctggagggagtggcaaaggactggctgtattaccttgctccaagttgcccccaccatcagatttcggagcagcttcttcttcaactcctgagcgattatcctctccaactctgggggaagccctacatccttgtcctcttcattctccgtccgacttgcttcttgctcgaaatcgacggttgggtccccgatattagtacttttgcgggattcgtcgtcggatctgtatcgttttaa

SEQ ID NO: 20394 - DNA, 315 bp, Glycine max
  misc_feature (83)..(83): n is a, c, g, or t
  Peptide Sequence Number=SeqID_112079
atgaaaatacatgaaacacaatgtggaccaccacggcaaaataggggagaagcttgccgcccagctcgcccaggcgagcaagnttgcttcctccagaagcaacaaccttctggaggaatcttctggagggcccaagtgggcctgctttcgaagaagttacggaaacttacgaattgcgcaaaaacacctctttttgatttccgccacattacggaatttcacgaatcacgcaagcctgcttcctttcgatttctgagacgtctcgggacttcatttattgcacgtcatcaagtaataatccccggacgaaattag

SEQ ID NO: 20395 - DNA, 204 bp, Glycine max
  Peptide Sequence Number=SeqID_112080
atgagtacgaccgggcgtgggaggcactcggtcctccggattttcaagggccgccgggggcgcaccggacaccacgcgacgtgcggtgctcttccagccgctggaccctacctccggctgagccgtttccagggaattttaacccgattccctttcggagtacgcgcacagagcgctatcagacgggcttcccccgtcccttag

SEQ ID NO: 20396 - DNA, 120 bp, Glycine max
  Peptide Sequence Number=SeqID_112081
atggcacaacctccaccccgtgagaggactctaagggaaatggctgcaccagatttcacctacaaaagcttgtgcatccaataccctgatgaggaagtgaagacccgcacaaacatctaa

SEQ ID NO: 20397 - DNA, 174 bp, Glycine max
  Peptide Sequence Number=SeqID_112082
atggcctgcttggaccagcagcattctggaagggagggacaggctgttgttgctattgttgttgttgtggaggattttcccgtctcagatttggatgattcctccaacctgaattgtatctgttgcttgaaagatcataattattttgttgttgttggttttgctgttgagggg

SEQ ID NO: 20398 - DNA, 291 bp, Glycine max
  Peptide Sequence Number=SeqID_112083
atgcataaggcattacgggccaatgcacctcttccgtatcctcatcttgtcactatgtttcttcagcatttcaatgttcctttagaggatgaaccttttgtcaaggttataagatcatttgctattggtgctggtgctgttacctccttcagagaccgaaaggatatggatggccaatgggtgcgtaaacaagacctgccacctcccattcctgatgaacgcacaccctccccaccaccgcaacgagatacctcatcttccttattgaatgacattctcactgagctatag

SEQ ID NO: 20399 - DNA, 849 bp, Glycine max
  Peptide Sequence Number=SeqID_112084
atgcatagatctcccataggcaatttagttcctctggacttggagattgaagctatgttgagaaggaacagagccgagaggagaagaaaattactgcaagacatgacattagtgtcctttcttgaggaagaaactcatttttccgattcttcatcatccaactcaccatcatcaagggaatccttgacttatttaccagaagtattttccatggctaatgagcaccaacaaagacttacccttgaggactattcaagcagttcagtgccacaattctttaccagtattgcacgtcctgaagtgcaagctcacaacataaactaccctcattctttgattcatttaattagactcggtctattttcaatttctttggcaggcaaaacaaagaggtggctccagtcatttaagggtaacagcctgaaaacctgggaagaagttgttgaaaaatgggctaagaccacaaaccaagcaaatgttagatgcttcagcaaggggaaaaataaagctgaagcccctgaagaggcaactgagctaattaagaatatgtcagccagcgatcatgccattctgcatgatagagttcatcaacccacaaagaaaaacttgttagaactgtcatcacatgatgctttattgacacagaataagttgttttctaggcaacttgagattttaacagaaacacttggttgtatcatctgtggtgaggctcatgaaacaggccaatgtattcccattgaagaaaacactcaagaagttcactatatgggaaatcaacaaagacaaagatatactcaaggaggattttcaggcttccagcagggtccttataactatcaaggatag

SEQ ID NO: 20400 - DNA, 273 bp, Glycine max
  Peptide Sequence Number=SeqID_112085
atgccagctggtctacgccatcttgaaccagggatcatgcctccaagacacccaatggacccagaaaagtccaacaaagcactagggttttcggccttaatcacgggtctctgccagttctatggggtgccgattatgctcacaaagctcatccgacctcctattaactggctcaattttgaggcaggggtaggacccgcagggacccccggagatgaagatggagctcaggaagatgatggcatggacgatgtgatgatcttcttcctttga

SEQ ID NO: 20401 - DNA, 618 bp, Glycine max
  Peptide Sequence Number=SeqID_112086
atggagtgtcttctcttactccaacttagctcccacatcccacacctcagatttgaagatgtacaaagccagagcctaagcccggccattaactttgcctacattaagaaaaactattggaatgtggatgatctgatagttaactttagaggagcaaggaaggcaagggctcggccagctgatgttccttcttcttttactccaccagcttcttccacttctgctactcctacactagttcctccaggcccatctacccaggactttcagcattttgagtttatgcttcaatgtctttatcaaggacatccttctcttgtgagggaaggtggaggtcccagtgctcaagcacctcagcagctacatgatgcatcttcagaggcctccatccctgagccatttgtttttgagatttcactagatccaccctcgccagtggtggatcaatcttctcctcagcagctagcagaccctccttcaccagtgcatgagatgccagcaaacctttctactccattactggagattctagaggaccctgccacaccagtcctaggattgactaccactcctccaaaaactcttgtgctacattttacagatgaggaggacacttag

SEQ ID NO: 20402 - DNA, 264 bp, Glycine max
  Peptide Sequence Number=SeqID_112087
atgaaaagaggaagaagtcgagctacaagaaaaattcccgcggctaccatagtagcagcatgtataagggcggaaattggagtaggcccttccatagcatctgacaaatcaagcgaaaacatcataactatagttaacaataaaatactaggaaaagcccacatacggcgaagatatttggttgctgtcggaaaaagtagaagtcccactcctattaacataggaactggaaatggaataaaaggtatgatccatgaatattga

SEQ ID NO: 20403 - DNA, 408 bp, Glycine max
  Peptide Sequence Number=SeqID_112088
atgggtgccaaagcacctcacaaggaccaaagaaaagtcgcatgtcatcaaagcaaaggtccccggacgaaattagggtatgacacaagtgatggacagaaatcccccctacagctgcgttttggggagaccttggattcatgcgctaggagtggtcccttcgacgcttcaccaaaaattgaatttcgcggttggtggactcttggtgatagtgttaggcgaagaagatatgttggtgagctgcccctccttcgcgccatatgtagaagcagcggaggaatcattggaaacaactttccaatccttcaaagtggtgagttgtccctctgtggaaacgagtctattgccgccttgtctctccaatgcggccctgatggttgcacgggtgatgctcaggcacggttatga

SEQ ID NO: 20404 - DNA, 618 bp, Glycine max
  Peptide Sequence Number=SeqID_112089
atgaaaagagaaaaacatgcctcctatagtagtcataactcttgcaaaagcctaagtgaagaacttcgtgactgttatgaaggaaggcataggtcacatcttagacctcactcccataggagagaaaaggaaagaaagcctcaagaggctaacattaacctcccatacttccatgggaaggacaatgtagaggctaatttagattgggaaataagggtagagcaacaacttaaaaggaagtatacttcaaaatcttatggctcttactcttatctaaagaaagaccaaggtcaaggcatcttagggtgctttaaatgtcttggaagagggcacattacttctcaatgccccaccaagaaaaccatgattatgaggggccaagacatttatagtagccaagatgaggctactacttcaccttcctctagtgaaagtgaagaagcaaaaggggaagaatctagtaaagagatctacccccaagaagaaggacaacctttaatggttaaggagacacttgttagcattgccacacctcttaggcttgagtttattcctcaagtaaaggagttgttggatgagggtttggttcgcaagagcttaaatccttgtgctttgttg

SEQ ID NO: 20405 - DNA, 288 bp, Glycine max
  Peptide Sequence Number=SeqID_112090
atggacaacacttgtgagagctctgcttcctgctctagccctgtcataggtcctcgaagtccttcaagtggatccttgcccttgctctgtgcgcttagcgggatgacccttcgctcagcaaacatgcacagctcatccttcttccagattcttccttgcgctcaaccaaggagtgttgcgctcagcggttggctcgctaagccagaagattggcttagcaagaggatgaaaatcagcacttcacaaacttgcctaattaacctgaaattgagaggaaattattattaa

SEQ ID NO: 20406 - DNA, 216 bp, Glycine max
  Peptide Sequence Number=SeqID_112091
atgtgggtgcaagccattagtctgtttgctcaagcgacctgtgctcctgagtttggacttccaagatcgttcaatcagagattactcgtcttgcgcgttggtggggctgccgtaaaacaacaaattaacaatgcacatagggacaacccttcccttgtattcaagaatcccctacaacaagagacccacgttctcttaatcccttttcagaaataa

SEQ ID NO: 20407 - DNA, 146 bp, Glycine max
  Peptide Sequence Number=SeqID_112092
atgaagatgctcttgataccacatgatgtggctccatgtggagcttgtaggccttgtgtcgcaacgtgcccttcgcgggcgagcgagggcgaggctcacgggtgcgctttccaaaggaggaaagatgcggcggagtcgccaccaac

SEQ ID NO: 20408 - DNA, 270 bp, Glycine max
  Peptide Sequence Number=SeqID_112093
atgttgtggaagcttggcgggattgatggggatccggtgttgagaagaacgaggataagggctacgtgggagtacgtgagctcaattgaaggtgggcaactagggatggtggttttatgtgtgatttgtggatatggagagtcgacttgcaccatcgcccgaccgccacctagtaccacatatgacggagtggtacctggagatatgtcgcgggggtcaggagaccttggggacgtcaggtggggtgctattgcccaaaaccaagcttga

SEQ ID NO: 20409 - DNA, 722 bp, Glycine max
  Peptide Sequence Number=SeqID_112094
gaaacagctatgaccatgattacgccaagctcgaaattaacgggggggtaaagggaacaaaagctggtaccgggccccccctcgaggtcgacggtatcgataagcttgatggtgttgacaggccttctatgggagatgtcttgtggaatttggagtatgctctccaacttcaagaggcggttgttcaaggtgatcctgaagaaaatagtacaaacatgattggtgaactctctccacaggtcaacaatttcaaccatgaagtaagtgtttctgctgcacaatttgaagctacaagtctggatgatctgtctggtgtatcaatgagtagggtattctcacagctggtgaagtctgaagggagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 20410 - DNA, 318 bp, Glycine max
  Peptide Sequence Number=SeqID_112095
atggcatggaagaaaaagcataggcgtgatatggctaacctgactttgtttggcaagatgtctcatatagcgaaggctaacagttgttgcatgaacaccttaagctccttcaactgcacaagtgatgaggacatgaccaagagcaagggaaaggatccacttgaaggacttagaggacctatgacaagggctagagcaaggaaagccaaggaagctcttcaacaagtgttttccatactatttgaatacaagcccaagtttcaaggagaaaagtccaaggttgtgagttgtatcatggcccaaatggaggaggactaa

SEQ ID NO: 20411 - DNA, 345 bp, Glycine max
  Peptide Sequence Number=SeqID_112096
atggtggcccgagtgatgttggggaatagttacaagcccggaatgggtttaggcaaggacaacggtggcataactagcctgataagcgccagaggaaactgtgggaagtttgggttaggctataaacccacacaagcggacataaggaaaagtgttgcaggaaggaagagcggaggtcaaggctcgcgattgggacaagaagtcgaaggaagcccgccctgccacatcagtaggagctttataagcacgggtctaggacacgaaggcaagtcgttgcgatatgcgaagatgattcgccgagtgggttggatttggtacgaccatgccctcctggtttccgactag

SEQ ID NO: 20412 - DNA, 337 bp, Glycine max
  Peptide Sequence Number=SeqID_112097
gctttttggtttggacctttcccttctgctccctaaggatccttttaacctttatagcaaggccaaaagtttccaaagccttgtctttattagcaatagccttggccagtttcttctgcctcttttgctgaatgtttacaacactgaagtgttgttatctagtgatgaagctacccttgttgataatggactgctaggagtcatcatccattcctttgaagacatggaagacttagtattccaaaagaactttgttgatgaggtcggcatagtagatgtcatccactcctcccaaagtcttcatattcctcaagatgttgatttagattgtgtgtaa

SEQ ID NO: 20413 - DNA, 405 bp, Glycine max
  Peptide Sequence Number=SeqID_112098
atggatgccggatggctgactttccaagaggatcggcccaatgtgaggaccaacccgctcgccaatcatggagggggagcagttaatgcagttgaatccgataggccccacaggtccaaacctttaagagatgtggcaacccctaggaggtttatctttgaggccctacaaaagggaggtgtaattccccatagtgggtgtaaggaggattcctgtctgctacattccggcgagatgcatgacatggagacgtgtttggaagtagaggaattgttacagcggatgatagaccaaggtcgactagaagtcggcattaaaggaaaagaagagcagcatcatatgcatgcaatctacggaggggagcggtgttgcgaagcccaaacccttggtgatatacttcactaa

SEQ ID NO: 20414 - DNA, 187 bp, Glycine max
  Peptide Sequence Number=SeqID_112099
atggatattgaagaggatgttgaaatcccactgattttgggtcgtcccttcatgttaactgccaattgtgtgatggatgaagttgagaatgagatgggttctaatgggctaaagccaagattgctccagacccttgagggtaacatgcgtcaggctagtggatgtaaagaagtgcttaatggggagg

SEQ ID NO: 20415 - DNA, 309 bp, Glycine max
  Peptide Sequence Number=SeqID_112100
atggaaccttccctcttcggccttcaaagtctcattgaatatttgctactaccaccaagatctgcaccgacgaccgctccgcccgggctcgcgccctgggtttttgcagcgaccgccgcgccctcctactcatcggggcttggtccttgccccgacggccgggttagcgcgcagttgggcaccgtaacccagcttccggttcatcccgcatcgccagttctgcttaccaaaaatggcccacttggagctctcgattccatggcgcggctcaacagagcagccgcaccgtcctacctattcaaagtttga

SEQ ID NO: 20416 - DNA, 240 bp, Glycine max
  Peptide Sequence Number=SeqID_112101
atgttgacaatagctgagaagtccgtggatcttcttgggggcggaatttgggagccaatccagtccttgtgttcggactctcagccacttatgatagccgccgatgatcccattactgcttcccctaagctctctgtcctttcttcacgccgcatcccatgccttgcgaactccttggagtaccctcgcgttgtggtcactgaaacctcgtgcgatgaaaggcgtgatgctttcgtctga

SEQ ID NO: 20417 - DNA, 585 bp, Glycine max
  Peptide Sequence Number=SeqID_112102
tacttggaaggcaaggcaagggattatggcgaatcaagaggagtgggtcccgtttgtggacatattagcatgctaatctttggggttgtcctctttccaaacgtggacggtttggtggacctagccgcgattgatgctttctttgcatatcaccatagcaaagagagcccggtggtagctatcttgaaggacttatttgatgcatttgaccgaagttgcgaaaagagtagcgcacggatcatctgctgcttacctgctctttatgataggaggcagaataatcaactagttttctcgatggaaggaaggaaaggagggagttctcttctcgtgtggggactacctaaacatcccattgatagggacaaggttatcaacgaggagaacttcgaagctccggaagaggatgaagaagtccgagctctaaaaacagaactaggaaaagcaaaacttgccaaagaaaaattcaagttagtcgttacagacgtccaaaaagagtgcacccggttacgagaagaaaatgcagctaccgcaagagcccttgaacgagaaaccaagagggctcgcaaggaagagtatggctga

SEQ ID NO: 20418 - DNA, 144 bp, Glycine max
  Peptide Sequence Number=SeqID_112103
atggccatagagattcagaaggagacatttattttgggtatacctgatgtttgcaatgaatacagaaattcaggtggcaataatgcgaaagcaggattgaacagttcatctgatttatcaatactatctgcgctgcaatactaa

SEQ ID NO: 20419 - DNA, 312 bp, Glycine max
  Peptide Sequence Number=SeqID_112104
atggaggtgacagaggtgtcgttggtctaccaacaccctcgtcatcgctttggtccacaacaacatatccaacatctccactttcggtgtcatatatttgagtcaagacaacgttatatgtacacatcttttattctgcgagatgatgttgatgttcgacaaatgttcaacattttttacaaaaacccatcactatcgtttgtggagttatttgtcataatctgtgacaataataacccaccaaccaaccaacatggctcaacctccaatcttgaggacttatcagatgaatacgagacttgttgggtctaa

SEQ ID NO: 20420 - DNA, 330 bp, Glycine max
  Peptide Sequence Number=SeqID_112105
atgatattgcacgagattagaaggcctaactctctaaaaacagtccccagtggagtcgccaactgtcgcaacctacccttcggcgggagggcgacgcgaaggctcgcgggtgcgtcttccatgggaggaaaatacacggagtcgccaccaacgtttattcgaggaaaacgtcgggaaaaaccagaaaggtgtggtctacgaactttaagtgtgaaaggttcgagagttgtatttacgcacggggaagggtgtctcccttgctcctacgtattcctcaattgtgataggaaatctgacctacgtagttctttgagaactaacgttggttaa

SEQ ID NO: 20421 - DNA, 232 bp, Glycine max
  Peptide Sequence Number=SeqID_112106
acgatcaggcgagatgctaattggagaagggctaacccggaccagccttcccggaaagcacgagcatacagattcgaagtgttcgttcggagattccactatacctttttcactcgggaaagccactctagcctatactctttgtcttgaatcacagaggaaggacaagagctcggacaacaactatcaaaactggaaatgcacctggaaccacactgctttagctgcttga

SEQ ID NO: 20422 - DNA, 186 bp, Glycine max
  Peptide Sequence Number=SeqID_112107
atgtgggtgcaagccattggtctgtttgctcaagcgacctgtgctcctgagtttggacttccaagaccgttcaatcagagattactcgtcttgcacgttggtgggggtgccgtaaatcaacaaattaacaatgcacacagggatcaaaacatcttgcttctacataggagtcatttgatcctttag

SEQ ID NO: 20423 - DNA, 534 bp, Glycine max
  Peptide Sequence Number=SeqID_112108
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 20424 - DNA, 162 bp, Glycine max
  Peptide Sequence Number=SeqID_112109
atggcttgcttggaccagcaacattctgaaaaggagggatatgttgttgttgttgtggaggacttgtccatttcagatttggatgatttcttcaacctggattgtatctattgcttgaaaggtcataatgattctgttgttgctggttttcataagctttag

SEQ ID NO: 20425 - DNA, 681 bp, Glycine max
  Peptide Sequence Number=SeqID_112110
atgggactcatctggctcgctaggggatcctgcaggctcctcccttgcctgggcctcgggccagtctccaggccatgcgacctcggccccaagctgctccggagtagggcatgcaaaagagacggaaccccgcccctactgactgaggctgaaccggtagagacaatcatgatcggcctactgaggtggtggcggtgcatttgcggcctgatgtgcatcaccctgtgcctacctaggcgtgcagtacttctcgatgaaggaccgggtgatcggcggtcaaattactttactgggggtgacgggaactccaaaagactagcagaggcccgtgatcagcaccagaaaccccaaggccctgttggacttatctgggtccagagggtgcctggtaggcgccatacctgcaaacaaataaatgacgtcagcaatcacctgggccatgtggacgctcatccatgtcaggatggcatacaccaactggcacttaggcagagggagatcggagttgtgatcgctagtggtcatgctggtgcacatgatccgcacccgcctccctgcagcggtccgggcgaaatcctaccccggtatgcacaacagctaggcaatggcttcctcatcgaacccgtcggccctgttcctcctctggctgaactcacactattggccttcctccaaaactag

SEQ ID NO: 20426 - DNA, 47 bp, Glycine max
  Peptide Sequence Number=SeqID_112111
agacagattctgcgccctttatcattcaggaagaacaagctgagtgg

SEQ ID NO: 20427 - DNA, 465 bp, Glycine max
  Peptide Sequence Number=SeqID_112112
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccgggagttagtcttgagtcatgcgcggttaaggctaaactgaaaggacaagttttggtgactgcgcctcctccagccagttacctcg

SEQ ID NO: 20428 - DNA, 306 bp, Glycine max
  Peptide Sequence Number=SeqID_112113
atgggttcaagtcaaacgccttcgcttaaaaagaggttctatcaagtcaaggtcaagagcctagggatcaccagtctaagagagttagggcaattgatgggtcagctccagcaacaagacctagccatggcagaagtctccacggaggccattgcatccctcgcccagtattatgaccagccgttgaggcgcttcacctttggggacttccagctatcacccatggtgaaagaatttgaagagatcctaggatgtcctctaggggaaggaaaccatacctcttctcagatttctatccctcattag

SEQ ID NO: 20429 - DNA, 399 bp, Glycine max
  Peptide Sequence Number=SeqID_112114
atggagagagagatgataacaatgatagtagacacattaccgatgttctactatgagaagatggtgggttacacgccttcaagctttgctgatttggttttcatcggcgaaaggatcgaagtgggtctgagaataggaaaatttaattatccttctttgatgaatatgaagcctggggcaaatggagagaataagaaggagggtaacccatgctgtgattgtcgtccctacatggccaaatttcccactagcacaacaatatctatacttagccgatatcagcccttctcattacccaccaccttatcagccaagaacacccaatcatccacaaaggccacccctaaattagccacaaagcctgcctgccgcacatccgatactaaacaccacccttaa

SEQ ID NO: 20430 - DNA, 264 bp, Glycine max
  Peptide Sequence Number=SeqID_112115
atgtgcttatcatggaggagttccaaggaagaagttgttgaaaggtttctgaagaaatatttccagagtcaaagactacgaaagggaaagctgcaatctctttatttcatcagttccctgcgcgacagagttcatcaacccacaaacaaaagcttgttagaactatcatcacatgacactttattggcaccgaataagatgctttctaagcaacttgagattttaacagaaacacttgatggcaagttgtacaatctgtggtga

SEQ ID NO: 20431 - DNA, 999 bp, Glycine max
  Peptide Sequence Number=SeqID_112116
atgatccctggtcaagcccctgctcctgagaaactggcccccaaaagacaacagggagtgaagatttctgaaaaccctagcattgcaacaagtcctagggaagtagacccggagatggataagaagatccgcagtattgtgagcagcattttgaaaaatgcttctgtccctgatgctgatgaagatgttccaacatcttccaccccgaatgtttctgtcgctgatgctgataaagatgttccaacatcttccacccctaatgtttctgtcgctgatgctgataaagatgttccaacatcttccaccccaaatgctgaaatcctctcttcacccagcaaagaggactcaacagaggaagaggatcaagccacagaggagacccctgcaccaagggcaccagaacctgctccagatgttcccgacatcaagagggccaagaaatcagggaaaaaggtgcctggaaatgtccctgatgcaccattggacaacatctcattccactccattggcaatgttgaaaggtggaaatttgtatatcaacgcagacttgccttagaaagagaactgggaagagatgccttggattgcaaggagatcatggacctcatcaaggctgctggactgctgaaaactgtcaccaagttgggagattgctatgaaagtctagtcagggaattcattgtcaacattccctctgacataacaaacagaaagagtgatgagtatcagaaagtgtttgtcagaggaaaatgtgttagattctcccctgctataatcaacaaatacctgggcagaccaactgaaggagtggtggatattgctgtttctgagcatcaaattgccaaggaaatcactgccaaacaagtccagcattggccaaagaaagggaagctttctgcagggaagctaagtgtgaagtatgcaatcctgcataggattggcactgcaaactgggtacccatcaatcatacttccacctgttgccacaggtttgggtaa

SEQ ID NO: 20432 - DNA, 526 bp, Glycine max
  Peptide Sequence Number=SeqID_112117
atggggacaaatcaaaacggcaaaaggttttatcaagtcaaggttaaaagtctagatgtcaccagcctcaaggaattgggacgattgatgggacctctccaaaggcaagccttccgcaaagtgtacgggaagattctagatttgaccgtagcggaggtatttacggaagctgtcgtatccctcgcccaatactatgaccagccgttgaggtgtttcacgtttggggacttccaaatggtaccaactattgaagagtttgaggaaatattaggatgccctcttggggggagaaaaccgtatcttttctccgggtttcttccctccttgagcaagattgcagctgtggttggagattcggcaaaagagatggatcgcatgaagcaaacttggaacggcgtagtgggcctgcctcggaaatacttggaaggcaaggcaagggatatggcgagccaagagaagtggggcccgtttgcagatatattagctttgttgatttttggggttgtcctctttccgaacgttgacg

SEQ ID NO: 20433 - DNA, 66 bp, Glycine max
  Peptide Sequence Number=SeqID_112118
atggtggttgatgaggtgaagacaaagaaatgtacggattgcatgcaccagacacgcaagaattaa

SEQ ID NO: 20434 - DNA, 213 bp, Glycine max
  Peptide Sequence Number=SeqID_112119
atggtaagcctatctttctccatatggaagtgctgcgggcacatagagatgtgggtagaggaagtctcaaaaagcgaaggccgagctgtaggtcacgtgacctgcaccgagttggtggctgactgggctttttccttgatcaaagcagatcagctcgccgccttcttgttatcaaaaagtcggtcgaatcgggcggaacgtcgaatgaaatag

SEQ ID NO: 20435 - DNA, 222 bp, Glycine max
  Peptide Sequence Number=SeqID_112120
atggcaggccttgacccaacgggtgattggatgggacggggagctcgggccctcgacaatccacgtaccgtgacgggagaacccagtttggagaaactctattcgattagagacagcctgaacgaggctggagcccgatcccccgactttgtgtccttacaaggaaaaatgttggcccggagagtgctcgatgatgaacactctgggacggatagattttag

SEQ ID NO: 20436 - DNA, 528 bp, Glycine max
  Peptide Sequence Number=SeqID_112121
atggccacaatgatggaggccatgatgagcgtgaagaagataatggaagccaatgcggttgcaattgccgctaccagcgttgttgctaagatatggtgggcaaagatttgggaagtacgggcaacccccataatgtacaaattcaaaacaagcacgccttcccgccatatggtttgcctcccaaactatacaccacccaatgtggtgtacattcccaatgaggatgtcaataactccactcccatactcattaagagccaacaacctcaatctgatcatgcacatgtctctcgacccatggaggagacacatgaaattccccaccacgatctagccaacttcgagccttgcctcggatatgctgctgaagggcaagcagttggtggtatacccctgcaaaacactttggagggccctcaatatcatccacaaccacaaccctcacgttccacagcggttaaaaaccctcatgactatggcaggaatgggaaagttggatcatctagaggaaaggctcagggccattga

SEQ ID NO: 20437 - DNA, 459 bp, Glycine max
  Peptide Sequence Number=SeqID_112122
gcattccgggccaatgcactcttcttatccacattgattactctgttttgcgtcattttcaaattccgcttgatgatgaaccctttgttcaagtcaagcgttcctttgcaattggtgctggtgcagtgacctcctttgggtatcataaagatcagaatggacaatggctgaagaaggatgcactccctcctcaagatgaatgtactccttcacctccccctcaacgtgaagattctgcactcatgaatgaagtcctctccgaattacggggtcttcgttcttatgttggtgaccgcttcaactcgttagattcacgctttgccggtatggacattcgccttacacagcttgaagaggatgtcggatacattcgtcagaggggaggaaaaggttgtgaaaaagcttattcgagtcatgatgctcgccgtatggtctgcaatgatcaggctgaaatgaccg

SEQ ID NO: 20438 - DNA, 336 bp, Glycine max
  Peptide Sequence Number=SeqID_112123
atggccttcattattggagaatcatttggtggtggccatacccgggagggtcttccagcccaccataccccaagtggtacgacccgggtgccaagtgtgtgtaccatagtggagctcccggacacaacattgactcctgcatcccgttcaaaggagggcccaaatgttaaaaccaacctactagctagtcatggaggggctagcgtgaacgccatcgaagaggatgggccatcgcgggcaaagagattaggagaggtggctacttctagatgcttcatctaccaatcgctgcaagtggcgtgcatggtcctcccgtggcgaagacgaaagggatga

SEQ ID NO: 20439 - DNA, 573 bp, Glycine max
  Peptide Sequence Number=SeqID_112124
atggtaagcatttgggacctagctagggtagaagtctccatggaaccaattgcctccctcgcccagtattatgatcagccgttgaggtgcttcatctttggggacttccagctatcaccaatggtggaagaatttgaagagatcctaggatgtcctctagggggaaggaaaccatacctcttctcagggcaagtcgaaaatggggtggtcggaataccgagaaaatatttggagcgatcgacgtttttctcgcctatcataaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttagctagcatggggaggcgtctgttaattggttccctcgctagaaggaaggaagaatcaggattctatcttcatgcgaaggatgtccaaatgttcccttga

SEQ ID NO: 20440 - DNA, 294 bp, Glycine max
  Peptide Sequence Number=SeqID_112125
atggtggtgagcttcttcttgactcatcttctccttgaagtggcgtctcctctctctcttcctttctccattccgctgccattaatcttccaagaagcaaaggaatccattgatgaagaagatcctaggcctacaagctccaatggagcttacatcatgtggtatcaagagcatcttcatctaggaccgaacgatgttccacaatctcagacggtgtttcttgaagaagatgtttcctacatgatgcctatgatgaagttgagttgtggtgctgagttctggctggatttgtga

SEQ ID NO: 20441 - DNA, 288 bp, Glycine max
  Peptide Sequence Number=SeqID_112126
atgcgagcggggaattctgatatctatggattcctcgagccacagtccactcagaggtctgggcaatcgcagtttgagactgaaagttatgtaaagagttggatgcagagttcaaaacgcgatgtctaccttagagcctacctgaatggtgctttaaaaggtcttgatgatgctcctcaatctaaatcaaaggctccagctaggtggattgttgtcaagtgtaatagacaaaaaggaagtactgagtgtgactattatgtcatgcattggatgtccaccatcatttag

SEQ ID NO: 20442 - DNA, 687 bp, Glycine max
  Peptide Sequence Number=SeqID_112127
gtgagagccaaaggggaagaatctagtgaagaaatctacccccaagaagaaggacaaccattagttgttaaagagaagtgtaaggaggtaagtatctcctccaagaggttagctaagaaagaaactcattttacaataaagacgaacattaaagaaactttccctcttagacaacctccacattttctcttttgtagaaagacacttgctagcattgccacacctcttgggcttgagtttattcctcaagtaaagaagttgttggatgagggtttggttcacaagagcttaaatccttgtgctttgttggtgcccgaaatagttattattaggcaccaagtccctaaaataggtggtatgatgaatgttttgagtggtgcaaccctcttttgcaaaatcattcatgcacccaacatcttcatgattcatgtacatagggactcattaggtagtgatcaaggggttcccacagaccctaagagaataaaggtcattcctgattggcccactccaccaagtgtcgagggaaggagcccagagtatgaagaacctcgggatttgaggtcaaatcctttccaaggtggaggggatgatgcaattctacccccaaaggtattggatagaagactccaagaggattgggctagagatactaaagaaggccctagggttctcatgaaccttagg

SEQ ID NO: 20443 - DNA, 153 bp, Glycine max
  Peptide Sequence Number=SeqID_112128
atgaaggaaggaaggatccctaaagaattagcttgttatttcatactcctgatcaaacacatgtctttaataacctctaagccaaatgatgcttcaagtgttcctaatacacctttggatgcaagaggatcttctggtgctagcaacccttag

SEQ ID NO: 20444 - DNA, 506 bp, Glycine max
  Peptide Sequence Number=SeqID_112129
cctaagtgaagaacttcgtgactattacgaaggaaggcataggtcacatcttagacctcactcccatagaagagaaaaggaaagaaagcctcaagaggctaacattaacctctcatacttccatgggaaggacaatgtagaggctaacttagattgggaaataagggtagagcaacaacttaaaaagaagtctacttcaaaatcttatggctctcactcttatccaaagaaagaccaaggtcaaggcatcttaggggtgacaccttctaagcccaaagatgataaggggaaggcaatagaaaagcaagcccctaaggctagctactacttcacttcctctagtgaaagtgaagaagcaaaatgggaagaatctagtgaagaaatctacccccaagaagaaggacaaccattagtggttaaagagaagtgtaaggaggcacttgctagcattgccacacctcttgggcttgagtttattcctcaagtaaagaagttgttggatgagg

SEQ ID NO: 20445 - DNA, 535 bp, Glycine max
  Peptide Sequence Number=SeqID_112130
atggcagaatcgtcgaagaagcgaaagggatcatcctccttcaccgctgctactggccatcgccgcgatggaccatctgaagcacccacaacacctatccatccttccttatcatctccaagatcatccactcttttttcttcagatgatcaacatctacagtacctttctcaattttcttctaggatcattttagaccctaagtacctagacatagatttcttcaatgatgagacatttgactgttatcaagtgtttcaaaactttggcttggttgatttcatgtctttaaaattgccttactatgctgaacttgtcaaagtcttttacagcaatttaaaaattcaggatggcattatttcttctgaggtacatggtatttccatgatcattgatcaatctttgttcttttctttgacaaaattacccagtcaaggtgcaccttttgagggcaccattgttgatgactggaaatttgattattctagtcacgatgcttgtcgtatggtttgtaatgaccaggctgaaatgaccg

SEQ ID NO: 20446 - DNA, 204 bp, Glycine max
  Peptide Sequence Number=SeqID_112131
atgaaggtacaagttgatgattcatggctatggcatcgaagatttggccacttcaacacacatgcctcgaagttgctacatgagaagaacatgatgagagatcttcccagcataaaggagaacaatgaaagcatggagagcgaaagatctattggagcttatacatacggacgtctgtggaccaatgaggacgccattacatga

SEQ ID NO: 20447 - DNA, 192 bp, Glycine max
  Peptide Sequence Number=SeqID_112132
atggagctcccagacagcgagaaaagagtagagcgacaatgcaaggaggctcggacggtgccagtagggcaagccaagcaggcttttcagctagctcttttacttgcggttgtgttgaagtcaatgggtaacggacaagggttttcctttagaagcggtggatttcatcccccatgtcatgtccatccttag

SEQ ID NO: 20448 - DNA, 507 bp, Glycine max
  Peptide Sequence Number=SeqID_112133
agcggcggccccgatgattacgcggagataccttacggtatccgcagccttttgtcatccagaggcggcgggcccgatgacaagcagagaccaagttttcaagtctcaccaaattatccagaactacgtcatgtgacgtgcacccttgtatcatccagaggcggcgggcccgatgatacgcggagataccttacggttatccgcacccttttgtcatccagaggcggcgggcccgatgacaagcagagaccaaagaccaagtttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttattcgcacccatttgtcatccagaggcggcgggcccgatgacaagtag

SEQ ID NO: 20449 - DNA, 606 bp, Glycine max
  Peptide Sequence Number=SeqID_112134
atgaaagataaaagggatgaggaagaaaaactagaaaaccaaaataaaaagaaggacagtaaggcctcatcttcaaaggccaaggggaaggaaaaagaggaaaaggattcctccaagaagattggaacatcccttagcatcaccatacatcttgagcttgaggttattcctcaagtaaaggagttgttggatgagggtttggttcgtaagagcttaaatccttgtgctttgttgatacacaaaataggtattatgaggcaccaaattcctatgataggtggtatgatgaatgtgtcgagtggtgcaaccctcttttgtaaaatcactcatgcactcaacatattcatgatttgtgtacatagggactcattaggtaggctggatctttgtgcttcaatgaggtcctttaatggtgattttccaccatggagatgcagcggaagacaaaggagaagaggtgagaagaggcttcatccactaaggaataagccatggaagaatgagcttcaccaccaagatgagccttggataagaagcttggagaggatgcttcaatggaggaaaagaaagagggagagaaagagagaggggggagcacgaaattga

SEQ ID NO: 20450 - DNA, 393 bp, Glycine max
  Peptide Sequence Number=SeqID_112135
atgaagctaacaaagtttggaagttcttctgttgctgatggggttgatgtgaagtcatatgccagcaaggttaaaagcactggaatatctgaacctttatcagcgtcagaagtaagattgaatccttcagccttcgtacaatctgttccttctagtgaaaaagagtggggaaaagtgtgggaggtgtttatacctcaatcaaagaataaacagggtcaacgttatggttttgtccgcttcaaaggcgtggaggacgcaggttggttggagagacaactggataacaaaatctacatagaagggaagaagttgtttgtcaacaaacccaagtttcagagaagaggtaaaagggaagtgggaagaacagggggtgaagtggttcgagtaaggaag

SEQ ID NO: 20451 - DNA, 1092 bp, Glycine max
  Peptide Sequence Number=SeqID_112136
caatcgacgctttccttgcataccaccatagcaaggaaagtccggtggtagctgtcttggcagatttatttgacacgtttgaccgaagaatagattgggaccagcttttggccgggataggaggtagaacaaggagttggttcccccgatggaaggaaggaaaagaaggagtccttttctcatgtggaagatacccaaacattccgctgataggaacgaggggttatattaactacaatcccgcgctcgctataagacaactagggtaccccatgaggggagcaccgacggaagaaagcatgtctcctttccttgtgagggatttcgggcgcacaaattccaagactatacaaagaatccataaggcatgggaaaccccgttaaggaaagatcaagagcttaggggcattcgtaatggcatcattgctcgccaagttaaagtcgtcagcgaagagagttttgaagcaccggaagaggacgaagaagtccaagctctcaaaagcgagttaggaaaggcgaaacttgccaaggagaagttcaagttggccgcaacacacattcggaaggagtgtgccggattacgggaagagaatgcaattaccgcaagagcccttgaacaagagaccaagagggctcgcaaggaagagtatggccggaataaatttcgcggagctctatggggtagcaatagtgaactcaagctgcgaagggaagagagggaccagtcgcgagcacatagcatggttctgaaagaggagttagttgcttgttcaaggtccaaaagaagcttgtctcagcgtttatgcgagacggagaccaacatgctagctattatcgccaagtaccaagaagagttaggtctagccacgacccacgagcatagaatcgcggacgagtatgctcaagtatacgcggaaaaagaggctagaggaagggtgatcgactctttacaccaagaggcaaccatgtggatggatcggtttgctcttaccttgaacgggagtcaagaacttccccgcttgttagccaaggccaaggcgatggcagacacctactccgcccccgaagagattcatgggcttctcggctatt

SEQ ID NO: 20452 - DNA, 757 bp, Glycine max
  Peptide Sequence Number=SeqID_112137
gctccggtatcacaggacacaggatttatttattctgcgaagtgatctccgtcacaggtatttattcggcgcaaagtgcgtcggctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctgctagccgattatttcgcccggcgccgcggtttgctggtggtggagatcccggccctggaagaattggaccaggtggagttgttcagcaaaagcatccgcaccgccgcgcaccgtggccatgtggatcagatcattcaggagtcactcgctgatggagtcattgatgagaaagaagctgccgacattatgcgctatcaccgcaagcatctgcaggcgcgtgatgcagagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 20453 - DNA, 528 bp, Glycine max
  Peptide Sequence Number=SeqID_112138
atgctgctgacgcgcaacattgagcgccgcctgctgctggccatcctgtttattctgtttgttgccagccacctgttatcggccgtggcgtgggatttcacgtcgctggtgctgtcgcgcattggcattgcactggcgcacgcggtgttctggtcgatcaccgcctcgctggcgattcgcgttgcgccggccggcaagaaaacccaggcgttgagtatgctggccacgggcacggcgctggcgatggtgctgggcgtaccgattggtcgtattgtgggtcagtatctgggctggcgtaccacctttggtatgatcggcctgtcagcgctggtactgctgattatgctggtgcggatactaccgcgcctgccgagtgagcacaccggttcactcagcagcgtgccgatgctgtttcgccgcccggcgctggtggcgatgtacattctggtcaccgtcgtggtgaccgcgcactacaccgcttacagctatatcgagccgtttatgcaggtagtggccagtgccgattag

SEQ ID NO: 20454 - DNA, 469 bp, Glycine max
  Peptide Sequence Number=SeqID_112139
atgacagcacgtaaaattattctggactgtgatcccggtcatgatgatgccatcgccatcatgctggccgcaaaacatccttcgattgaactgctcggtatcagtatcgtggcgggcaatcaaattctggacaaaacgctggtcaacggcctgaacgtttgccagacgctgaatattgacacaccagtttatgccggcatgccacagccgattatgcgccagcagatcgtcgccgataatattcacggcgaaaccggtcttgacggcccggtgttcgacccgctgacgcgtaaagcggaaacaaagcacgctgtgaactttattatcgatacgctgatgaacagcgacggggatatcacgctggtgccggtcggcccgctcactaatattgcggtagcgatgcgcatgcagccgaaaatcattcccaaaatccgtgaaatcgtgctgatgggcggcgcttacggcaccg

SEQ ID NO: 20455 - DNA, 651 bp, Glycine max
  Peptide Sequence Number=SeqID_112140
atggcgtccggctattgcgataaattttcagccgatgtgatcccgcacacacatttatttcatattcttgccggagactatattgtgcgcgagggttctctgccggcgtatatgttttatctggcgcgcggtcgcaccaaactgtatgtcacgctggccaatggccgtatttcgctggtggatttctttaatgcgccctgttttattggcgagattgaagtgctggatgaaacgcatgcttcacgcgcggtgcaggcgattgaagcctgctggtgcctggcgttgccggtgaaaacctgccgcacgctattgttaaatgatgcgcagttcctgcgccacgcctgccttggcctggtgaaaaagaatttccgcaatattgtcacctcaacgcgcaatcaggcgtttccgctggttaaccggctggcggcctttatcctgctgactcagcatgacgatgtgtataaagagaagcatacgcaggtagcggagtaccttggcgtgacctatcgccacctgctgtatgtgtttgagcagttcagcgcaggaggagtgctgcgtaagcagcaggggggttatgcgatcggtaaccgcgcggcgctgacggccttagccgaagagatggaacccggcgcagcgctgccgggtcactga

SEQ ID NO: 20456 - DNA, 693 bp, Glycine max
  Peptide Sequence Number=SeqID_112141
atgcaaccaatcagtctgcaaacccggtaccgttctgcaaacgagaacaccattgcgctgtgggcgaaaaatgcaggcatcgggaacatccatgaagagaactattacgatccggtaaaactggcgcttgccgcagggataaagccgtcagtttccttaccggtgttacgtctgattgatgaattgcaacgactcacacaggctgatccgcttgccgataccttgccagcgcaaggtcttcattttacttttttgcctctgaccttgccgctttacaacatcaatgagcgtttaccagcgaaagtggcgcaactgaccacaatctggcaggaatttgctgcgaaaaaaatcgttatccgggatctgcgcttagtggcgttacccagtcagttattgcttgcaggcatacctgacacgcctgcgattgccatgcgccagtcattttgcgacaagattctggattcagactggaaaaatgaattgctgatgcggcatggcaacagcccgttgccggcacccttctggcacagcacgttactgcgctacagcgctgagtttttacctggcattctgcgtcaattcttttatgaacgtcaggacatcaattttgctgaggtggcgggagaactgatgctggcgaagactaactacaactggacgaagtgttatccgttattgccggcgagggtttaa

SEQ ID NO: 20457 - DNA, 1296 bp, Glycine max
  Peptide Sequence Number=SeqID_112142
atgacggcaatcgagcggcttaacgcgtttgacaggcaggggcgctatgtctttgctgtgcgtgatttagccaaagtcttttatgacgacagtgacaaggctttcaatgctggcctgaaccgtctggtgaaggacggcatcctgcagcgcgccagccgtggcgtctatgtttacgcctatgcgagaagtaaagacgcttacacgctggaaagaatcgtccagacgttgcgcagaggagaatacagttacctgagcctggaatcggcgttatcggcttacggtgtaatttcacaaatcccgatggggcgtcttaccgttatgaccacgggccgttctgaagaacacattacgccttatggcgtgatcgaattcacgcataccaaacgatcgcctgaacaaattttgcaggacaccattttgggcgagtcacctttgcgcctggcaaccaaaaaagccgcactgcgcgatttacgtcgggccatggcttcagcgcaactcgagggtatgcgtaacgtagtggaaaaagagcttttacactacgacatcctttactgtctggataaagcgggtctgctgcaaaatctgacgttccagggcggtacctctttgcggctatgttatgacggcaatcggtttagcgaggatctggatttcgccggcggcatcaacttttccggtgcagatttaaaaaacatgaaggtctgtatcgaagactatctcggcacgcgttacggtttagaagttacggtcaaagagccggcagaacttcgccgccagcccggctatgaagagattagggtcgataaatggcaggtctccgtgacgacagcacccgaaaaacgcgatatgcctaagcaacccatcaaagtcgaagttgctaatattcccgcttacagtcgcaaaccgttgccgctgagccgcaattatccggtgttgccggatggctacagcgatacgctggtgatgtgtgaaagtctcgacgaaatcatgagtgataagcttatttctctggttgcgaccaccaaatatcttcgttatcgcgatgtctgggatttaccgtggctgatgcagcaaggcgctgcgtatgatgtgggctggattcggcaaaaaatcgaggattaccggattcctgactatgaaaagttattaaaacaacgactggctggtatcgaaaacatcgtcaaagacggacgtttttacaatgaaatgcgccgttttataccccagcaggaaaacgaccagatgacgccttcagaatgtaacagcgacagctggcccggagtgcagaggagataa

SEQ ID NO: 20458 - DNA, 2337 bp, Glycine max
  Peptide Sequence Number=SeqID_112143
atgtccgctcagatacctgccgcagattattcaggtgcagagaaacagcgcctgtcagaaacacgttccattgattacatcccgctcagcgagcgtcacgggcatccgtttagccagttcacattgtggtttggtggcaatttgcagattaccgccattgttaccggtgcgctggcggtggtactgggcggcgatgtggtgtggtcgattgtcggtttactggtgggacagatcgtcggcgcggccatcatgtcgctgcacgcgattcagggcccgcgccttggcctgccgcagatgatcaccagccgtatgcagtttggcgtgtttggcgcggtgatcccgctggtgctggtgtgcattatgtatgtgggcttctcggccagcggcacggtactggccggccaggcgctggcgaagctggtcaacgtcagcaatgcagccggcatgatcatcttcagcgccatcatcattgtgattgcggtgctcggctatcgggtgattcataaactcggcaaagtggctagcgtcatcggcgtgctggcgtttgtttacctgttcatcaccctactctccagccacgatttagcggccgtctggcaaaatcagcacttcagcgttgccagttttctgctggcggtatcgctctcctcgtcatggcagattgcgttttgcccttatgtgtcggactactcgcgctatctgccggtggatgtctccgcgaaaaagctgttcagttcggtgttttttggcaccgtgctgggcacgcaggcatccatgacgctgggcgtcattgtggctgcaattgcgggtaaagcgttctccggtaatgaagtgggctacatcgttgggctgggcagcagcgccaccatggcgatggttatctacttcgccatctgctttggcaaaatcaccttcaccacgctcaatgcctacggcagctttatatcgctgaccaccattgtctccggttttcgccagcaaaccgcgatcagccgtggcggacgtatcctgtttgtggtgctgatggtcacgctctcctgcatcattgcgctactcagcgaaccggcgtttctcaaatcatttacccacttcctgctgttcctgctggccttttttgtgccgtggagcgctatcagcctgacggatttttatctgattacccaagggaaagtcgatgtgcccgcgctgtcgcaaccggatggccgctacggtcgctggaactgggcaggcattattatttacttcctcggagtgctggtacagctgccgttcattgataacccgctgcatcatggttccctgacgtggatttttgccggcaacgatgtgtcatggatcatcggctggtttgttaccgcgctgctgtggctggccgcactgctgcggcgcgtgttttcgcgccgccctcatcggcaatatcctgataatgccgtaaacgctgcggcacgctacactgctgatcgccctttcgagaatgcaggagtcatggatgccagcctcagcgctttcactgttcaccccggccacgcaacagtggtttcgccgcactttcccggcggcgacccccgtacaacaggaagcctggcgcgccatcgccagcggacaacactgcctgcgcttgcggctgacgtgcagcgtaacctggcgctaccgctggcgggcgttgccgctcagcgcgcggaattaggtgaggcggacatcacgctggaggtcggcatgcgctccggcgacacgctcagcgccgaacgggcaaagctgcagcgccggccgccggacatcctgattactaccccggaatcgcttttcctgctgctgacgtcaaaagcccgcgaaacgctgcgcggcatctcaaccgtgattattgacgaagtacatgcggtggccgggagtaaacgcggcgcccatctggcgctcagcctggaacggctcgatgtattgctggcgcagcctgctcagcgcattggcctgtcggccaccgtgcgaccgccagaagcggtggcagctttcctcggtggcgcagaggacatgacggacatccagcagcgtcccgatgcgcgcgccgcgcaggagagcagcctcgccgccgggtccatctggccgcatattgaagccggcattctggatgaggtattgcgccatcgcgcgactctggtgtttaccaattcgcgtgggctggcggagaaactcaccgcacggctcaacgaactgtacgcgcgacgctccgcgccagagcatggcgttacggagcccgccctcgcctatggctcttttagcggcggaaccgaaaaacgcgccacgcctgctgaagcgtatattgcccgttcgcatcatggctcg

SEQ ID NO: 20459 - DNA, 1561 bp, Glycine max
  Peptide Sequence Number=SeqID_112144
gtcaaaagcccgcgaaacgctgcgcggcatctcaaccgtgattattgacgaagtacacgcggtagccgggagtaaacgcggcgcccatctggcgctcagcctggaacggctcgatgtattgctagcgcagcctgctcagcgcattggcctgtcggccactgtgcgaccgccagaagcggtggcggctttcctcggtggcgcgggcgctacgcgtatcgtcaacccgccggcgcagcggccgctgcagctgacaattactgtgccggtagaggacatgacggacatccagcagcgtcccgatgcgcgcgccgcgcaggagagcagcctcgccgccggttccatctggccgcatattgaagccggcattctggatgaggtattgcgccatcgcgcgactttggtgtttaccaattcgcgtgggctggcggaaaaactcaccgcacgactcaatgaactgtatgcgcgacgcgccacgccagagcatggcgtaacggagcccgccttcgcctatggctcttttagcggtggaaccgaaaaacgcgccacgcctgctgaagcgtatattgcccgttcgcatcatggctcggtgtcgaaagagcagcggctggagattgagaacgccctgaaagccggcgagctgcgctgcgtggtggcgacatccagtcggggcaccgccttcggtggccagcgcgctgcagcgtattggccgggccggtcaccaggtggggggtacgcccgtgccgatccgttcaaaacgttaccgcgtaacgccttcgatgcggtgctggatatgctgtctggctgctatccttcggacgagtttgctaacctgcgcccgcgcatcatctggaatcgacaacagcaaaccttaagcggtcgcccgggcgcgcagcatctggccgtcaccagcggtggcaccattccggatcgtggcatgttcagcgtgatgctgccggagggcgaagaacagtctggtgcgcgccgggtcggtgaactggatgaggagatggtgtatgagtcgcggattaacgacatcatcacgcttggcgccacctcgtggcgcatccagcaaattacgcacgatcaggtggtggtggtgccggcacccggtcgctcggcgcgcctgcccttctggcacggcgacagtctcgggcgttcggcgacactcggcgaagccattggccgctatttgcgacatgccgccagcggggtgttgcccggcagcgacaaccttgacgccaatgcccgacacagcattcgtgcactcatcgacgaacagattgccgccacaggcctggtgcctgatgatcgcaatttgctgattgagcgctgtcgcgatgaaaccggtgactggcgcgtgattttgcattccccttatggtcagcgcgtgcatgctccgtgggcgctggccatcgctgagcggattggccgccagatggggctcgatccggccgtggtcgccagcgatgatggcattgtcgcgcgcttccctgacagcgaaggccgggtgccagcgctgaactgtttttgtttgcgccggacgaactccagcgacaggtga

SEQ ID NO: 20460 - DNA, 648 bp, Glycine max
  Peptide Sequence Number=SeqID_112145
atgattgatgcggcttgcgcctacatcagaatgataccaaaccgcttcagcactaccgcccagagggcgaacagcatcacgataagcaccagcaaggtgaccagcggtaaagcggcgagcaggccgcccagacgatcgctgcgtttcgctgcttctgagatcagtaccaccataaaggcggtaagaacgaatgaccgcgacgatctcttccagatcctcacttcgcgcctgcggcgtagcctctgcgttcatcaaatgttcgcgtatatggccctcgagcaattcgctcatcaggccattaatagcgccgcgcactgccgcaacctgctgcagtaccttgaggcactcctcacccgattcgacggcggtttccagcgacgccgcctgaccttttatgcgtcgaatgcggtatataactcactttacggcgctttcgggccgcctgcaactgattacaccgacattgacatccaaatcccaggaggctggatatggccgcaaaatcgccgtgcatcgatctctgcgtgtttgatacgaaaaccggctggtgcgaaggatgcggacgcacccgtggggaaacccaaagctggagcaagctttcgccttaccatcgcaaagcgacagagcgggcgcttccggcgcgcctga

SEQ ID NO: 20461 - DNA, 1431 bp, Glycine max
  Peptide Sequence Number=SeqID_112146
atggccactgctaatctgctggcgcgctgggtcaaacgcaccgcgctggtcctgaccgccaccttaaccctcagtcacagcgcgctcgccgccacgcccatcgtgatggcgaccaaaagttttaccgagcaacatatcctgtctgccatgacggtgatgtggctgcaaaagaaaggttttcaggtcatcccgaaaaccaacatcgccaccaccatcgggcgtaacgcgatgatcaacaagcagattgatatgacgtgggaatataccggcacctcgctgattattttcaaccatatcaacaagccgatgtcgtccgaagaggcgtacaaaaccgttaaacagctggacgcgaagctgggactggtttggctcaatcctgccccgatgaataacacctacgcgtttgccatgcagcgccagcgcgctgacgccgaaggcatcagcaccatgtcgcagctggtggcgaagctggaacaggtacgcaacaccgatccggatcacaactggaaactcggtctcgatctggaatttgccggccgctcggatggtctgaaaccgctgcagaaagcttacaacatgccgctggatcgcccgcagatacgtcagatggaccccggcctggtgtataacgcggtgcgcgacggctttgttgacgccggactgatttacaccaccgatggccgggtaaaaggctttgatttgaaagtactggaggatgataagcacttcttcccaagttacaacgtcacgccggtagtgcgtcaggatgtgctggaaagccatcctggccttgaggccgcgctgaatgcgctgtcgccgctgatcaccgatgaagccatcaccgagatgaacaagcgtgtcgatatcgatcaccagtcgccgcagcaggtggcgccacacctggctggtgctggtggcggtgggttttgccatcctcgtcggcgtgccgctgggcattctgattgtccgcttcaaatggctggcaacaccggtgctgggcatcgccaccatcgtgctgaccatcccgaccattgcgctgtttggcctgatgattccgctgttttcactgatcggtcaggggattggtgccctgccggcgattaccgcggtgtttctctattcactgctgccgattccggtcgcggtatcggcatgaccttctggcagcgcctgcgctgggtggaaattccgatggcgctgccggtgatttttggcggtatccgtaccgccgtggtgatgaacgtcggcgtgatggcgattgcggcggtgatcggtgccggcggcctgggcctgcaactgctggacggcatcagcggcagcgatgtgcgtatgctgatagccggcgcactgatgatctgtttactggcgattattcttgactggctgctgcaccgtctgcagtcggcgctgactcctaaggggattcgataa

SEQ ID NO: 20462 - DNA, 636 bp, Glycine max
  Peptide Sequence Number=SeqID_112147
atggtgcagggctgcaccgcaaacgtgcaggaaagattctgcaacacgccgctcacgcttttcatgagcgccgctgcggggttaatgctaaggaacagtgagatgattatttttgttaccggtgcgaccgccggttttggtcaaagtatcacccgccgcttcattgctacaggtcacaaagtgatcgccagcggacgccgtgctgagcgtttacaggaattaaaacaggaactgggcgacaacctgtacaccgtgcagctggatgtgcgtaatcgcgcggctatcgaagaagccatcgccgccctgccagccgaatggcgtgatatcgatgtgctggttaacaatgccgggctggcgctgggcgtcgaaccggcgcataaagccagcgttgaagactgggaaaatatgatcgacaccaacaacaaagggctggtgtatatgacgcgcgccgtgctgcctgccatggtagagcgcaacgtcggtcacatcgtcaacattggctcgatagccggcagctggccgtacgccggcggcaacgtgtacggggcaaccaaggcgtttcacgtcaacatcaacacgctggaaatcatgccggtgacgcaaaccaccgccggactgaaggtgtttaaaggataa

SEQ ID NO: 20463 - DNA, 1173 bp, Glycine max
  Peptide Sequence Number=SeqID_112148
atgagaattgtcgggaagcctggcaggggaaaaggaattttcatgttttcatgggcccgattaagcgcacttgcgctgctggtcagcggcagtgcgctggcaacgacatcaccagacagcatcatcaaaccgctgatgcagcagtatcagatccccggtatggcggtggcgattctgcacgacggcaaaaccgaattttataactacggcgtggcatcgaaagagagcggacagccgatcaacgagcagacgctgtttgaaatcggttcgctgagtaaaacgtttaccgccaccttagccagctatgcggcgcagcagaacaaactgaatttcagcgacgcggccagccagtggctgccggaactgaaaggcagcgcttttgatcgggtctcgctgctgaatctggcgacgcacaccagcggcacgccgctgttcgtaccggatgacgtgaccaatacccgcgagctgatgcgctggtacaaacagtggcagccagaggcccagccgggcacggtgcgcgtttattccaacctcggtatcggtatgctcggcatgattgcggctaaaagtctgcatcagccgttcatcagcgcgatggaaaagcagctgctgccggcgatgggcatgacgcacagctatgtgcaggtgcctgcatcgcagatggggcgctacgcccagggttataacaagcaggatcgcccggtgcgggtgacgccaggcccgctggatgcggaatcctatggcctgaaatccacctctgccgatctgattcgctggctgaccattcagctgcagcaacagccggtcgcgcccgcatggcaacaggcggtggccgcgacgcatcagggctattaccacaccgaggccgcttttactcaggcgatgatgtgggaatattacccgctgccggtgaccacgcagcagctgggggatggcaacagcggcgcgcgcatcatgaagggcatgaaagccacgcggattacgccgccgcaggctgcgccgcagcaggcgtggtacaacaaaaccggctccaccaacggattcgccacctacgcggtctttattccgtcgcagcgggttgcgctgattatgctggcaaataagtggttcccgaatgacgatcgggtggtggctgcggaaaaaatcatcagcaacatcgggaagggcgaatga

SEQ ID NO: 20464 - DNA, 1923 bp, Glycine max
  Peptide Sequence Number=SeqID_112149
atgaaaaacggagcaaacggtatgactgacagaacccaaacgctggatagcgcaccgcgggtggcgaaaccggccagcggcaagcgcctcaatctggcgcggctgctgctggaagggcgtgcctttatcgcgctgctggtgattatcgccactttctccctgctatcgcccaactactttaccggcgcgaacttcctcaccatggcgtcgcatgtggccatcttcggtttgccggcgatcggcatgctgctggtgatcctcaacggcgggattgatttgtcagtcggctcgacgctgggactggctggcgtgatggccggctttatgatgcagggcatcaaccttgaagcgctcggcgtggtgctctatctgccggtgtgggcggtggcaattctgacgctggtgctgggtgcgctggtgggactggtcaacggcgtgctgattgcgatttttcgcgtcccggcgtttgtcgccacgctcggcaccatgtatgtggcgcgcggtatcgcgctgctgatcaccaacggtctgacctacaacaaactctccggcagcgaagcgctgggcaataccggtttcgactggctcggttttaaccgcctgttcaacatcccgggcggtaacgagcgcgccgccgatctctccggcgtgccggtgaaacgcatcaagatcagcgtctacgtgctgtcgggtatctgtgcggcgatggccgggctggtgctctcttcgcagctgacctccgccggtccgaccgcgggcaccacctacgagctgaccgccattgctgcggtggtgattggcggtgcggcgctgaccggaggacgcggtaacgtgcgcggcacgctgctcggcgcgttcgtgattggctttctctctgatggcttagtgattatcggcgtttctgcctactggcagacggtttcactggcgcctaaccgtaaaacaaacctgtaccctaataataacggagcacctatgttcactaaacgtctgtttatcgccgccgccgcgatggccatctccacctttgccttacccagctgggccaacaacggcctgatgaccatcatcgttaacgatccctctaacccttactggctgactgagggccaggtcgcgcagaaggcggcggagaagctgggctacagtgccaaagtcagcgcgcacaaaggagataccaacaccgaaagccagctgattgatacggcgatcaccaataaatctaaggcgatcattctcgatccggctaacgccgacggctcgattggctcggtaaagaaagccatcgccgccaatattccggtgtttgtgatcaatgccgaactgaaccagagcgggctggctaaagcgcagctggtgtcgaataacgcacagggcgcggcagtaggcgcgatggagtgggtgaagcaggtgggtgacagcgccagctatgtcgagctggtgggaccgccgtcggataacaacgccgccacgcgcgccaacggtttcgataccgtgctgtctcagtacccgacgctgaagaaagtcggccaggaagtggcgaactgggatcgcacccagggctttaacaaaatgcagtcgctgctgcaggctaatccgaacatcaaaggggtgatcagcggtaacgatgagatggcgctgggtgctatcgctgcgctgaaggaagccggcaaactcagtcaggtgaaagtgggtgggttcgacggttcaccggatgcggtcgacgcggttaaagccggtacgctggcttataccgtgatgcagccggtagcgcagtttgcgcagaaggcggtagagcaggcggacaccttcctcaaaaccggcaaaaccggggtagcacaggagaagcagctgtttgactgtatcctgatcaccaaagacaacgccggtgatttcgtttcgccgtttgtcctgaagcagtaa

SEQ ID NO: 20465 - DNA, 1251 bp, Glycine max
  Peptide Sequence Number=SeqID_112150
atggatataatgagaagtgttctgggtatggtggtattactggcgatcgcgtttctgctgtcagtaaataaaaagcacatcagtctgcgcaccaccggtgccgcgttactgattcagattgccctcggcggcgcgatcctttatttgccgccgggcaaatggctggcggaaaaagtcgccagcggcgtgcatcaggcgctggcttacagtgatgcgggcagcgcgtttctatttggcgcgctggccggaccgcaaatggacaaggtgttcaacggcgccggctttgtgtttgcttttcacgttctgccggccatcatctttatcaccgcgctggttagcgtgctctactatattggcgtgatgggcgccatcattcgcctgttgggcggcatctttcagcgcgcgctcaatatcagtaagatcgaatccttcgtggcggtcaccaccattttcctcggccagaatgagatcccggccatcgtcaaacccttcgtcaaccgtctcaatcgcaacgaactgttcaccgccatctgcagcggcatggcttcaatagccggttccactatgctcggctatgccgggctgggggtaccgattgaatatctgctggccgcctcgctgatggccattcctggcggcattctgttcgcccggctgctcagtccggcaacggaagcgtcgcaggtgacttttaccaacctgtcgtttagcgacacgccggcacgcagcctgattgaagccgccgccagcggagcgattaccgggatgaaaatagccgccggtctggcgacggtggtgatggcgtttgtcggtatcatcgcgatgctcaacggcatacttggcggcatcggcggctggtttggtcacggcgacatcagcctgcagggaatactcggcttcgcgctggccccgctggcgtggctgatgggcgtggcgtggcacgatgcggcgctggcgggcagcctgataggtcagaaactggtggtgaacgagtttgtcgcctacatcagcttttcaccttatctgcatcaggcgggcgcgctcgacggcaaaaccatcgccatcgtctcgttcgccctgtgcggctttgctaactttggttcgattggcgtggtggtcggcgccttttctgccgtcgcaccggagcgcaccccggaaatcgcgcggctgggcctgcgcgcgctgatcgccgcaacgctctccaatctgatgagcgccaccatcgccggcttcttcatcggccttggctaa

SEQ ID NO: 20466 - DNA, 621 bp, Glycine max
  Peptide Sequence Number=SeqID_112151
gattgacggggcgaactgctagttttcggatacgagatatccaccctagtcactatggacgcatttgtccaattgacacgtcggaaggaatcaatgttggacttattggatctctagcaattcatgcgaggattggaaattctttggcacttaatcgagatattcaggaggaacagactgttccagcccgataccgtcaagaatttcttacgattgcatgggaacaggttcatcttcgaatcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatcccg

SEQ ID NO: 20467 - DNA, 126 bp, Glycine max
  Peptide Sequence Number=SeqID_112152
gtcgactctagaggatcccctgtaaaaagggctttctccggaggggccctgatgctcgccaacatggatgacgaggagctaccttcacccgtgaattctgacgttgtcaagcgatactacgcttga

SEQ ID NO: 20468 - DNA, 82 bp, Glycine max
  Peptide Sequence Number=SeqID_112153
accatccactggggaagcagaagtccttttgaaggaagctatccaagaaacagaatggaactcttttttactacaggaccag

SEQ ID NO: 20469 - DNA, 401 bp, Glycine max
  Peptide Sequence Number=SeqID_112154
atgatggcaaaatgttttgatatcaacttccaagatagctgcaaaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccgggcggtgcttttgccgttacgcaccacccc

SEQ ID NO: 20470 - DNA, 144 bp, Glycine max
  Peptide Sequence Number=SeqID_112155
atggataagattctaaaggaaaaggagaaggaagcaatgaagatcctccagttgaagtcaaaacaaatgatgaactttcgagagaatggaaagcttctagagatcatccccttgacaacatcattcggtgatatctcaaaaggg

SEQ ID NO: 20471 - DNA, 441 bp, Glycine max
  Peptide Sequence Number=SeqID_112156
atggtgactttccaccatggagatgtagtggaaggcaaaggagatcaagcttatcgataccgtcgacctcgagggggggcccgctgcattaatgaatcggccaacgcgcggggagaggcggtttgcgtattgggcgctagcggagtgtatactggcttactatgttgggcactgatgagggtgtcagtgaagtgcttcatgtggcaggagaaaaaaggctgcaccggtgcgtcagcagaatatgtgatacaggatatattccgctttcctcgctcactgactcgctacgctcggtcgttcgactgcggcgagcggaaatggcttacgaacgggcggagattcctggaagatgccaggaagatacttaacagggaagtgagagggccgcggcaaagccgttttcataggctccgctcccctgacaagcatcacgaaatctga

SEQ ID NO: 20472 - DNA, 240 bp, Glycine max
  Peptide Sequence Number=SeqID_112157
atgatcattgaagaatctatccatgttgcttttgatgaaacaaacccgattatgccaagaaaggatactctagatgatatttcagattctttagaaggtatgcatattcatggtgaagagaacaaaggcaaaggaaagggaaatgatgaagactttcaaattgatgaaacaaaaacaagtacagatcttccaagagagtggagaacttcaagataccatcatcttgaacatcatcggtga

SEQ ID NO: 20473 - DNA, 451 bp, Glycine max
  Peptide Sequence Number=SeqID_112158
acatgtcctcgccttgagagggctacacgccctcaccttgggtactagttaccctcaccgtcagaggactacacgtcctcgccttgagaggactacacgtcctcagcaccagagggctgcacaccctcacctccagaggactataagtcctcgccttgagagggctacacgccctcaccttggaggactacacgtcctcgccttgagaggactacacgtcctcaccatcagagggctgcacgcccttacctccagaggactacatgtcctcgccttgagagggctacacgccctcaccttgggtactacttaccctcaccgtcagaggactacacgtcctcgccttgagaggactacacgtcctcaccaccagagggctgcacgccctcacctccagaggactataagtcctcgccttgagagggctacacgccctcaccttgggtactag

SEQ ID NO: 20474 - DNA, 249 bp, Glycine max
  Peptide Sequence Number=SeqID_112159
atggggggtggaatgaatgaaaaagtgaaggttattctatggatgaatgctctcctagaacctaagcttttgaatcctagaaagaccatgaattgttggcaggctaaccccattacaagcctagaaagtgaaaaagaggccaagtttataattgcaaaaagtagcagttgggctaagctcagcagttgggctaagcgcatatcctccgctaagcgtagctccagcgcgcttagcgcaaaggagatctag

SEQ ID NO: 20475 - DNA, 147 bp, Glycine max
  Peptide Sequence Number=SeqID_112160
atgttgatgcacaatccgcccacttgggccctccggaatattcctccagaaggcggttgcttctggaggaagcaaccctgctcgcctgggcgagctgagctcgcctgggcgagctgggcggcaaccacctcccctattttgctataa

SEQ ID NO: 20476 - DNA, 300 bp, Glycine max
  Peptide Sequence Number=SeqID_112161
atgagtcttcattcttcatctagtgttaatggtgagggttctactcctaaggaccccttgtataagatattagatgagttgagatccctcaagttgtggaaagaaaaacaagagagaaaagaaaaagtagtcatgactcttgcaagagttttaagtgaagaacttagcgactattatagagggtgccatagttcacatactaaacatcactccaaagaagagaaaaggatagaaggcctcaagaggttaacattagcctcccatttttccatggaaaagataatgttgaggcctacttag

SEQ ID NO: 20477 - DNA, 470 bp, Glycine max
  Peptide Sequence Number=SeqID_112162
atgcgagactcacgggtgcgtcttccaagaaaggaaaatgcgcggagtcgccaccaacgtttattcgaggaaaatgtcggaaaaaccggaaaggtgtggcctacgaactttaatcgtgaaaggttcgggagttgtatttacgcatggggaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcgcgggtgtggtggttacgcgcagcgtggactgctacacttgcagcgctgat

SEQ ID NO: 20478 - DNA, 453 bp, Glycine max
  Peptide Sequence Number=SeqID_112163
atggcttataggaaaagaaaggcaccctctacacctacccaagccagatttgatagatccagattcacctcccaagaggcttgggagagatacactgacattgtggtgcctcgtaagcttttaccagaaaggaatgtggtagtctactatacagagtttgatgagttcaaggaggaactcgagagatgccattgggatgaggagttcactgaatttatggacggcaatattgatgttgccattgatactcttaacacatttttgaagacccctgttgttgtggaagagggggaaacactttgtgcttactctagatttgcactcctgaggcctaatcctcaagacttagctgctaagctctgtatcccagggaggggattcgagcttaatgctgatgggcagcctttgaagattctgaggaagaacatgaccactcttgctcagacttggagc

SEQ ID NO: 20479 - DNA, 354 bp, Glycine max
  Peptide Sequence Number=SeqID_112164
atgaagcagcggtggttcattgttgactgtagtaatctcttggtattgcatatggctaccatattcataaccagaattattattaatagtagtactagaagaagccacatcaatggattgtggtggatgatggaactgatggcaaccgcttgcaagtctactatggtgatgattgaatcaaatgggcatagcaagggctatggttttgttgccttttctactctcgaggaagaaaataaagcattgaatgaaatgaatggaaagatgattggacataagcccctgtatctagctgtggcccaacgcaaagaagagaggaaggctcttttgcaggttaaaatattgatgccatga

SEQ ID NO: 20480 - DNA, 189 bp, Glycine max
  Peptide Sequence Number=SeqID_112165
atggctggtgtcataacctacccttcggcgggagggcaacacggggctcacgggtgcatcttccaagggaggaaaatgcacggagtcgccaccaatgtttatttgaggaaaacgtcgaaaaaatcggaaagggtgtttccctcgctcctacgtatcctcaattgcgatgaggaaatcagacctacgtag

SEQ ID NO: 20481 - DNA, 222 bp, Glycine max
  Peptide Sequence Number=SeqID_112166
atggggaaggcggttgcttctggaggaagcaaccctgctcgcctgggcgagctgggcggcaaccacctcccctattttgctataaataggggaggaaggcaagaaggaagggccgaggcgcttccgaaacgtttccgtaacgttttccgtgaggaatctcgcaaagatttcaaccgttcttcgacgttttcattcgtcttcatcgttcttcgatctcaacgg

SEQ ID NO: 20482 - DNA, 267 bp, Glycine max
  Peptide Sequence Number=SeqID_112167
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtccaatctgcgcggcgatcggtgcgggcctcttcgctattacgccagctggcgaaagggggatgtgctgcaaggcgattaagttgggtaacgccagggttttcccagtcacgacgttgtaa

SEQ ID NO: 20483 - DNA, 498 bp, Glycine max
  Peptide Sequence Number=SeqID_112168
atgccgatctccccctgcggaagtatcagttgggatcgcgcccacaagacacatagtggacccggagaagcccaacagggccttggggtttccacctctggttatgggcctctgtcagtcctaccgggtgcacgtcccccccagcaagggatcgcgcccgcaagacactcagtggacccagagaagtccaacagggtcatggggtttccagctctgattatgggcctctgtcagttctacagagtgcctgtcgcccccagcaaggtcatcaggccccctactaacctagctttcaacaataagtattgtgccccatgcaggcgcagggcgagacaccacaacagcttggggatggccggtagcgggcaacagacgcaccgccgccatctccaaagcccttcagctcatctacaaaagttggagcgttgcctacgacccgtggtcgaccagcaggcgatcaagtccaaagccaaggtaagcaaagtactaggtccgtga

SEQ ID NO: 20484 - DNA, 436 bp, Glycine max
  Peptide Sequence Number=SeqID_112169
aggactgcacgtcctcaccttcagaggactacacgtcctcaccttcggaggactacacgtcctcacacttaagagggttgcacacccttgccttcagagggttacatcccctcaccttcagaggactacatgtgctcaccttaagagggttacacgtcttcgccatcagagggctacacgtcctcaaactttagaggactacacgtcctcaccttcagagtgctacacgtcctcaccttcagagggctacacgtcctcaaacttcagaggactacacgtcctcaccttcagagtgctacatgtcctcaccttcagagtgtttcacgtcctcaccttcagaggactgcacgccatcgcctttagagggctacgcgtccttactttcagtgggctccatatccatgccttaagaggatttaaggtcctttgcccttaa

SEQ ID NO: 20485 - DNA, 267 bp, Glycine max
  Peptide Sequence Number=SeqID_112170
atggtgaaagttggaacctcttacgtgccgatcaacgtctcattttcgccaaaaagttggcccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 20486 - DNA, 282 bp, Glycine max
  Peptide Sequence Number=SeqID_112171
atgttaccagcacttgctgccagtgtttgttgccaagcagcagatcttttgactgtttgtgcagcagctgaggcatggattgaagctctcaaggccagcgagaaggaaatactgatggaaacaaaaatagctcaaagagaactcaaagaatcaaaattggagcaagagctggaggtttacaccaaagagaagatgctttcaagaaaagttagtagtaatgaggagcttgacaattggccaagaaaacgcgagaacacttcatccaagaacttcatagtttaa

SEQ ID NO: 20487 - DNA, 147 bp, Glycine max
  Peptide Sequence Number=SeqID_112172
atggaggctggatctttgagcttcaatgaggtccttcaatggagaagtgaagaggggagacaccatccactagggaataagccaaggaagaaaggagcttcaccaccaagaatttccttggataagaagcttgaagaggatgtttaa

SEQ ID NO: 20488 - DNA, 207 bp, Glycine max
  Peptide Sequence Number=SeqID_112173
gtaatccttgtggcgtctaccctgaattatcttccttcattggaagtggcgtctaccttgacttatcttccttcactgggaagtggcgtctaccctgacttatcttccttcaccggaagtggcgtaatccaaaccttcatagcctgtatcaaacgatccgctcctactcaggttcacatcatctggtatcagagcttcggctcttga

SEQ ID NO: 20489 - DNA, 441 bp, Glycine max
  Peptide Sequence Number=SeqID_112174
atgtatttttccagctttgctttgacatggatcttttcgtggcaatacagatatgggaaaactgaaaacaacaagcaatacccacctttgcagagacatgcttttgtaaaatggtggacacaatttgatacctcaaaggctgctccaaaccaagtcaagaactggttccagagccaccctgaatttctcaaacctgttgatccagaaacgtcattatttttgaatcagaaatctcaacttgcggcattcttggccagttcaaaatccaaagaaagccttgcccagaaccttaaggaagttctccagctacttcaacaagaagaagatgaagaatcttcaaagaagggggccgaatcttcagaagacattgatgaccaagatgatgatcctttctaccagaatgaggatgattgttttggaatctcactgaaagatgattaa

SEQ ID NO: 20490 - DNA, 255 bp, Glycine max
  Peptide Sequence Number=SeqID_112175
atgtatgaatatcctaggagaacccgtgcattaatgtgtaaacattcctttcaaaattcatatggatgttcatgctttgttggaaaaagggaaatgcctccaaagaaactctccacgaagaggtctagaagagacgccgcagcggaagggcccaattccacccccgagtttgatagtcaccgtttccagagcgtcgatgatatgaaccctcatggcacaagggctgacttaggatcgtctaggattaaaccttga

SEQ ID NO: 20491 - DNA, 510 bp, Glycine max
  Peptide Sequence Number=SeqID_112176
atgtcgggatttacacgcaattctcctcaaatttcagccagcccgcatcaattagaccttgcaccttatgcttcagagccctaccatgctcaatggaacgccccggggcttctccgtgacaagcacacgttgcgttcgagtcgtattctcggagaaatggaggttgatgaaccttggatagggttatggctaccattgaattatcaagtagatatgggagcaagctttctcgctgcaaaattcacttcttggttggtgtttttggtttgtgctaaaggtggtgttcgtcattggaagtgcggtagacagactttgtgggtagatttagggatggcctttgtggataactgggtggtgggtaaggagaaagtttgttattggctgagtaaagatattgttggggttggtggggaacttggccgtacaggaatggcagtcacagcatgggtttctccctcatcctcaccctcttcatttgccccagttttctcagtcgtcctagtaggatga

SEQ ID NO: 20492 - DNA, 213 bp, Glycine max
  Peptide Sequence Number=SeqID_112177
atgtttgcacattctggaggaaggctgctcgtcccttgggacgggcgtgggtgcaagtcctccccgtattttgcgtataaatacggggaggagtcccgaagcttaagaaaaggttcagaccttcttggcatttctccctctctcgaaattgctgaggaaaattatttccgtgaagaaaatccaagccgaggcgcttccgtaatgtttccgtga

SEQ ID NO: 20493 - DNA, 342 bp, Glycine max
  Peptide Sequence Number=SeqID_112178
atgtccaaatcttgtggatttgggatgaccggccctctcgatgagtcgatctcttgctttctcataagggtggacccttgggtacttgtacctatcacttttagaggactacacgtcctcgccaacagagggctgcacgcccttaccttcagaggactacatgtccttgccttgagagggctacacgccctcaccttggttaccctcaccgttgagaggactacacgtcctcgccttgagaggactacacgtcctcaccatcagagggctgcacgccctcacctccagaggactacatgtcctcgccttgagagggctacacgccctcaccttgggtactag

SEQ ID NO: 20494 - DNA, 739 bp, Glycine max
  Peptide Sequence Number=SeqID_112179
atggctacctcaccaaaagaaacttcagctcctggctcacccactgtaccatcatctccttcatccaccaaagcaccatcaatccaggaacaacctgaattccatatccaacccatacagatgattcctggtcaagcccctgttcctgaaaaactggttcccaaacgacacaggggagtagacacagagatggataagaagatccgcagtattgtgagtaacattctgaaaaatgcctctgttcctgatgctgatgaagatgttccaacatcttccaccccaaatgcttctgtgcctgatgttgagaaagatgttccaacatcttccgccccaaatgctgaagtcctctcttcctccagcaaagagagatcaacagaggaagatgatcaagccgcagaggagactcctgcaccacgggcaccagaacctgctccaggtgacctcattgacctagaagaggtagaatctgatgaggaacccattgccaacaaattggcacctggcattgcagaacgattacaaagccgaaaaggaaaaacccccattaagaggtcaggacgaatcaagactatggcacagaagaagagcactccgatcactcctaccacatccagacggagcaaagttgcaatcccttccaagaagaggaaagaaatttcctcatctgactctgatgatgatgtcgaactagatgttcccgacatcaagaggaccaagacatcagggaagaaggtgcctg

SEQ ID NO: 20495 - DNA, 384 bp, Glycine max
  Peptide Sequence Number=SeqID_112180
atgacaagcagcggccaaatgtggtcattctgcacccttgtgtcatccagaggcggcgggcccgatgacacgcagagataccttacgattatccgcacccttttgtcatccagaggcgacgggccgatgacagcagcggaatgtggtcattctgcacccttggcatccagaggagaggcggcgggcccgatgacacgcggagataccttacggttatccgcacccttttgtcatccagaagcggcgggcccgatgacagcagcggccaatgtggtcattctgcacccttcgtcaatcgcggccgacaagcccgttgacatgcgggagatttacatcatcttccgcacttacagatctgtggacactgactttgagtcatgctga

SEQ ID NO: 20496 - DNA, 462 bp, Glycine max
  Peptide Sequence Number=SeqID_112181
atgagaacaataccattcacaggaaccttacaaacagttttaggacacaaccctgtgactgaatctataaaccaacacccgggaatcctagatagattcttcagaagaacaaactccgaaaccagacaactagaacaaatagtagatataaaatccaacattgatattgggtcaaattctaggatagactccctcaatcctagacatttatacaacctaaactggctaagttctgatagaactagtttatacaaatatagaaggattgacgactttcatcttactaatggaagacatgagattattagactaatctcaggacaaactggacgacaacttcttagtacaaacagaatatatgtagacctagggttaattgccaaaggcgtcaggtctctaacaagatctattgtgggagctaaagcttttgtagtgctattcgatcaaaggaagaataagtga

SEQ ID NO: 20497 - DNA, 354 bp, Glycine max
  Peptide Sequence Number=SeqID_112182
agttttctgccttgctctgtttttgcttggctgtgatagcttgtgctgtttgaatgttgttttgcttggtgatgatttgtggaagcttgagaggattgatggggacccggtgttgagagaaacttgtgaggatatcgggctacgtttgggagtacgtgagctacccattctgtttggaggcgttttggcaacaggggatggttgtgagtttatgctgaacgcattgtggatgtggaaaactctgttgtgcaccatcgcccgaccgccacctagtaccacatgtgatggggtgaaacttcctgcttttatgagtgttgaaccacagagtgagtacctttggagatatgttgcggg

SEQ ID NO: 20498 - DNA, 354 bp, Glycine max
  Peptide Sequence Number=SeqID_112183
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcggcggcggggtgtggtggttacgcgcagcgtga

SEQ ID NO: 20499 - DNA, 140 bp, Glycine max
  Peptide Sequence Number=SeqID_112184
atggataacacgtatacacatcttgatatgcatatccatggagtctccaaaggcacgggaccaccccctatccatttgttccccacatacatcagatacgagatcatcacaggcacgaaccacgcatacaacaacgcaag

SEQ ID NO: 20500 - DNA, 514 bp, Glycine max
  Peptide Sequence Number=SeqID_112185
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgaaattccttcctaaaaaaggccttcacttctatcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 20501 - DNA, 660 bp, Glycine max
  Peptide Sequence Number=SeqID_112186
atggacctcatcaaggctgctggactgctgaaaactgtcaccaagttgggagattgttatgaaagtctagtcagggaattcattgtcaacattccctctgacataacaaacagaaagagtgatgagtatcagaaagtgtttgtcagaggaaaatgtattagattctcccctgctgtaatcaacaagtacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcctgcataggattggcactgccaactgggtacccaccaatcatacttccactgttgccacaggtttgggtaaatttctcattatgttgagtcaacatcccaatatcttaaacaacattgactctgtgaagaagagagaatctcctctatccctgcattacaaactgtttgaggggacacatgtcccagacattgtctcgacatcagggaaagctgctgcttcaggtgctgtgtccaaggatgatttgattgctgaactcaaggacacatgcaaggtgctggaggcaaccatcaaagccacacagagaagaaaatggagctggaacggctga

SEQ ID NO: 20502 - DNA, 355 bp, Glycine max
  Peptide Sequence Number=SeqID_112187
atggtgctggctagagaacacaacaaggctaatcagatgtatgtgagaacagagactagggcagatagaagaagtaacgaggaaagcggtgaagagaaagaggggctagaccacggtggagaaaaggatgttgttttttacgtaccagccatgcatggcgccagtgctgatggcgccttcgacagggacgagtcacgtggcatgtcgccactagctatcggcataggctgcagcacctgcagctgcttaggtcgtagctggaaggcgccactcgagttggcgatttgggtcgcgcttccttgtaaaatttgtgtgttgaaggtgaaaaagaatgtggttgcttgtgttgagagag

SEQ ID NO: 20503 - DNA, 1079 bp, Glycine max
  Peptide Sequence Number=SeqID_112188
tcactgagccagtatcacatggtccagcatcagagcgtgaatccccagcacaagagttttacattcttcagtcaagtgttgaaactcggggcttaggcagacgaagggagcctgttgaagcggagcaatattcccaacaaatgatggagcgtggtcatggaatgtattacacgccagcaacatttttcgaatatccttcacagatgtatcagtatccttttgaaggtcatcacactgatacttctgcgagcgaacattcgttcggtggtgttgcggaaacacaagctcatttttcatggcccactatgactccttcgcagcagcacgatggccccaaggcaacacctaacgccccatttgctccgcaatggaatgtacccggagcaatacctgatatgggcgacatattaggtgttgatttgcgtcaggagttttttgctgaggctgagcaagcagaagcggggagacaacacagcagaagaaatcttgatcgtcaagcgcgaagatgggatcgaccatgggctagggttttggggggtttaagggttagtgttttggattatgggttagggttagcttttagggggttagggttatggggttgggtttattgttttgggttagggattagggctgaggggggcgcaacttcgcaaaagccccgacacccctcggtagctaaacctggccctttcccataccaaaacagccacgcagtcccatggaggtacacaccttcgaacaaagaagaagaagaagccaccgacatcagttcgttgtcagccaaggtaaccaatatcacggggctgagcggtgtgaccctcagcggtcgcgtatttgcgccccctgacctaccaattcagcccacgaacgtcaaggggaaggcaaaggtagtggaagaacaagatgataaaacacccctcactccgaatgaggatattccggtgaaaggtcttcaagagaaaagggatggttatggcaagaaggaggtgtcgctagaggaagccagagagtttctccgcataattcagcagagcgagttcaaggttattgagcagctcaacaaaaccccggccagg

SEQ ID NO: 20504 - DNA, 378 bp, Glycine max
  Peptide Sequence Number=SeqID_112189
atgctgccaactactgatttagtgtatgatggtgttttgaggtgctccagtgggcttctgtttctatcagctgtccctcctgttcagctactgacgggggtggtgcgtaacggcaaaagcaccgccggacatcagcgctggcaaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 20505 - DNA, 320 bp, Glycine max
  Peptide Sequence Number=SeqID_112190
ggacaccaggatttatttattctgccgaagtgatcttccgtccacaggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 20506 - DNA, 279 bp, Glycine max
  Peptide Sequence Number=SeqID_112191
atggatatgagaggaagggattgttctaagaagggttcacccaaccccttaatgagtaacacaaaagaacccaaaaagatttgggtacctaggaaaagaaattttcttgttatagataaccttgatagcatgaaacaaatgtctgtcatggtacctagacagtggctgctcacgacaaatgatgggagaaaagtctatgttccaatgcatgactccttatcatggtggaacagtcactttcagagggaatcaaaaagacataataaccggcatgggtaa

SEQ ID NO: 20507 - DNA, 150 bp, Glycine max
  Peptide Sequence Number=SeqID_112192
atggagtcaaagatcaccaaggtcgaagaaaatggctatcatcatcaaaaaggggaagattgtagaagcaagcttcatgatgttgaatccagattcattcaagttgttttgatgataacaaagatgatgacaaaaagcctaagagaatga

SEQ ID NO: 20508 - DNA, 720 bp, Glycine max
  Peptide Sequence Number=SeqID_112193
atgatcggccctctcgatgagtcaatctcttataagggtggacccttgggtactagtacctatcgccttcagaggactacacgtcctcgccttcagagggttgcatgtccttgccttcagaggaatacacgtccttaccttcaaagggttacaggtcctcgccttcagaggactatacgtcctccccttcagaggactacacgtcctcgccttcagagaactacacgtccaagacttcagaggactactcgtccacgccttcagagggctacacgccttctccttcagaggaccacatgtccacaccatcagaggactacacacccttgccatcagagggctacacgccatcaccttcagaggactacacgtcctcgccttgagagggtagcacgccctcgccttcagaaggatactcgccctcgccttcaaaggactgcacaccctcgccttcagagggctacatgccctcgccttcagaggactgcatgtcctcgccttcagagggctgcacgccctcgccttcagagggctacacgtcctccccttcgtagggctacgcgccctcacattcagagggctacacgtactcgcctacagagggctacacgctctcaccttcagaggactacacgtcctcgccatcaaagggctgcacgccctcgccttcagaggactgcacgcccttgccttttgaggactacacgtcctcgcctttag

SEQ ID NO: 20509 - DNA, 670 bp, Glycine max
  Peptide Sequence Number=SeqID_112194
ccagtcagatgcttgcctggccttgtctaactccccagtttcacaagcaagccaggcagatcaccttgttcaaggatttcagagcgagtacttccaacaaaacgtctgcctagacagagcttccaaccacttggacccgatgatacacctgcaggtcatcctctgtgaatctgcaagacagggagagaaagacatgccggactcacaagagaaagacagccaatgcagtcagaatgccctattgagcgtcatgcctgaactcatgttccggagagtgcctgtcggatcacttatgcctatgcaaggagagagcaccgctaagggaaagttcaatcattgggaaggcctcactatctactggatttggtctaccgggcagctagatcggactggtagcatgctgagagtcctcgggtcagtcaagaaagctgccagttctattctacgagctgcttccaaaggtgagaaagcctgtttctctgagctaggacacatgtccggaaaagaatccgaggtctatgatgccgaaccgacatccctgacggactatagtgctcctgctagaggggactctgctaggcttgctaattcgatccttgtccgatacggcagctgctgggtctccccatctctccaaaacttcccccggtcttcggcccgagctgtatga

SEQ ID NO: 20510 - DNA, 507 bp, Glycine max
  Peptide Sequence Number=SeqID_112195
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgagccttacacagagtccactcagacaaagacaaattacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 20511 - DNA, 579 bp, Glycine max
  Peptide Sequence Number=SeqID_112196
atgaggggagcaccgacggaagaaagcctgtctcctttccttgtgagagattttggtagcgcaaaatttcaagattggctcgccaagttaaagattatcaacgaagagaatttcgaagctccggaagaggatgaagaagtccgagctctgaaaaccgaactaggaaaagcgagacttgccaaagaaaaattcaagttggtcgctacagacgtccggaaagagtgtgctgggttacgagaagaaaatgcagctactgcaaaggcccttgaacaagaaaccaagagggctcgcaaggaagagcatggccgtgacaaattccgtggagcgttatggggcaataacagtgagctcaagcttcgaagggaagagagagaccaatcacgagtacatagcatggttttaaaagaagagttagccgtttgctcaaggtccaaaagaaacttgtctcagcggttatgcgagacagagaccaacatgttagctatcatcaccaagtaccaagaagaactaagtctagccacggcccatgagaaaaggtggcgacgagtatgcccaagtgtatgcagaaaggaggcttga

SEQ ID NO: 20512 - DNA, 642 bp, Glycine max
  Peptide Sequence Number=SeqID_112197
gggggcggagcctatggaaaaacggctttgccgcggccctctcacttccctgttaagtatcttcctggcatcttccaggaaatctccgccccgttctgccaacatagtaagccagtatacactccgctagcgcccaatacgcaaaccgcctccccgcgcgttggccgattcattaatgcagctggcacgacaggtttcccgactggaaagcgggcagtgagcgcaacgcaattaatatacaaatgctctgagttcctaagcctaccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 20513 - DNA, 480 bp, Glycine max
  Peptide Sequence Number=SeqID_112198
atgaaaagagaaaaacatgcctcctatagtagtcataactctttcaagagcctaagtgaagaacttcgtgactattatgaaggaaggcatagaaagtctcaagaggttaacattaaactctcatacttccatgggaaggacaatgtagaggcttacttagattgggaaataagggtagagcaaaaacttaaaataaagcctactttaaaatcttatggcggtcattcttatccaaagaaagaccaaggtctaggcatcttaggggcagcaccttctaagcccaatgatgataaggggaagacaatagaaacacaaccccctaaggctagtatgcaagaaaagactagctccataaagtgctttaaatgtcttggaagaggtcacattacttctcaatgctccaccaagaaaatcatgattatgaggagccaagacatttatagtagccaagatgaggctactacttcacccttcctctag

SEQ ID NO: 20514 - DNA, 210 bp, Glycine max
  Peptide Sequence Number=SeqID_112199
atggccgatacgatcagttgtttggcagacgcagttctgtgtaacattctatctttgtctcaaccaaagaagttgttgcaaacagcgttctctccaagcgatgggggtaccgagctcgaattcgtaatcatggtcatagctgtttcctgtgtgaaattgttatccgctcacaattccacacaacatacgagccggaagcataaagtgtaa

SEQ ID NO: 20515 - DNA, 344 bp, Glycine max
  Peptide Sequence Number=SeqID_112200
cgaggaagcggaagagcgcccaatacgcaaaccgcctctccccgcgcgttggccgattcattaatgcagctggcacgacagcggataacaatttcacacaggaaacagctatgaccatgattacgaattcgagctcggtacccccatcgcttggagagaacgctgtttgcaacaacttctttggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 20516 - DNA, 620 bp, Glycine max
  Peptide Sequence Number=SeqID_112201
atgggtaaagcagaggaggtgcaagagaaggtgaaggccgacatggaggccatgaaagagaaaatggccacaatgatggaggccatgatgagcatgaagaagataatggaagccaatgcagttacaattgccgctaccagcactgctgctaaggtgaacccgatgcccccatctggcctcaaccaaatgaatcatccaaccttagatatggtaggcaaagatttgggaagtagggacggcccccatgatgtgcaaaatcaaaacaagcacgccttcccgccatatggcctgcctcccaactatacaccacccaatgtggcgtacactcccaatgaggatacacatgaaattccccaccacaatctagccgacttcgagccttgcctcggatatgccactgaaaggcaagcagttggtggtatacccctacagaaccctttagagggccctcagtatcatccccagcaacacctcttgcattccacaacaagtaaaaaccctcatgctatggcaaaaatgggaaagttggatcatctagaggaaaggctcaaggccattgaagaggtgccggactttgagaagtacaaggggactacttgccccaagaaccatctaaagaa

SEQ ID NO: 20517 - DNA, 477 bp, Glycine max
  Peptide Sequence Number=SeqID_112202
atggcttccaagaagacaaagtcttttgcttcttcctctacccaagcaagatttgacagatctaggtttcattctcaggaagcttgggagaggtacattaatattattgtgcctaggaaactgcttccagagaggaatatggtagtatattacattgagtttgatgagttcaagaaggaactcgagagaaggaaatgggatgaagaattgactaattttgctgacggcagcatcgatgttgccattgtcagaggtcatttggtgaaatttgatgaagatacattgaacacatttctgaagaccccagtgattctggaagagggggaaaatctttgtgcttattctagacttgcactcttgaggcctgatcctcaagagttagctgctaagctctgtatcccagggaggggatttgagcttaatgcagatggcctccctttgaagattttaaggaagaacatgaccactttagcttag

SEQ ID NO: 20518 - DNA, 355 bp, Glycine max
  Peptide Sequence Number=SeqID_112203
atgggtgataaggaagagtgtatactcttttacgaaagagggggaggaagaaactgggcggcaagctcctccatgtttttgaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 20519 - DNA, 699 bp, Glycine max
  Peptide Sequence Number=SeqID_112204
ttgggacctcttacgtgccgatcaacgtctcatttcgccaaaagttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatttgaaaatgagggttcgggagtcatttacgcacggggaagggtgtttccctcgctcctatgtattcctcaattgcgatgaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 20520 - DNA, 161 bp, Glycine max
  Peptide Sequence Number=SeqID_112205
atggtggaggaagatcgaagcactgacgaacataacttatatcctcctcaagctaagagtcatctcgttgaggcgaaggagagggagtacgttcatcttgcggaggttgcacatccttcttcaaccattgctcatccatgtccttatggtagccgaaggag

SEQ ID NO: 20521 - DNA, 863 bp, Glycine max
  Peptide Sequence Number=SeqID_112206
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgattgcccggatgagcctgataactaccaaatgagcttgaagggtcgtcgtatcccccggagggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 20522 - DNA, 174 bp, Glycine max
  Peptide Sequence Number=SeqID_112207
atgcgcggagtcgccaccaacgtttattcgaggaaaacgtcggaaaaaccggaaaggtgtgctctacgaactttaagtgtgaaaggttcgggagttgtatttatgcacggagaagggtgtttcccttgctcctacgtattccttaattgtgataaggaaatccgacctacgtag

SEQ ID NO: 20523 - DNA, 462 bp, Glycine max
  Peptide Sequence Number=SeqID_112208
atggttgaagaagttatgagggtctatttagtatacttccaagatgtggaagcaatgtcttccaagggtacatcctttgtggtacaagtagagggtacatctacttgggttgttgtaactgagaacaagagatggtacatctcttgtggatcagttcaagtggagggtacatccacttggttgttcaaagagaacaagggatggtacatcccttgtggatctttgcttgtaaaggtttttacaaggttgaaagaaatctcaaggaccgcaggttgcttggggactggatgtatgcacggactcatcttctacttgaagtggtgtctccattcatctttctccttctccattacacttcaatcagacctcaagaagcaaaggaatccattgatgaagaagatccaaggcctaacagctccacatggagctacatcatgtggtatcaagagcctcttcatctag

SEQ ID NO: 20524 - DNA, 360 bp, Glycine max
  Peptide Sequence Number=SeqID_112209
atgtggtcatctgcaccctttccggagatgtcaacatcttccggtagagactattttagtctcacacctctttcgcaaaaactaggagcaaaagcctcgcttttgtcgactgccccacctttccctatcatgacctgggtaacatatggttatccacacctttggtcatctagagacggcaagttcgatgacatgcgggggtaccgtatggttatctgcacctttcgtcaaccaggagcaaaaaagcccgttgacgggcagggactaatgtcgtcctctgcaccttttgtcaaccaggagggaagcaagccctttgacgcgcagggactaacgtcgtcttctgcaccttttgtcatctag

SEQ ID NO: 20525 - DNA, 342 bp, Glycine max
  Peptide Sequence Number=SeqID_112210
atgaccctttcatcatggcagaacaagctaaacaggaccatggctactccacctggttcgcctcctcctcatcctcttcctcctgcagacccatcagcatcttcgtttaccgtgaagcggacacgcaaagcgacacggctacgatcattggccactagacaacctggtgcagggagactagtggtaactgttgatcctgataccggcaaggccgatggtccccacaagaagaaattaagaacatatttggggattgtcgcgcgtgataaggtcgacgtcacatacgagacttggaaggaagtccctactgctcagaaggatttgatatgggaggatatttag

SEQ ID NO: 20526 - DNA, 765 bp, Glycine max
  Peptide Sequence Number=SeqID_112211
atgttgcggaaccttacggattacataatcatcccttttttgccttccggaacgttacagaactttacggattgcgcactaacacttccttttaatttccggtatgtcacggaacttcacggattgtgctacaacgcttttcttttgatttccagcatgtctcggaacttcacgaattgcctaacgatgggtgccaaatacctcgaagtggtcaaacgagggtcgcatcccaacaacggatggtccccggacgaaattaggcaaagtttttataaaatatcaatgacatcttcgtcgtcatgttcatctaatatacaaattaagtctggtttaattgatggtgacattttatggatgcaagctaagcatgtttcaaaacatatttggaatggggaagaagacagaaaattacacatgagacgagttgtgcccatgtatcaaggacaagaagaaataccagaggaaattattcccctacttcgacaatctagtctccgtgtagatgggttaccgttaattggtccaacaaatcttgattgggttaatttatgtgaagaattgttaggagtcagaccacaagaaggtgaacttcaaggtagtaagattaaattaagttggttggctcaccattttccacagttaaataaccatgacggtaacctacaacaactagaaaggtttactcgtgcatggatccttagattcataggaggtgtcttatttgttgacaaaggcagtagcaaagtttccctaaggtacctgtaa

SEQ ID NO: 20527 - DNA, 174 bp, Glycine max
  Peptide Sequence Number=SeqID_112212
atggaagagaaggtagcttccttgagaagctttgttgataaaacttccttgagaagcttctttgagaaaacttccttgagaagctacagcttcgctacacacacccctctaataactaagctcacctccttgagaagcttccttgagaagattcataaagaagctagagattag

SEQ ID NO: 20528 - DNA, 388 bp, Glycine max
  Peptide Sequence Number=SeqID_112213
caatcactacgcatggctccaaactcgtggctgaaggatgcatgaacgaaaacggaattcatggggctctgaaaaagggtaaagcatggagaattgcactaagcaatcactacgcatggctccaaactcgtgggtgtaggatgcatgaacgaaaacgcaattcatggggctccgaaaaagggggtagagaatggataattgcactaaacaatcactacgcatggctccaaactgtggctgaaggatgcatgaacgaaaacggaattcatggggctctgaaaaagggtaaagcatggagaattgcactatgcaatcactacgcatggctccaaactcgtaggtggaggatgcatgaacgaaaacgcaattcatggggctccgagaaagg

SEQ ID NO: 20529 - DNA, 333 bp, Glycine max
  Peptide Sequence Number=SeqID_112214
atgtcagtctctggatgctatcaggcttttcgtcttacagataggaaaaagaatgtttatacggataaccactcgggtatttccgcccgtcagcgtgactcaaatgtcagtatgacagatcttgtgagcgtggaagatgaagtaaatctccgcttttcgtcttacagacagcaaaagaatgtttatacggataaccactcgggtatttccgcctgtcagcgtgactcaaatgtcagtatgacagatcttgtgtgcgcggaagatgacgtaaatctccgcgtgtcaacgggcttgtcggccgcgattgacgaaggatgcagaagacgacgttag

SEQ ID NO: 20530 - DNA, 175 bp, Glycine max
  Peptide Sequence Number=SeqID_112215
atgggggtgcaaatagcaatcaggcccacttgggccctccagaagattcctccaaaaggctccgaggcgcttccgaaacgtttccgtaacgttttccgtgaaggaatttcgcgaaggtttcgaccgttcttcgacgttcttcattcgttcttcatcgttcttcgatcttcaacgg

SEQ ID NO: 20531 - DNA, 360 bp, Glycine max
  Peptide Sequence Number=SeqID_112216
atgcacaaaaaaagatcttctgcaagtgatttgattcctattgatttggagattaacgccacttgtagaaggcgtaatcaagagagaattataaattttttgcaggacttagaggcagcagcaattccagaggaagaacctcaatcttctgaggcatcttctagttttccaattgcagaacattctcatttagatcctattgaagactacatcatggctgaagagccacgaagagttactctggaagattattcaagttctaatgtgccagagtttttcaccagcattgcacaaccaaaagttcaagcacaaaccattacttatccaccatcattgattcagtcagttgattcagaataa

SEQ ID NO: 20532 - DNA, 156 bp, Glycine max
  Peptide Sequence Number=SeqID_112217
atgccggaaatcaaaaggaagcattgttacacaattcgtgaggtccacttgggccttccaggaagttcttccagaatgcgagaactacgtaggtctgatttcctcttcgatggaggatacgtaggagcaaacaacccgcttttgtcgacctcgtga

SEQ ID NO: 20533 - DNA, 429 bp, Glycine max
  Peptide Sequence Number=SeqID_112218
atggcaagagtagaaaaagtggtcaagatctcggcacaagagttagaccgagtgaagcaaaacaggaatggggtggtagggataccaaggaagcgcttggaggaaagggcagaagctttggcaaatcaaggagagtggaccttgttcattgatatattagcactgttggtgtttgggatcatactctttccaaatgtagatgggctagtggatttagtagtgatcgacacttttcttgcttatcaccacagcaaggaaagtccagtcattgctgttttggccgatgcatatgacacatttgacttgagatgcgaaaagagcagtgcaagaattgtctattatacgtctgctctttatgtgtggttggtctcccatgtttttcatcatgaagctagacatgcttgctccctacaaggtcatcacatgtga

SEQ ID NO: 20534 - DNA, 411 bp, Glycine max
  Peptide Sequence Number=SeqID_112219
atgaaactggccaaatttaggctaaaggcccaagtggagaaggacgaaggcccaagtggagaaggacaaagcccccgagtggagaaggataaaggcccaagtggagaagaacgaagacccaagtggagaaggatgaaggcccaagtggagaaggatgaagatccagaggcagagacactatcaagacaattaattacttatcaaggtaatccttgtggcgtctaccctgacttatcttccttcactggaagtggcgtctacccagacttatcttccttcatcggaagtggcgtctaccctgacttatcttccttcattggaagtggcgtcatccaaaccttcgtagcctgtatcaaacgatccactcctactcaggttcacatcatctggtatcagagcttcggctcttga

SEQ ID NO: 20535 - DNA, 780 bp, Glycine max
  Peptide Sequence Number=SeqID_112220
gtgagcaagaacgaactggccccttcgttagggcgtgccgatgaggtattcctgttccagccgcaccacattccgtggcaggtcgcggacgttgcggacgcctgcattcagccggcgcactggagcgcggacattgatacgctggtggagatggtggctaaagcggcgcagccgggtgattcgattctggtgatgagcaacggcggctttggcgggattcatcagaaactgctggagcggttaggcgatctgccctcatcccagccttctcccgcaagcgggagaaggggccgtccggtgcggacgtcacattcagcgctcgtcctccgctacctcagcacaatgcttcagctaccccaacactgcgcttcagctacctcagcactgcgctttatatcccctctcccgcttgcgggagagggtgagggcagggcaaccgtccgcagcggacttacgcttcagccagctcgcgcaggtactggaaaatctggcgggcggcttttggcggcttactggcggctttctctttctgcgcgttgcggatcatactgcgcagctgctgacggtcagcgtgcggatagagattcagcacttccgccaccgcgtcatcaccctgttcgatcagccgatcgcgcagctgctccagcttgtggaacagcgcaacctgctggttgtggcggttcttcagcttatccagcgccaggcggattggctcttcgtcgcgctgacgcagcattttaccaatcagctgcagctggcggcggcggccttccttcttaa

SEQ ID NO: 20536 - DNA, 279 bp, Glycine max
  Peptide Sequence Number=SeqID_112221
atgaattcgcttagcgaggcagattggctaagcgagctgtcgcaacctatccttttgcgggcgagcgaggcgaggcacacgggtgcgtcttccaaaggaggaaaatgcgcggagtcgccaccaacgtttatttgtggaaaacgtcgaaaaaaccgaaggaaatcggtcatgaagaatattccagatttgggagttgtatttacgtttgaggaaggtcaacaaaagcggggctcttgctcctctgtaccctccatcgaagaggaaatcagacctacgtag

SEQ ID NO: 20537 - DNA, 744 bp, Glycine max
  Peptide Sequence Number=SeqID_112222
atggagctcattgagaatatggcagctagtgatcacgctgttttgcgtgataggacacacataccctccaaaagaaagacactcaacaaattgccaacacaactgcaagcagctcaaccatctcactcagcaattatgcaggctggaggctgcagtatttgcggagggactcaagaatcgggcaatcagttcaacaaggatcaaggagggtcttctaatagacctcctaatcaagggccaaacctgtatgtgagaaccgctaagctggaggacactttgactcaatttatgcaagtctcaatgtttaatcacaagagtactgagtcaaccattaagaacctagaaatccaagtggggcagctggctaaacaaatagctgaaagttcttcaggaggttttggagcaaacactgaaaagaatcccaaagaagagtgcaaagttgttatcactagaagaaaaaggggattgtctgtggaggatgagagtaggagcaatggaggagaattagaagttgagaaagagaaagagggagatcagatgggagagagaaaaataaatgaggttgatgaagtagaaaatgagaaaaatcacaaaaagagaaaaagtgagggggacgagataaaagagagtgaaaagaaaaagactaagagtgagctggtgaaggagaagaagaaaaaggttgtccccaactcaggaagggaagcaccataccctttggtgccgtctaaaaaagacaaggagtga

SEQ ID NO: 20538 - DNA, 652 bp, Glycine max
  Peptide Sequence Number=SeqID_112223
atggggacaaggggttgcattaattataatcccatcctcgccataagacaacttgactaccctatgagaggggcaccattagaggaagacctcacacctattattgaacgaggtttcaatagcaccaacgcggaggcgcttcagaaggttcgccaggcatgggagatgatgcaaaagaaggacaaggaactcagaggcagtagcaacgggcccatcggcggctaccataggtggttggaggcctacacacaaggtttggattggctcccaaatttgagaaccactaagggggtggaagttgaagctccggaggaggacgatgaggatttgcctaaggtccaagagaagcttgtcgtagcggttatgcgagatcgagaccaacatgttaaccatcgtcagcaagtaccaagaagaattaaatctagccaggcccacaagcacaaagtggcagatgaatatgcccgagtgtacgcggaaaaggaggctagaggaagggtgattgactcgttacatcaagaggcaacgatgtggatggaccgattttctcttactttgaacgggagtcaacaacttccccgattgctggccaaggccaaagcaatggcggatgcctactccgctcccgaggagatccacgaactcctcaactatt

SEQ ID NO: 20539 - DNA, 360 bp, Glycine max
  Peptide Sequence Number=SeqID_112224
atgaagcaaaaaattattgaaagtgctcatgttgtaagtacctctaaagacaagggcaaaagaaaaagaaatgaggagcccaagaatgaagcaactaagggtccaaaacaaaagaaacaaaatcaagcttcagtacctagaaacacttggtggttagattctggtgccactgctaacatcagtgtttcaatgcaaggttgcttaagctaccgaaaaccaattgattctgaaagatggatatatgttggagatgttaaatcggtggagcttcctatggtgaatcctttaatgcggaattgcgtggtactaagtgtagaattgataatacaaactcaggagcattatggcataagcgcttag

SEQ ID NO: 20540 - DNA, 1149 bp, Glycine max
  Peptide Sequence Number=SeqID_112225
atgacaccttcgaccgaagatgtgaaaagagcaacacaaggattgtttgttgtactacagctctttatgtatgagaaaggaggggcaaattgggaccaactcttagcaagcaaagaaggagcatctgtcaactggttccctcgatggaaggaaggaagaaccggagttcttatttcatgtggaggatttccaaatgttcccttgatggggacgaggggttgcatcagctacaatcccgttcttgctataagacaacttggctaccctatgagaagggcaccactagaggatgagctcgcacctgtcatttcacgaggcttcaataagaccaacgtggagacacttcaaaaggacaaggaactcaggggcagtaacaatgggcccatcgatggctatcgtaagtggttaaaagcccacgtgcaaggattggattggctcccaagtttgagaaccgctaaaagagaggaagttgaggcactggaggaagacgaagaagtgcaggcccttagggcggaactcgagcatgcccaaacagttaaagaaaggttcaaatcaacagctctgaaaatccgaaaagagaataccaaactgagagatgtaaatgtggctaccaccaaagccttggaacgagaaaccaagagggctcgtagggaagaacacggccggaacaagttccgaggggctctgtggggcagtaacagcgagcttaagctccggagagaggaaagggaccaatcgcaagtagacagtttgatcttgaaggatgagttgaaggcttgctcgaggtccaagagaagtttgtctcagcggttatgcgagacagagaccaacatgttagccatcatcagcaagtaccaagaagaactaaatctagccacggcccccgagcatagagtggcggacgagtatgcccaagtgtacacggaaaaggaggctagaggaagggtgatcgactcactacatcaagaggcaacgatgtggatggaccgattcgctcttaccttgaacgggaatcaagagcttccccgattgctagccaaagccaaagcaatggtggacacctactctacccccgaggagatccacggacttctcagctattgtcagcatatgatagacttaatggcccatataattagaaaccactag

SEQ ID NO: 20541 - DNA, 429 bp, Glycine max
  Peptide Sequence Number=SeqID_112226
atgaagcacttcactgacaccctcatcagtgccaacataagcaacgatgggacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 20542 - DNA, 207 bp, Glycine max
  Peptide Sequence Number=SeqID_112227
atgacttccaagattattttgattatgctaaagaatcaagagttaagaaaattccaaagattcaagaatcaagttttaagaatcaagattcaagattcaagaatcaagtttcaagaatcaagattcaagaataatcaagatcaagattcaagactcaagattcaagattcaagaatcaagagaagactcaatcaagataagtactaa

SEQ ID NO: 20543 - DNA, 208 bp, Glycine max
  Peptide Sequence Number=SeqID_112228
gtatagtctgcaagcttacccctatggcttgcctccagacttcgctccccgtgccgccctggaagatttaagccaagcccctaccttcgaggggcaactcccaccttatgacgactatcccgtgcaagacgatgaggaaggaaatatctcggccccctgctccacctcaaagatccatccccccatgaactaccccaaccaaacataa

SEQ ID NO: 20544 - DNA, 318 bp, Glycine max
  Peptide Sequence Number=SeqID_112229
atggaggccatgaaagaccaaatgactaccatgatggaggctatgatgagcatgaggaaaatgatggaggtcagtgcggctgcagttgccattacaagtgtcgccactaaggtagacccgactcacccatctggtgtgaatcaagtccaaagcaagcatccgttcccaccatatagcctatctcccaactatacaccacccaatgttgtacatgtgcctgatgagaacatcgaccactccgctcctataccccttgagagccaacaacctcagtctgggcacgcgcatgtcgctcaacccatgggggagacacatgaa

SEQ ID NO: 20545 - DNA, 213 bp, Glycine max
  Peptide Sequence Number=SeqID_112230
atgggggtgcaaatagcaaccaggcccacttgggtcttccagaatgttcctccagaaggcggttgctactggaggaagcaacctagctcgcctgggcgagctagaaaatctaagccgaagcgcttccgtaacgtttctgtgggtgatttcatgaagattttcaaccgttcctcgtcgttcgtttttcgtcgttcttcggtcttcaaccggtaa

SEQ ID NO: 20546 - DNA, 135 bp, Glycine max
  Peptide Sequence Number=SeqID_112231
atggcggatgcgcttgctactctggtgtcgcaacctacccttttgcgggcaagcgaggcgaggctctcgggtcaacaaaagcgaggctcttgctcctacgtaccctccatcgaagagaaaatcagacctacgtag

SEQ ID NO: 20547 - DNA, 179 bp, Glycine max
  Peptide Sequence Number=SeqID_112232
atggattctgctgcctcaaagcacatttgtagagatcgagagatgtttgacattttgaaaaccgatggagaatttgactgtttcaagttaggtaatggtggaaaaatgaaggttgaaggcatagggagtgtgagaatgaagctccatgatggtgctattcgaattttctcaaatgtgag

SEQ ID NO: 20548 - DNA, 384 bp, Glycine max
  Peptide Sequence Number=SeqID_112233
atgggataccaattgggaaagagggtttttagtttatgtaaagaactcaaaaacttcgacatccttaccttcaggaacactcgaaaggtggcaacgccactaaaaaaggcacgactttggctacgtggcggtggtgggagcagcaggtccacttcggcttcaagtagcggtggtgggagcagcgggaaacaaaacgtcagggtggtagcgggacggagttcacggcgggatgaagtagttcaggcaatagtgggggtgctaggtttttggagggacggtgtacctacaagcaccgtctttgatgacttccatcaaaactacaacgacagggttatagacaaatgtcgttgtacaacaaatgcgccacataaaaaacttatataa

SEQ ID NO: 20549 - DNA, 153 bp, Glycine max
  Peptide Sequence Number=SeqID_112234
atggagaaatttgagaataaaaacattggagaaaagaaggcaaagaaggcctacatcacatgggatgataatgacttagaatcgtctgatgattctgaaaaagaagtgattaatctatgtctaatgggcaaaaattatgaaagcgagaaagag

SEQ ID NO: 20550 - DNA, 597 bp, Glycine max
  Peptide Sequence Number=SeqID_112235
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcttgcttcaagctagagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 20551 - DNA, 905 bp, Glycine max
  Peptide Sequence Number=SeqID_112236
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggcttccagagtagaagtgggtcgttccattctcagtgccaaatccaaattcataccgtcgagaataatttctaaggcttccttccagaccttaaaatttgtccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 20552 - DNA, 138 bp, Glycine max
  Peptide Sequence Number=SeqID_112237
atggcaaattctgatgcaatcctccctaggaagggaccagtcactagaaccatgagcaagaggcaccaagaagattgggctagagctgttgaagaaggccctaggattctcatgaacctcaggggctccatattgtag

SEQ ID NO: 20553 - DNA, 339 bp, Glycine max
  Peptide Sequence Number=SeqID_112238
atgaacaaatatgaggaacaaggaattaaagagaattcaccgaacaaaaagatagaggaagcaaaagaacatcacctagatgaagatgctctgataccacatgatgtaagctccattggagcctgtaggcctaggatcttcttcatcaatggattcctttgcttcttggaagatgaatggaagcggaagagagagaggagatgccacttcaaggagaagatgagtctagaagaagctcaccaccataggaggccatggataagagcttggaggaagaatgagatggctgaagggagagaaagagaagagcatgaaattttatgctctaaaaagctttga

SEQ ID NO: 20554 - DNA, 753 bp, Glycine max
  misc_feature (36)..(36): n is a, c, g, or t
  Peptide Sequence Number=SeqID_112239
ggcttcccggtatcaacagggacaccaggatttatntattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgacctcgtgagatggttagaggtccagcgcctcaacttttctcaccaaaaagaactatgtaggtctgatttcctctccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 20555 - DNA, 707 bp, Glycine max
  Peptide Sequence Number=SeqID_112240
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagatacgggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 20556 - DNA, 696 bp, Glycine max
  Peptide Sequence Number=SeqID_112241
atggcttcaaagagaagaaaatcatctgcttcttattcttcccacattagatttgacagatcaagattccattcacaggaagcttgggacagatataatgacattgttgttcctaggaagctattgctagagagaaatgaggtaatctaccacactgaatttgatgagttcaaggaggaattggagagaagaaaatgggatgaagaactgactagctttgatgaaggcaacattgatgttgccatagtaaaagaattatatgctaacctctatgatccagaggacaaatcaccaaaacaggtgagggtcagaggtcatttgataaaatttgatgaagacaccctcaacacattcctgaagacccctgtgatcattgaggagggggagacattaccaacctactctagatttgcactcttgaggcctgatcctcaagagttagctgctaagctttgcatctcagggaggggatttgagctgaatgctgatggtcagcctttgaagatcttaaggaagaacatgaccaccctcgctcagacttggagtgttctttcttactccaacttggtccctacctcccacacttctgatatcacattggatcgggttaagttgatttatggcattattatgaagatggacatgaacctgggctacctcatctcccaccaagatttctatcattgcccagcatga

SEQ ID NO: 20557 - DNA, 237 bp, Glycine max
  Peptide Sequence Number=SeqID_112242
atggctccaaagaaactcacctctaagggagctaggaagaccattgcaggagaaggttctagcacagctccacctgtagaaattgaatttgatggacaccactttcgtagtgaggaacatcagcaccgctttgaagtgatcaaagattggtctttcctcaaggaaataagggtccaattagctgagggtgagtatattgaattccaagcagagattgctaggaggcactggacatag

SEQ ID NO: 20558 - DNA, 1266 bp, Glycine max
  Peptide Sequence Number=SeqID_112243
atgggaaagttgttgcacttttctgccatgggatccacaatcttcattctcttggggctggtagttacagtttacggttttgtggactatggtagtagctctttgtcaagactcaaggttttggaagttgagagaaaattaaagcagcttagaggacattccttaaaaactatccagagtgaagatggggatatcattgattgcattgacattaataagcaaccagcttttgatcatcctgcattgaaaggtcacaaaatccagatggctcccacttataattcagctaagaaggacatgacaatagggaccaaaactactagaactagaaaaaatgcaaagagtggcaaaatgatgaagcaaagggatgaagggtcatctgtgactgtgacttcccaagtgtggcagaaaagtggaagatgtccagagggaacaatacctgttcgaagaatacaagaaagagacatgataaaggctcattcaattgaagattatggaaggaagaagccaagcttctctcatcaacatgttggtcaactgaataataatctcgactcctttgtacaactgaaaaaccactctaaagcaatagcattggcagttgggttccgttacttgggagccaaaggagacatcaaagtggacaacccttctgttgaaaaggatgatgaatacagcacttcccaagtatctctcttaacagggccatacaatgactttgagtgtgttgaagctggttgggcggtcaatcccagtgtgtatggagataggcaaactcggttatttgtttactggacgattagcaatgaaattgctttaggtgctgcaatttatccgatatcaattcctggtgggcttcaatacataataactatttacatctataaggatccctataccaataattggtgggtgcaatatggtgagaataccaacataggttattggccacctgagttatttgaaacaatacgttacaatgcagaatctgtggagtggggtggtgaagtttacagttccactattgggcatactcctcacactgcaacacaaatgggtaatggacaatttgcttcagtttttggtgagtcgtctacaataacaagaatgagaattcatgacaactctgcagccttgaagatcccagaatatgttgctgaattcacggatgaatttaactgctatgatgtttggtatttgtcagattatgttgaagatcctgagttatattacggagggcctggtcaaaatccaaaatgcccttaa

SEQ ID NO: 20559 - DNA, 1071 bp, Glycine max
  Peptide Sequence Number=SeqID_112244
atgcaatcaagggttttgacccttgaagagggaaaggagagaatcaaccaatctaataagcctttgagaccagtgcggttacttgtgttgttttttgctctatgtgttctgttctcagtgatcagcatatacactgttaagcattttggaattgagagtgtggtgaccacaatgagttctagttttcagccatgttattatgaggaacctggtggtttggataagtggattaggccaccttcaagcctgatccacaatatgagtgacgaagagcttctttggagggcttcctttgttccaaggatcaagggttacccttatcctagagttcccaagattgcattcatgttcttgaccaagggaccattgcctctggcacccctttgggagaggtttctcaaggggcatgagaagcaaatccctagccaggtttctgagtggggaaggatgagcatgtgcgatgctgaaagaagactccttgctaatgcattgcttgatatctccaacgagtggtttattctgctgtctgaatcatgcatccccctctacaatttcagctttgtctaccactacataatgaaatccaagcacagcttcgtgggtgcatttgatgatcccggtccatacggaagagggcgctacaacgagcacatggcccctctggtgaatgtcaccaagtggcgcaagggctctcaatggttcgaagtaaaccggaagctcgccatcaccatagttgaagacactacatttcatccaatatttgaacaatattgtaggccggcttgttacgttgatgagcactatttccccaccatgctcaccattcaagcagccaatgtgttggcgaacaggagcataacttgggtggactggtctaggggtggagctcaccctgctacatttggaagaaatgatatcactgaggagtttttcaatcgagttcgcagaggtcacacttgcctatacaacaatagaaactcttcagtttgtgctctttttgccagaaaatttgctcctagtgctttggaacctttgttacatatggtggattcaaaggttttggacttttga

SEQ ID NO: 20560 - DNA, 477 bp, Glycine max
  Peptide Sequence Number=SeqID_112245
atggtttatgaatttatttatccacctgtagatattgatttgtatgttcaggtcaaggaccccaagttttggagacacagaccattatctgaacaaatggtccgtgctgctgctgatgatgttcgttttcttctctacatttatcaccaaatgatggagaaattaaatgagcggtctttatggtatctcgcagttcgtggtgtcttgtattgccgatgtttctgtttgaacagtaacaattttgctgattggccatctctacctccgattccagataacctgaatgctgatggaagtgatcccaaggaagaaattctttcagttcttgatattccccaaggaaagatgggacttgttattgggaaaagaggggcaacaattttgtcaattaagcagtcttgcaatgccgaaattctcacgggaggtcccaagggcccacctgacaaggttcgtatatcagcatcatgtaccatgtga

SEQ ID NO: 20561 - DNA, 480 bp, Glycine max
  Peptide Sequence Number=SeqID_112246
atggcttcttcttctccctctcactcatatctcacacatcttcctcttcatccctctcaccaaggtgatagtgagaagcgcgtggaggacgatgaatcgcgcgttccgattcacatcgtgacggcggcgtcgcaacttcccgtcgaatttctggaaccctcgcctcaatcgaagctcgtcatcggctttgactgcgagggcgttgacttgtgccgcaaaggcactctctgcgtaatgcagcttgcgtttccggatgctgtctacttggttgatgcgattgaagggggagaggagcttatcatagcgtgtaagcctgcacttgagtctaattacatcacaaaagtgattcatgattgcaaacgggacagtgaggcattgtactttcagtttggcatcaagttgaacaacgtagtggatacccagtttttagtctatcttcaatataccggacgtgcctatcagcctatcaactttacatga

SEQ ID NO: 20562 - DNA, 375 bp, Glycine max
  Peptide Sequence Number=SeqID_112247
atggtgaaagttggaacctcttacgtgccgatcaacgtctcattttcgccaaaagttggcccagggcttcccggtatcaacagggacacccaggatttatttattctgcgaagtgatctttccgtcacagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 20563 - DNA, 1467 bp, Glycine max
  Peptide Sequence Number=SeqID_112248
atgtcgcgagcaagatcacgctcaccgtcaccgtgctgcggtgacactcacttagtgctgctgctgcctgtgatgctcgctgttttcttccactcgctccttctgcttcctcactcctcgctcgctattcgccctaccgagtcggatcggatcgaactcgccaacgcgaccgagtccagcagcaacgcctccctctcgcgccctcgcgaaggaaccttcgccgacatgattgatcgcgcgctcgagcacgagttcaccgagaacgaccagaatgaagaagcggttttaacgctttgtttgttcttctttgtgctagcagcgcctgatccgggaagcttcaacaacagtgtagcagaacaacaggctgttctggaaactgtggccagagtcacaccaaacaagaatgacacgaaagatgaaaagtcatttcaactacatcatgtattcaatagagctgaggaaaccccaatgttgatagatcgaaaggacaatgtctttatcatttctaactttaaatccaagtatcccgtgctccagctagatttacgattgatttcagacctggtagttgctattgtttcagcaacttgtggtggcgttgcatttgcttttgctggacaaccggtcattaccggatatcttttagctggctccatagttggacctggcggctttaacttcatcagtgaaatggtgcagctatgtggtggtaaagcttcagaaggggtttttgttggtgctttcctttccatgtcttcaacagcagtggtcttgaagtttttgatggaaaagaacaccactaatgctcttcatggacaagtcacaattgggaccctgattttgcaggattgtgctgttggattgctctttgcattgcttccagttctgggtggcacctcaggtgtttttcaaggagtgttatcaatgaccaagctcgataagctgggactaagtctagaactaggttcctttgctgctggagtgatgattgcaaccactgatttggctcaacatacactagagcaaattgaacctattcgcaatctttttgctgctcttttccttgccagcattggaatgctgattcatgttcattttctctggaaccatgttgatattttggtagcatctgtaatattggtgattgttataaaaacaatcataattgcatctgttgtgaaaggatttggttacaataacaagacttctatacttgttggaatgtcgatggcacagataggagaatttgcttttgttcttctcagtcgtgcttcaaaccttcatctagttgaggtgacaactcctttacttttcaagctaattcctgctgtagtgcatcttggtgtcctactgagatggttctctcctgatagttcagtggagattggatataagctagataacctccgctcagatagtggtaagcagcggataattttgatggaccaagaatctcatgattcttaa

SEQ ID NO: 20564 - DNA, 330 bp, Glycine max
  Peptide Sequence Number=SeqID_112249
atggcatgtaagattattacaaagaaagatgagaatcacttacaaactcaattctgcaaatgctcatccaaccacattgagaattgcaaaaaggtgtatttacttggtggggaatttgcgaacgaggccaaagcaatcaagttggaagagaaagaacaaggggaggaacttggtaaggaggatggggtcttcgggaaagttcatggtggagttggcacaacgattcaagctttgacaagagttgttgggcaacttagtgacgttcacaagactcataagcttttcacgagaagtcgctaccatgcacattgttttttcgaccttggctga

SEQ ID NO: 20565 - DNA, 2130 bp, Glycine max
  Peptide Sequence Number=SeqID_112250
atggagaatgcagacatccctgagaatgccaacgagcattgcccaggtcctcagtctgaatctgctggaaaatctgatgcatgtgaagggtgcccgaatcaacaaatttgtgccactgcccccaaaggacctgaccctgatctggttgccattgcagaaagaatggctactgtgaaacataagatattggtcttgtcaggaaagggaggagttggcaagagcacgttctctgcccaactggcgtttgctttagctgcaagggattttcaggtgggtcttcttgacgttgatatttgtggtccaagcattccaaagatgcttggcctagaaggtcaagagatacatcagagcaaccttggttggtcccctgtctatgtagagtccaaccttggggtcatgtcaattgggttcatgcttcccaatccagatgaagctgttatatggagaggcccacgcaaaaatgcacttatcaagcagtttctaaaagatgtctactggggagaacttgattttctaattgttgatgctccaccaggaacctcagatgaacacatttccattgttcaattccttgatgccactggagtagatggtgcaatcatagttactacacctcaacaagtctctcttattgatgtgagaaaagaagtgaatttttgcaagaaagttggcgtgaaagttctcggggttgtagagaatatgagtggcctgtgccagcctatcacagatttcaagtttatgaagttgaccgataatggcgagcagaaagatgttacacagtgggtttgggaatacatgagagaaaaagcaccagaaatgctgaatttgcttgcttgcactgaagtgtttgatagtagtggtggtggagcagtgaaaatgagcaatgatatgggggtaccctttcttggtaatgttcctttagatccacagctttgtaaggcagctgaagaaggttcatcctgctttgctaagaaagattgtgttgttagtgctccagcactaaacaagattatagagcagttgattgaaactaatgggtggtcaatgttagatctctggtccctcccgcgcctcttctcagagtcgcttaatttacagtctttacgcgaatcctttacgagctcgagctgtgacagaacggagtcggagcaatgccgcgacgagtcggcggcgatggttctgaaattcgtggcggtggcgtcgattctggtcgccggattcgggggagtctcgattccgctggtcgggaagtcgcggcggtttcttcgaccggacggcgacgttttcgcggcggcgaaggcgttcgcggcgggggtgattttagcgacggggttcgtccacatgctgagggactcgtgggacgcgcttcgggagccgtgcttggggacgcactcgcgcgcgtgggcgaagtttcccttcaccggtttcttcgccatggtgtcagcgctctttactctactggttgactttttagcgacggaatattacgagcgcagagaggcgcgtgggcgcgtggagcgagggaaggttgttgattatgatgaaggttgtgacgaggcgttgttggaaacgggaatcgtggaggttaaggatcttgggcgagggggaagacactcccactctcacgacggcgatgatgtggaaagtagtgttcgacacgtcgtcgtttcacaggtattggaacttgggattgtatcacattcgatgataattgggttatctctaggagtttcacaaagtccctgtaccatgaaacccctaattgtggcattatccttccatcaattctttgaaggatttgcacttggtggttgcatctcccaagcccaattcaagaccttatcagcaacaataatgtcatgtttttttgcactaacaacgccacttggtgttgctattggagctagtgttgcttcaatttttaacccttacagtccagtagcactcatcactgaaggcatcttggacgccttgtcagctgggattttagtgtatatggctttagtggacttaatagctgcagattttcttagcaagaaaatgcgttgtaactttaggtttcagataatatgttactgtctgcttttccttggggctggattgatgtcttcacttgcaatttgggcatga

SEQ ID NO: 20566 - DNA, 1323 bp, Glycine max
  Peptide Sequence Number=SeqID_112251
atgtccaatttgacgtctgcatccagtgaaataagtgctacttctggaatcaggaataacaacggttcttctctctatgctcaatattcctctacttcaataagtcaagaaccagaacctaaaaagaagcgaagtcttccaggtcacccagaccctgaggcagaagtgatagcattgactccgaagacccttttggcaacaaacaggttcgtttgtgagatttgccagaaagggttccagagagaccagaatctgcagcttcatagaagagggcacaatttgccatggaagctgaagaaaaagagtagcaaaaacgtgagaaagaaagtgtatgtgtgcccagaggcaacatgcgttcaccatgacccttcaagggcacttggggacctcactggaatcaagaaacacttcttcaggaaacacggagagaagaaatggaagtgtgacaagtgcttcaaacgctacgcggttcaatcagattggaaagcccactccaaaatctgtggcaccagagagtataaatgcgactgtggtacccttttctcaagaagggacagctttatcactcacagagccttctgtgatgccttagcacaggaaagtggtagaacagtgaaccctcttctagatctatcaactcaatttcgtagccatggccttcaacttcaagcaccatcatcacttctgatgaaaggagaacatgatcatcacttcaacttattaaacccagaaattccatcatggttattaagttctccaacagtggtagtagaagaagaagcactccacaacagtagtcaaaccataagatccaccttagataatttctccacaataccacagttattattcccaacagcacaacatgtcaacaactaccactcctcctcattagtccaccatgatcaaaaccctaaccctagtactactacaacaacaacatcatcaaccactttgcttccttctttgagtacttctttccattcttcttcttcttttcctcacatgtcagccactgctttgttgcaaaaagcctcacaaataggggtaacagtgagttgtagtactgctgcaccttcatcacaaacgatgatgctggttagaccccacttgttactgcatcagcaggttcacgtgcctgaatgttcaacaacaacagcaattgcaacaacaggaactactcttgggtataataataataataataataataataataataatatggcttcatcttcagccgtttcttctggaatgtttgttatgccttcacgtgaagaaatagggactactcttgggtttgctcgtggcttggcatcttga

SEQ ID NO: 20567 - DNA, 1587 bp, Glycine max
  Peptide Sequence Number=SeqID_112252
atgacaagtgttgatttatccgctgcagcacctatgtactacaaaggagtttaccactttttctaccaacataacccctatgcaccaacctttggcgagaaaatggtgtgggctcactctgtgtcctatgatctcatcaattggattcatctgaatcatgccattgaaccaagtgattcctatgacatcaacagctgctggtcaggctcagccacaatactcccaggtgaagaagaacaacctgttattttgtacacaggaattgataacaataaatatcaagttcagaacatggctatgccaaaggatctatcagaccctttcttaagggaatgggtgaaacaccctcagaaccctgccatgacaccaccaagtggtgttgaagtgaataacttcagagacccttcaactgcttggcagggaaaggatggaaaatggagggtagtcattggtgctcaaaatggggatgaagggaagacaattctctaccaaagtgaggattttgttaattggagagtggaattgaaccctttttttgcaacagataacactggagtttgtgagtgtccagatttttttcctgtgtccatcaatagcacaaatggggtggatgcatctgtccaaagtcaaagtgttagacatgtcttgaagataagctatctacgtagacatcaggactattattttcttggtaaatatgtctatgatgaggggaactttgttcctgatgttaaattcacaggaactagttcggacttaaggcttgactatggtaagttttatgcttcaaagtcattttttgaccatgctaagaacaggaggatattgtgggggtgggtgaacgagtgtgacactagacaaaatgacattgagaaaggatgggctggtctacagtgtattccaaggcaagtttggcttgatgaaagtgggaagcagttgatgcagtggccaattgaagaaatagaaaaactacgcgacaaacaaattagcatattgggggagaaactggttggtggatcaattattgaagtctcaggtatcactgcatcacaggccgatgtagaagtgttgtttgagctacccgaactagagaatgtggagtggctagatgaaagtgaagttgatccccacttgctgtgtagtgaagagtatgcaacaagaagtggcacaatagggccatttggtttgttagctttagcttctgaggaccaaacagaacacactgcagtgttcttcagaatatatagagcttccaatagatatatatgcttcatgtgcagtgaccaaagcaggtcttcattgcggcaggaccttgataaaaccacatatggaacaatctttgacattgaccctaatgtcaaaacgatttcacttagaagtttgattgaccgctcaattattgagagttttggggagaaagggagaatttgtattaccagtagagtttatccctcgatgtctatagacaaaaatgcacatctttatgtgttcaacaatggaagccagagtgtggtgatctctgaactgaatgcttggagcatgaagcaagcagaatttggccaagaagaaagcataaataagcagtag

SEQ ID NO: 20568 - DNA, 516 bp, Glycine max
  Peptide Sequence Number=SeqID_112253
atgacaaccaatccagtgagtgattcatcccgtgatgataaactgaacggagccaaaccacaaatcacacccttatcactctcacaatcacatccttatgctatcacgggcgccgacttggacgagtttggggacgaggtggccggagacgtggagggcgacgagggactcgaggccgccgacggaggagcctccgatgaagacggcgggggtgcggtggtcggggagggggagggcggcgatctcgtggtcgtccaattcgatgacggtggggttgacgccgatggtggcgaggagcttcttcatgacgtggcacatgcagcaggaggagcgcgtgaagattatgacgggagagaacaagaagaggagaaagaagaagagtttgtgttgtttgtggtggtggtggtggtggtggtggttgttgttggggtggagaggtctagctggacgacgtcgtttgagcagcggcgcaggccttgcatcgttgaattgagtgaggaaaaaaaggacaagtag

SEQ ID NO: 20569 - DNA, 561 bp, Glycine max
  Peptide Sequence Number=SeqID_112254
atggtagaaccctcaaataagagaaagggatcatcctccaccatcaccgttgtaggccaacgccaccacggcacatccaatgacccaccagcaccacctcttccttctttttcttctccaaggtcattgactctattttcttcggatgaccagcgtcaaagtcagggtgttccttttgagggcactctagttgatgataggaagcatgtctattctagtcatgatgcccttaaaatggcctctgaggaggatttaatcttgctattggctcttcaaaacggttggcaaattgactgggcccatcttgtccggtactgtatgcataaggcattacgggtcaatgcacctcttccgtatcctcatcttatcactttgtttcttcaacatttcaatgttcttttagaggatgaacattttgttaaggttaaaagatcattttctattggtgctggtgctattacctcctttggataccagaaggatagggatggccaatgggtgcataaacaagacctgccacctcccattcccgatgaacgcacaccctctccaccaccgtag

SEQ ID NO: 20570 - DNA, 768 bp, Glycine max
  Peptide Sequence Number=SeqID_112255
atgtgggtcataaggtcttatgctttaaacaaaacctgggtggtaggttttctaatagatatatttggggcattattgatgttaagggcattgtctctggctccagtctctgtcatccaaccagtttctggctgtggactagcaattctttcaatcttttctcatttttatctcaaggaagtcatgaatgctgttgattgggttggcattacattagcaggttttggcacaatagtgtctgaggaccttagcaatgaaccaatttttttctggagtattcctcttttttattatttggctgctgacaaaaccaagtttgcaatgaaaggagttggtgctggaggtgaggagcaagaggtggttgctctatctatttttcacataccagggctggcatttattgttttcatcttgtttgtaggctttaagacttctctatacttcttagtggatggcttcgaatatgcaagcgccaacgaagagaacaagagatggatgtcatctgtaatatcaaagatgggatttctattcctagagcaaggctttcccaagctgttggttcctatgtgcatcatgatcagcgtgtgttgtagtggcacaggcatttactaccagacacgtggtctaaagcatgggagggctattgtagtttccacatgtgcagctgtggcctcaattttgactggtgttcttgctgggatgcttgctttgggtgaacgacttccttcggagccaaaagctcgcttggcacttcttcttggatggtaa

SEQ ID NO: 20571 - DNA, 1287 bp, Glycine max
  Peptide Sequence Number=SeqID_112256
atgggtgcatcggaaaggaatgggacttgggagattgtagagagaccgaaagataaaaaggcagtgggttgtagggatacatccaaacctatgggatcgattatgaggagacatttgctcagtggcaaaaatgaatacagtcaggatcatcatctccttagcagcaagcacaatttggttgggagatgcatcaatttgatgttaaaaatgccttcttacatggaagcttggaagaagaatctcctcgggcttggtttggtaggttcactcaagctatgttatctttggggtacaagcaaagccaaggtttctaatgaagaggctaagaaagtagagatttccaaacttcaaaagatgttagaagctctgaatcttgaattggatgcagctaaattggcaaaaattaatgagtgcaacaagaatgctgttctgcaaaatcaatttgaattgtcagtaaaggaaaagtctgctttaaaaagagagctagttgcagtggatgaattacgaaaggaaaatgctcaattaaaggttccattggatgcatttgaaaagaagtgcacaaccttagagcttgagcttatgaatgctcaaaaaggccgggatgaaaccatggagaaactgagagagtctgaacagaagtgctctcaacttgagcaaaatgagaaaaggcttgaggaaaagctattgaatttagaggatgaaaatcatgttcttcgtcagaaagccttaagtacccctcttaagagtaaccgtccaggttttgccaagtcaatatcagaagagtcacccacacccacaaaacttattgccccttttacactaagcttgccagactctcgtcgatctaataagttaacagcagagaggcagcaggtagatcctgttgcacctatgttctgtcttaaatcctacacctttagttttgggcatcctgctatttcagaagaacttgtggaatacagaggatgtgaagagggtcataagtatttcttggggaagcaaaattggactatgatatggagagtggagaccaattccagaaattccattgagaaatatctacccccatgtagaatcgaaaccggagtagactcgtccgatttagcgcagactcgggcgagtttaggtagactcgcgagtctgcgacgagtccgcaactgctactcaccgctgttcactcgcatcgtcatcgctggccctcagtcgcggtcctccatcgtcatcggccgtcgctgcctcgctggtcctcacttgcgctccaagctttgcttcacgtcacaacgctaa

SEQ ID NO: 20572 - DNA, 300 bp, Glycine max
  Peptide Sequence Number=SeqID_112257
atggcgaaacggctggattgggtatttatatcgcggtttattacctttagcaagattatggcatcgtttcaggaagggaggaaggtctcggaaagggatatgcgaaaacattcaagggataatgaagccagcgattcagagattggtgagaaaaggaggtgtaaagaggatcacttggaaaatgtgattcatgatgcagtgacttacactgaactcgccaagaggatgacggtgactgcaatgaatgtggtttatgccctcaacaggcaagaaaaaaccctctatggctttgaattttaa

SEQ ID NO: 20573 - DNA, 2970 bp, Glycine max
  Peptide Sequence Number=SeqID_112258
atgaaggaaggagacatcattttcggaaacgtcgtcgtttccgacgacgacgacggcgacggagacggaaacgatacccgcggcgacgataagcaattcgcgatggtccgcgccgatgtattgggctcgtggcccggcgagagcagctccaccgccgccgccgagtgtttggatatcgccgccgccggcgagagccgcgatttgagcaacaagcgcgccaagttctacgccgacttcgaggagcatcacttttcaaccgggaagtgcagtgcatctaatgaatacgttgattataactttagtattaaaggcactcttcgacccaacggtgagacttgctatgatgcattttcattgatgggtgttgttgaagagaatagtagtggcttcgattcccgcattgtgaaagagggtggtgagggagatgatagcgatatctcgaaagtggaagaagatgtagaggtcagaatggatctcaccgatgacttgttgcatatggttttttcgtttttggatcatcccaatctctgcaaagctgccagggtttgtaagcagtggcgaggtgccagtgctcatgaagatttctggaaaagtttgaattttgaagatcggaacatatctgtagaacaatttgaggacatgtgtagccgttatcctaatgccacagcagtgagcttatctggttctgctatttacttgcttgtcatgaaggccatctgttcattaaggaatctagagtttctaacattaggaaggggacagatagctgatacttttttccatgctttagctgattgttctatgttgagaagattgaatatcaatgattctatacttggcaacggcattcaggagataactattaatcatgacagattgtgtcatcttcaattaacaaaatgccgtgtgatgcgaatagcagtcaggtgcccacaacttgaaactatgtcgttgaagcgcagtaacatggcacaggttgtgcttaattgtccacttttgcatgagcttgatattggctcttgccacaaacttcctgatgccgcgatacgagctgctgcaacttcatgccctcaactggtctcactggacatgtcaaattgttcatgtgtcagtgatgaaactctgcgtgaaatagcattgagttgtgctaaccttagttttcttgatgcatcatactgctcaaacatatctttggagtctgttagactgccaatgttaacagttttaaagctccatagctgcgaaggcattacttctgcctcaatggctgcaatagctcatagttatatgttggaggttttggagcttgacaattgcagcctgttgacttcagtgtctttggatcttcctcgtttgcagactattagattggtacactgtcgcaaatttgctgatttgaacatgagaactatgatgctttcttctatactggtatcaaactgccctgcactccatcgtatcaacatcacttcaaattcacttcaaaaattagccttgcaaaagcaagatagtttaaccatgctagctctgcaatgccaatctttacaagaagtggacctctcagagtgtgaatctttgacaaactctatatgtgatgtttttagtgatggtggaggatgccctatgctgaaatcactagttcttgataattgtgagagcttgacatccgttcggttcatcagcacctctttggtcagtctttcccttggtggttgtcgggcaattacttctcttgagctcacatgccctaaccttgagaaagtcattttggatggctgtgatcatttggaaagagcatccttttgtcctgttggccttcggtctctcaatttaggaatatgtccaaaattgaatatactcagcatagaagccatgtttatggtctcacttgagttgaaaggatgtggtgttctgtccgaggcatcacttaattgtcctctcttgacatctttggatgcttccttttgcagccaactcactgatgaatgcttgtctgcaacaacggcctcctgcccattgattgagtcattaatattgatgtcatgcccatcgattggtttagatggactttgttctttgcgttggctccctaatttaaccctgctggatttatcgtacacttttttggtcaatttgcagcctatttttgagtcttgttcacagctaaaggaatgtagatgtttcacattggatagaattgtagccagtataatccttataagacatatgcattcctcctcccttaagccagcttttgggagtgagtcagttctggtattaaagttacaggcatgcaaatatctcactgactcatcacttgagcctctttacaaaggtgctttaccagtacttcaggagttggacttgtcttatggaacactgtgtcagtcggccatagaggagcttctttcttgctgcacacaccttacacgtgtgagcttgaatggctgtgccaatatgcatgatttaaactggggatgcagtcgtgcgcatactgctgaattgcctggtgtaaatgtcctacccattgcaagttcccctgaaaatgtcctcgagttaagtgagcaacccatccggttactgcagaacctaaactgtgtgggatgtccgaacattcggaaggttttcattccatcaacggcacattgttcccgtttgttatttttaaacctttctctatcagctaatttgaaggaagttgatgtagcttgtctcaacctaagctggcttaatctaagcaattgttcctctttggaagttttgaagctagagtgtccgagattgaccagtctattccttcagtcttgcaacattaatgaggaagctgttgaggctgctatatcaaaatgcactatgctggagactcttgatgttcgcttctgtccaaagataagctcaatgagcatgggaagattgcgtgcagcatgttctagtttgaagcgtatattcagcagcttgtcagcttcataa

SEQ ID NO: 20574 - DNA, 3096 bp, Glycine max
  Peptide Sequence Number=SeqID_112259
atggagttccacctagcatgtcatgtgtattttgtggactttagatggtacataagccccctaagctctaagccaacttgtgggagaaagaggttgtccagtgtcaagcatggatgggtgttattcgatgtcgagagtggtaacctcgacaagtgcaagagttgcaggatggacatgcttttggttttgcaagcgaaactagacgtgttaggcgtgtgcggcgtacgcgcagtactcttgcatacatgtcactcatggaatgggcatatactggaggcgtggtgcatgggtaaatttcttctaacaatgtctttctttctttttgattccaccattggtatggggtgtagtgactttgggttcgatttagcaacccctggtagaccgagaggtcaacttcatcggtggttcctcctcggaggagactcgtgtggggcttctaacaacgaatcatcttccttagaaaggttgagggtttcacgccgtgttgggagagtgaggaagagtggtggcggggatgttagggggtcccctggtgtgcgatgtagccatagtgttgggtcattgtcgtccccccctgtcgtcgctggctttgaatgggtgagggatgacattttaaaatacaagtcctccatcacctctatggcgagctttgttgctctgcaatgccaagtgaaatatgcaagccctgaggactcttgcaagctagtcattcaggcttgtgggatcccatgtttctctttggacccatcgcaattgccattgatggtggtggtggggtctgccaatgccgacatctacgtcgaggtagaccagctcctaggcgagggtgagaccctggtggcgaggtccgggcagacgcttgttgccggcaagggagccaacccgaccacatgctccaccaagctcacgagactcattacggcgggcctccgcggtggcggggtttgcctcgataatcttgtcgtggtcgctttggcaccgataggtcatgcagctgtcatgatccaatccaacaaccaaaactccatcatctacattggggtttgtttccccctcttctctggccataacttcctcagtgtctatggtgtgagtttggagcgtctcctaaataatagtcttgaggtgctcgacctttttggtgttggccagcttggagaacatgtcttccctggtgttgctctccctgggtatgtagtacatctcaaagcatttgaagttgtcgatgagagttttggtgatgtgatagtacttgagcaacactatttccttgttcagttatctgttggcaacttgcccctggataagttgcgagtcgctcgattgtttgaggctttaaagttgaacctgagggcttgctctagagtgatgttgctaaggccttcgaggatgattcctgccccgcttaccttcacgttggatgctctgtcgacgtcaaactctgaaagttcaacgaatcaggctaccattcctcctgctaatttaggctttcacaaaacctacttaatgggggctaagctaacgactttgtcagctactgaaagatataggagtagcggttctcctggtctgggtcaactcacgattagaggtgtggcaatggtcctctttaaggctgagatggcttatttcttgggcgtttgtatgactgtgcatcttcagtatggttgtgcatttgttggggttgacttttattccatggcgtgtgatcataatgcccaagaacttgtctccactgactttgaaggatttgatcaccatgtcatcgacgtagacctcaacatttcatctgatatgctatttaaagatatggtccatcaacctctaataaaacgtgtatccggatctggttgtatttggagtagacatcttggaatcatagtacttggaactcagacgctctatcgactagcctgtcgatgttgggtagaagatgatgagtctatggcagataatgttggggtggattcccagcatgacatcaactatgtgtttgtgctcatggttattgaggtccctgctgatctatatccactgctcaagtttcggtttgagctgcaacttaaagagttcttcaataggctttgggcccctatcagaagtatcaccacgctccctggtggaaggatagggtgcccctttcagactttccgtgtagcactgtcgtgcttggttttgatcttccttgacaatcacgatctttcccgtcaagacttcaagcctctggaatgttttccaatacatgatatcaatggagttaccctggttgatgaggaccttatataccatgaagttggagattatgatggagacaaccatgggattgtcttgatggataaggttgatgttgatgtcccagatgacatagaggtgacgcttgcgggactggttggactgccctccgtaggagaatccacctacaatggtgtttattacacctctgatttgctacgagggctcgtttccctgttcttgcggaggttgtcgttcacgtctttgctggtggtgtttgtgtctttatcctatgttgatcctcttggcccaaacatgttcgatgttgtgaccataactgtgatggcctcctcgaggattgtagtgcgattgaccgcaggagtgtgtaacgctcgtacccggacccttttgggagaggtggcagaggtcatgcaatgtaaccagttggctgcatattgtgaactgaaatgcttgaccaaagtgtcgaagttgtcaatggaacttagaggaagtccaccataccaggttaatgccacccctttgagggacgttgggaagacacaaacacaggattgcatcgtctttggtgggtatgtcaacttccataatttggtcgacgaaggggtgtcgacaagtacactgccttgtaggacggtgttgttggagagacttagatcatttagagtgttgactgtgtgtcggggagtgttagtatttgtcatggttgctagaggaggattaaagccttcgaaaggggtctcgtgtctacggccagaccgtgggctaaccatgcgtgaaaagagaggtcacagggtggatgtggctaagatgaggtctaagatctcacatgtcgaacggtga

SEQ ID NO: 20575 - DNA, 57 bp, Glycine max
  Peptide Sequence Number=SeqID_112260
atggcatgggagatgagttcaatggtggctcttcgatttgcatacagatgttggaag

SEQ ID NO: 20576 - DNA, 2706 bp, Glycine max
  Peptide Sequence Number=SeqID_112261
atggcaggaaacatttctggtccaagtgggagcaagggtgctaatattttacttaatcatgacttctctagtgggctgacctcttggcatctcaatagctgcactggctatgtaatttcatccaaatcaggtactcaaggaggaatcccaatggatttggatgctaattatgctgttatcaccgaccgaaaagaatgctggcaaggtcttgagcaagacatcaccaacaaaatttccattggttccacttacacggtttcggcttgtgtgggagtttccggggtttctcagggatctagtgatgttctagctactctgaaactagaacatcatgattcagctactcgttacttattcattggaagaacttctgttaataatgatagctgggaaaagttggaagggacattctcattgtcaactatgcctgatcgggttataatttatttggaaggacctgctcctggagttgacctgcttatacgatcggtagtgatcaactgttccactcctaatgataataccacaagcacaggatgtgtttcagctggagatgacaacatcatagtcaacccccaatttgatgatggcctgaaaaactggtctggaagaagctgcaagattatgttgcatgattccatgaatgatgggaaaattgttccaaagtccgggaaattcttcgcatctgcaacagaacgcacacaaagctggaatggaattcagcaagagatcactggacgcgtgcagcgcaagctggcctatgaggtcactgctttagttagaatatttggaaacaatgtctctaccgctgatgtacgggctactttgtgggtccaaacgccagatcttcgagagcagtatataggcattgcaaagttagcaacagataaagattggataacaatgcagggaaaattccttctgaatggttctccatcgaaagtggtcctttatttagagggtccccctccaggcactgacattcttctcaataatttggtcttaaagcatgcggctaaaacacctccttcaaccccaccagatgtaaagaatgttgcttttggggttaatataattgagaacagcaatctggctgatagcacaaatggatggtttccccttggcaattgtactttaagtgttaaaactggttcaccacatataattccaccaatggcacgagattctcttggtcctcatgagctcctaagcgggcgctacatccttgtaactaatcgaatgcaaacatggatgggtcctgctcagaccatcactgataaagtgaaactctttgtgacttatcaagtgtctgcttgggtccggattggctcagcaggatcatcagggcctcagaatgtgaatgttgcccttggtgttgacaatcagtgggtcaatggaggacaaactcaggtttcggatgacatgtggcatgaaattggagggtcctttagaattgaaaagcagccatcaaaggttatggtttatgtgcaaggtcctgcttctggtgtggacttaatggttgctggacttcaaatttttcctgtggatagacacacaagatttagatatttaaagatccaaactgataagattcgtaaacgtgatgttatcctgaaattctctggactggactctggcagctatgctaacacctcggtaaaagttatacaaacacataatgatttcccaattggaacatgcatcagcagaacgaacattgacaacgaggactttgttaacttcattgtgaagcattttaactgggctgtgtttggaaatgagttgaagtggtattggacggagccacagcaaggcaatttcaattacaaggatgctgatgatatgttaagcttgtgtcagaagcacaagatacaaactcgcggccattgtatcttctgggaagtggacgaaaccgttcagcagtggatcaagtcactgaacaaaaacgatctgatgacggctgtccaaaaccgcctaaacggcctgctgactcgctacaagggcaagttcagtcactatgatgtcaacaacgaaatgctgcacggttcattttaccaagataggctaggcaaggatataagggcaaacatgttcaagactgcaagccaactagacccttctgccacactctttgtgaatgattatcatgttgaagatggatgcgacaccagatcatgtccagataagtacatccatcacattcttgatttgcaagagcaaggtgctccggttgggggaattggaattcaaggccacatagactgtccaatagggcctattgttagttcttccctggacaagttgggtattcttggcctacctatatggttcaccgagcttgacgtgtcttccgtcaacgaatacgttagagcagacgatctcgaagttatgctacgcgaagccatggctcatcctacggtggaaggcttaatgctgtggggattttgggagctgtttatgagtagggaccattcacatttggtcaatgcagaaggtgacatcaatgaggctgggaaaaggttcttagctctaaaacaagagtggctctctcacagccgtggccatgttgatgaacaaggccaatacaacttcagaggctttcatggaacatacaatgtgcaagttgtgacaccgtcaaagaaaatttcaaagacatttgtgcttgacaaaggtgactctccactagtggtatccattgatttataa

SEQ ID NO: 20577 - DNA, 2661 bp, Glycine max
  Peptide Sequence Number=SeqID_112262
atgccgagacacaaaaagtgcaacccatgtaaaatacgagttgagccaaatcagtctatttttcatgcttgtcctgacaagctatgttggttcacctatattgacaactctagttacaataatatcagtggtggcaactttgatttcaatggtgatagtaatagtgacaatgatgatagtagtgataacaatataggtgataaggaccacaatgttagtattggttgtggtggtgacgatgttggtgatagtagtgttggtagcaacgacaatgataatgacgatggtgccaatagaaatggaggtggtggttgtggtaacaccaatattggtgatagtgagaaagaatcattatcaaatgtaggaaaaaaagacaacatcattttcaaagtgagtgtgtatgaagaaggtgtggttgcaatgtcggattttgaggtagcagagttgaacatttgctcagattatgtggcgatggtgaaggagtttgggacattcaacgatgacgaagggttcatcggtgacaaaattgtaaacaacataaaggcggttcctcgtctaaggatactcgtcgaggtgcctctgatagcgagtcctcatgttcatagaagtatgagtgttgggtcgtcgtcgtccaccccggccgttgctggatatgagtgggataaggacaatgtgctgaaatataagtcttgtctatccttgatagcgagtgtcactgcgcttcaacgtcaagtgaagctggcgaaccctgaggactcctgtcctgggtgtcattttatccttaatcgcttttcagtgtgctctactggagcacttgaatgtggctttttcccagctttactcgaacaattgagcgatggtgtcttggctactgatgttatgactaatggaaagccattgatgtttaattggggtgaggagccctacttctcgttctaccggcagtctgatcccaccaggttcaagtcaaatgacgaggatctgttgagccttagaaacgatcctctcgctaccttggatgataagtgtcgaaccttatccttaccactcgtgaagcaggtcagacctgaaggtggaactatgccactgtttgctgctactctgtctgttggagaaaggggtcaacttgctagtgagattgaccttattgctattgctgttgaggtcacccccaatgttcattcctctatttttgcaaagagaaagagggatgatatcgttgggtcgtttggatgcaagaagtcgagaacccctatgagcctccatgccttgaggttcatagggctcactacaggtcacctcacgactagacaagatatgcctccagctccattggaagttaaggctcttgttgttgttgctgctgctgctgcaactcctgctacgcctgtgcattcaccttctcctactactattattcaggaggttactcttgctgatgttgaagatgttgtgttagccactctggttgagtctgttgtggtgtcatcgtccaccgttgcatcccttttactaagtgttagtgtggtgaccactggtgctcccacggtactgtccccttctttggtggccctccctgttgctattttggaggctatggcgttgccttcttcgtcctcgcacccttgtgtgtccctcgatcatttatacaccttcagtgatgttgagttactatggggtgccacttacaagtcagagcagaagaccctgattggctttgtgtcaaccttcgagaaaaatctcatcaggtcagttggggtgcagaatgctactgactctgtcaagatgtttctccaaaggagtttgacaattttggaggagaatatactgcagcaccaagaggcagtgcaaaagatttcatccttggaggcagaggtctccaagtggagggctattgctcagactctatggcgagtggagctccctaaggtggccaatgccattgtcgcttttactgaggtcgtaagggaaaatcaccaactatcttccaaggttggtggtgcactgactaagttgttgcacacccggttagatggtgatgacctgtttagatgttgcaagaacttacagactgagaagatggacatgtgtggtagggtggagagcatggtggctgagaaggacaggcttgccaagaggattgctaagttagaggcttggctgagggagtcagagtctagattgaaggagtccgagctgcgggctgccaaggaaattgaggctagcaaggagttagaggaagagttgattttgtataagaaggtcgtggagcaacatgaaaaaggctttcagaaggctgtcaaatctcatcaatcccttcaagatgtgaaggagggtctcctgcttgatgaaaaggagattgattcggaggaggaggctgctgatgaaaggcagggtgctgtggagcaaggcgatgatgcctgtcttgtcacccgtctgatgggtcttccttctgttttgtggagcttctcccttgatggttttcctcctctgatgattatggggagtaagtgtgagttgcacctgattgaaggccttgtcatgcaatcgggtgtcttgccgaataatggggtggtagttcgcttggtggaacttggactcttgacggtggtcgtcatagttgttgtatgtgagcgaaccaaggagatgcctcgagtttag

SEQ ID NO: 20578 - DNA, 1026 bp, Glycine max
  Peptide Sequence Number=SeqID_112263
gaggtggtagatttctgccgaaaatacttgattgcaaataaggaggcgttttctcataagaagctcgaccttgtcattaatgatgccaaggctgaattggagaaaagaaaggagaagtttgatatcatcgttggagatttggcagacccacttgaagatgggccttgctatcaactctacaccaaatccttctacgagaagatcctgaagcccaagctcaatgataatggcatttttgtgacccaggctggaccagcaggtatcttcacacacaaggaggtcttcacttctatatataacacagtcaaacaggttttcaaatatgtgattgcatacacgactcatgtaccatcatttgctgacacatggggttgggttatgtgtctccatgaagcaagcgtcgaagatttgctctcactcgtagccatcattgtgatgctagccatcaccctccttctcatgttctcggtaactggtagtctcaagctctccaaactctgctcccacaaccaccaactcgacaccgagactgtggtggcggcttcggcggtgctcctctccctggccgctctgtacgtggtggacttcgcgtgttacaagccagagaaagaacgcaaaatatcggtggaggggtttctaaagatgggcgaagagagtgtggggttcgaggaagagtctcgccaattccagaggaagatttccacaagggcgggtttgggtgacgagacctactttcccagaagaatcacttcttgctcgcctaagctctgcatgagcaaagcgcgtctggaggtagaggccgtcatgttcggcgccctggacgctcttttggtcattacgggggttgttccaaaggacattgacatttcgatggtgaattgcagcctgttcaacccaacaccatctctccctgccatgattgtgaaccactacaggccgagaagcaacataaagagctacaacgctcacaatcacactatttttggtaagcattactttccacaaattctagatgttcagttttaa

SEQ ID NO: 20579 - DNA, 180 bp, Glycine max
  Peptide Sequence Number=SeqID_112264
atggacgcaggttacaatcctcgtaccgtcgaagaggtctttagggatttcaagggtcgcagagctgctttgattaaagccctcaccactgatgttgaagagttctaccagcagtgcgatcccgttgttttaatgtaccgtggactgaaactcagaaactcagttgcaatttttttgtaa

SEQ ID NO: 20580 - DNA, 411 bp, Glycine max
  Peptide Sequence Number=SeqID_112265
atggatttcagggtgatgagtttggagtctccactgtttcacacgctgcaacacatgatggacatgccagacgactctgcaggggacaacaagacatacaatgctccgacacggtcatatgtgcgagacgccaaggcaatggctgcaacacctgcggatgtgaaggagtattcgaattcttacatgttcgagatagacatgcccggtttgaaatctggggacataaaggttcaggttgaagacgacaacgtgcttctgattagtggggagagaaagaggaacgaagaaaaagaaggagcaaagtatctcagaatcgagagaagggttgggaagttaatgcgcaagtttgtgctacctgagaatgctaacacggacgctgtttcagcagtgtgccaagatgggggtgcttag

SEQ ID NO: 20581 - DNA, 615 bp, Glycine max
  Peptide Sequence Number=SeqID_112266
atgtggaagaaaaggaatggaacaatctggaaaggatccaagaaaccacatagagaaagaaaggataaggagaaaagttccatcatatgctttgagtgcaagaaaccagggcatttcaagttagaatgtctagatcttgataaatcagcttacaagaaaaagtacttcaaatcaaaggacaagaaagtgttaatgaaaacatgggaagaactggacgacacattgttcgatgtagaaatagaagaggaagaagaaaccaacctttgtttgacaacaaacactgcatcaaaaggatcagattcaaaatcagatgaagaggctctccaaaagcaacctcaagatgtagttatgcttcatcaagagactgaaattctaaaagagactttatccaaatttgttggacgcattgagaaacttaacaaaatgttaagatacaacaaattcccaattgatgaatttggaaatggatataaaggaaagaaatatgttcatgatgaagaaaacataatttttacaaccatggacacaccaatcatggtacctgaacaatggttgctcacgtcacataataggagaaaaatgtatgttccaatgtctgaatgttccaatgtctga

SEQ ID NO: 20582 - DNA, 522 bp, Glycine max
  Peptide Sequence Number=SeqID_112267
atgggtacaagacaaggtttggagattttagctttcccctgcaatcaatttggtatgcaggaacctggatcaaatgaagatattaagcaatttgcttgcactcgatataaagcagaatttccaatttttgataaggttgatgtcaatggaccatttacaactccagtgtaccagtttctgaaatcgagtgctggaggctttttgggtgatcttataaagtggaattttgagaaattcttggttgacaaaaatggtaaagttattgaaagatacccaccaacaacgtctccttttcaaattgagtttatgcttaatgtagtcagtaacctcttgcatgctgagcggtttaagcagttttcacttatatttattgagaaccacactacaatcattgtaaatcccacactagaatttgatatgtccaatatgggactcaaattccatagcttgccattggatcctaagagattcacatttgggtttgaatcatgtgatacatattacatacttggattggcataa

SEQ ID NO: 20583 - DNA, 1332 bp, Glycine max
  Peptide Sequence Number=SeqID_112268
atgcagagattcaaagctctgctacctcaacaaactaggtcctcacttcgcactctctgttctcaccgtcgagctttctccgctcaaccgaattacgcaaagcaccacgacgacgattctcaggaacagattttagtcgaaggaagagcgaaatcacgagcagctattctcaacaggccgtcttcgctgaactcgctcaatgcttcaatggttgctcggttgaagaggctgtatgattcctgggaagaaaactctgatattggctttgttttgatgaagttgcaaattgcaatcttgaatgttttgaagggtagtggcagagctttctgttctggtgcagatgttgttaggctgtatcactcactcaatgaagcttctaaacttcttcataaacacttattggggaagaaaataagaaggaaaaatgaattaaacttctcgcagaagctaaaatcagcttttgcacaagttaaaatcaacctatgcttggttcaaagttgcaaaaatgatgcagagggatcacacttctatgctaatgccctctgtatcttgagtcttttcattttcacttactgcttggagtgtttctcatcctcctttctgttattaatttccgttttgataaacttgctgtttattgaaaaacaaaagtataaagtcaacattggattcctgaatcacattccgactgaatcccactgcaaggtggtgatgggaggaaatactgacgaagctgaacagtttttcaaaacattatattcatttgtatatcttcaagggacatatcttaaaccacatgtaaactcaggtgcaatcattcaaagccaagttggcgagtccacttccgtagccattttagagcaaaatgacattgatctgtgctggtctcttgcatgctcttacacatcgcacgatcaacaattttcttcctgcacatttcttgccattcctgttgccattttggatggaataacaatgggatgtggatctggaatttctctaccaggaatgttccgtgtggtaactgataaaactgttttttctcacccagaagctcaaataggtttccacccagatgcaggagcttcttatgttttgtctcgtctacctggctacttaggggaatacttggcccttacaggagataagcttaatggtgttgaaatgattgcctgccgccttgctactcattattcactaaatgcaaggctctctttgcttgaagaacgtcttggtaaactaatcacagacgaaccttctgttgtggagtcatccctcgcacagtatggtgatcttgtttatccagataggagcagtgtccttcacaggtag

SEQ ID NO: 20584 - DNA, 978 bp, Glycine max
  Peptide Sequence Number=SeqID_112269
atggaggggttgtataaagtggtggcggagtataaagaacaaggaggatggaatttgaatcagatacaacatttgttacctgagaatatcgccgatattattcaaagtgtagtgggtagccaagctcaatttatcattaaaagtgtctatgatgaaatccaccaacgtggtattgataatcaaaatcccttttccaacctttcttctcttcagatcggatcagatcagaatcccaccgccatggatttcatgaaggtcttcgatcaaaccgttcgagaaataaagagagaggtgaatctgaaggtgctcaaggttccggaaatcgaacagaaggtgctggatgcaactgataatgaaccttggggtcctcatggtactgtgctggcagagatttcacaggctaccaaaaaatttactgaatgccaaatgatcatgaatgtcctttggacaagactgggtgaaactggaaaagattggcgttatgtatacaaggcattagctgttatagaatatttggtagcacatggatctgaacgtgcggttgatgacattatagaacatacttttcagatatctgcactttctagttttgaatatgtcgaacctagtggtaaggatgtgggactcaatgtaaggaagaaggctgaaaacattgtgtcgcttttgaatgataaagataagatacatgaagtcagaaataaagctgctgcaaaccgtgacaagtacattggagtttcttctagtgggatcacatacaagtctgggtcagcctcctcttatggtagtggcagcagctttcagagcagtggtaaatatggaggctttggatctagagatggcgacaggtttaatgatagctatagagacaaaggatcctatgaagaagaaaaagattaccaaggaaaatcacaccatgccaccgcaggtgacaatcaagagaattccttcaagaagggttctgctcgctctgccaggtag

SEQ ID NO: 20585 - DNA, 255 bp, Glycine max
  Peptide Sequence Number=SeqID_112270
atggcatttgcgcatgattttgtgaggaaacaacctatgggagaatttggtaaccagggttcctcacaaaatttgtgtatgtatagatctcagaaatacctgaatatgcacgaaatggctccgagaaagctttctgcaaagagatccaggaaggacaaagcggctgaagggaccagtgccgctcctgagtatgacagccatcgcttccggagtgctgagcaccagcagcatttcgaggccatcaaaggatggtaa

SEQ ID NO: 20586 - DNA, 432 bp, Glycine max
  Peptide Sequence Number=SeqID_112271
ctgccagcggacaagaaaaccgttctgcgtaacaacgcgggcggccacgctaaccacagcctgttctggaaaggcctgaaaaccggtaccaccctgcagggcgacctgaaagcggctatcgagcgcgacttcggctccgttgacaacttcaaagcggaattcgaaaaagccgctgcaacccgtttcggctctggctgggcgtggttggttctgaaaggtgacaaactggcggtggtttccactgctaaccaggactccccgctgatgggtgaagcgatctctggcgcatccggcttcccgatcctgggtctggacgtgtgggaacacgcttactacctgaagttccagaaccgtcgccctgactacatcaaagcgttctgggatgtggtgaactgggacgaagcagcagcgcgtttcgccgctaaaaaataa

SEQ ID NO: 20587 - DNA, 189 bp, Glycine max
  Peptide Sequence Number=SeqID_112272
atggtgaaaccttctgaagctgaaaagaaccttgttcaatctaatgcttctggtggagcagccggtgtaactggcccctatggagctgtggaccgaaaattatatgtggggaatcttcacttcaacatgactgagagtcagctgtgggagagttttggcatgtttcttggtctttgctacatttattag

SEQ ID NO: 20588 - DNA, 324 bp, Glycine max
  Peptide Sequence Number=SeqID_112273
gttcatcgagtcaagttgaagtatggaagtaaccatcttgcaaaaattggggcaaaagatggatcgtgttacatcattgcttcgtctactgccaaacacgtagaagaggtacaagagaagatgaaggccgacatggaggccatgaaagagcaaatggccacgatgatggccatgatgagcatgaggaagataatggaagccaatgcagttgcagttgccgctaccagcactgttgctaaggtgaacccgatgcccccatctggcctcaaccaaatgaatcatccaacctcagctatgatttgggaagtacaaatggccccatga

SEQ ID NO: 20589 - DNA, 153 bp, Glycine max
  Peptide Sequence Number=SeqID_112274
atggcgaggacgtgcagccctctgaaggcgaggaattgtagccctctaaagattgattgtccttttgaaagaggcgataattcatgcaaccttatcctatctttgcaaatctctccgggaactccctcagagtgtttgttctgtttgatttag

SEQ ID NO: 20590 - DNA, 1026 bp, Glycine max
  Peptide Sequence Number=SeqID_112275
cccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgagctaaggaagctaaaatggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcagggcggggc

SEQ ID NO: 20591 - DNA, 162 bp, Glycine max
  Peptide Sequence Number=SeqID_112276
atgaccataatttgtcttcgcatgtcatcgggcttgccgcctctggatgacaaaagggtgcagaatgaccataatttgtctctgcgtgccatcggacacgactgtgtgccgaatgaccataatttgtcttcgcatgtcaacgggctcgccgcctctggatga

SEQ ID NO: 20592 - DNA, 97 bp, Glycine max
  Peptide Sequence Number=SeqID_112277
atggatcaaataggacttcccttgggaatggcgaacaaggcaccgacgcacaggattttggttggtaatcaaagggagaagaccactttaggtcatg

SEQ ID NO: 20593 - DNA, 660 bp, Glycine max
  Peptide Sequence Number=SeqID_112278
atggcagaggtctccatagaggccattgcctccctcgcccaatattatgaccagccgttgaggtgcttcacctttggggacttccagttatcacccatggtggaagagtttgaagagatcctgggatgccttctagggggaaggaaaccataccttttctcaggattctatccctcttcagctagaatttctaagatagtccaaatcttgacgcaggaattagaccacagaaagcaagtcgaaaatggggtggttggagtaccgaggaaatgtttggaagcaaaagcaagaatcttggcagcaagcaaaaaaggagcatctgtcaactggttcccccgatggaaagaaggaagaaccgaggttcttatttcgtgcggaggatttccaaatgttcccttgatggggacaaggggttgcatcaattacaatctcgttcttgctataacacaacttggctaccctatgagaggggcaccactagaggaagagctcacacatattattccacgaggtttcaataacaccaacgcggaggcacttcagaaggtccgcaaagcatgggagatggtgcaaaagaaggacaaggaactcagaggcagtaacgcgatcatgaaaatggcgtcgtgcgagtgttcattgcttcgagcgaagaccgactga

SEQ ID NO: 20594 - DNA, 831 bp, Glycine max
  Peptide Sequence Number=SeqID_112279
atgcaacaaccaattccacggtatccttcgcaaccctttaatattcatggcataacattgaaaggaaaacatgatgaaaattggggacaactgttagctccaatgatcaatcaatggaacaattgggttgattttagggtcgacagttatcctcgacaagaaggcgtactgagctttaactccgactatatggtgtggtataggcgaaaaacgaagatgtttgttgaccctaaaaatgcaaacacagctacattggctaaagttggagagacattacagtacatgttgtctccacaagggagaaatacatggacagtggatgatccagtatcgtatatggaaaaaataaccattttatctaaagagcaagagagaatcactaaacctgtgtcacatggtccagcaatagaacatgagtttgcatcgcaagactttaatattctcccatcaagtgttgaaactcaaggtataggtagacgaagggaggttgttgaagcagaaccatatttgtacccacagatggtagagcgtggccatggaatgtattatacaccagcaatatcttctcagtacccggcacagatatatcattatccattcgaatgtcatcaaagtgatacttctgcaaccgaacattcattaggtggtgttgcggagacatatcccaatttttcatggcctactatgaccccttcacaacaacatgatacacaaattcaaacacctaatgccccattaggtactcaatggactgtacccggagcaataactgatatgaatgaattattaggtgttgatttacgtcaccaattttctactgaggctgaccaa

SEQ ID NO: 20595 - DNA, 150 bp, Glycine max
  Peptide Sequence Number=SeqID_112280
atggttacactaatcaatggagcgtttcatccatctaaggttgcggcaaaggctgtcactttgtccattaggcaacaatttggtcagccttggtctacatggggagtgattccaaaagatcatcaagaacttttttccgagcgtttcatg

SEQ ID NO: 20596 - DNA, 192 bp, Glycine max
  Peptide Sequence Number=SeqID_112281
atagttttctactgtctgaccgttggaatctttaaaataataacttttggtctccctctaagcaagaatggcgttctaagcgcaattccaactgaggggaattgcgctgagcagcccaaagctgcgctaagcccaattccaaccgagaggaagtgcgctgagcacccagaggatgcgctaagcgggccctag

SEQ ID NO: 20597 - DNA, 474 bp, Glycine max
  Peptide Sequence Number=SeqID_112282
caaaaccaacaacagcaaaataattatgacctttcaagcagcagatacggatccaggttggaggaatcatccaaatctaagacgggcaagtcctccacgacaacaacagcctgccctgctttccagaatggtgttggtccaagcaagccatatgttcctcctccaatgcagcaacaacaacaacaacaacaaagacaacaagcaactaaggccccttcgcaaccttccttagaagagctaactgtgaaaaattcgaaaaatgtgagtgccatcaccatgaggtctggcaagcaaattgaagtgcctccactagcagcagcacctgcacctgcacctgaacctgtcaagcttcattctgcacctgaaaaagaggatgcgatagttgcacaaaagagaaagcttcctgatcaaaagggagctaacaaaaattttcatgcaagtggaccttattctaataattctgacttgcaatag

SEQ ID NO: 20598 - DNA, 231 bp, Glycine max
  Peptide Sequence Number=SeqID_112283
atggggttggacgagtgggatctcaacactggggcaatcaactacttgctagctagtacacgggtgcttccaaggcttcccggactactagctgacgactccctcctccggtaccgactactccatctgcctctccggactagcccatctgcctcaaccactgccagaagcaacgcgtggatgccactactagatacgagctcgttactaccatccgatcactactactag

SEQ ID NO: 20599 - DNA, 972 bp, Glycine max
  misc_feature (7)..(7): n is a, c, g, or t
  Peptide Sequence Number=SeqID_112284
cctgtgnttggtcctggtccctccagtcctcgagtgagcacaaaggggatttgtgttgatccctcaggaaacgatcctgagaccggtgactctgacaggtgcggcttgtacatagaagcagatcctgcatgcctggttgccatcgggagagtttatgagggatccactgttgttcataacactcctttgtttcctggccaagtaaaggtgagtgtggaggaggttagagatgcagatgctccagttcctgtacccactgatgaggtttccttagtggggcagacacttcacaccttccttgcttggccgacacatctggtcaagtctttatcacagcaggtagttgtgtctccgccaaaaccacctccgaagcccgatacggaggtcgatgatccgctttatctgatgacattgaccatcccagagcttttcttgaggccttatcaggttagatgggatgccaccgtgttcggggtcgttaatccagatttccccctgtacataaagcacgaagacttctccgaaatcgcacacggtggtcaatgtctcagcatatcagtgttacagttgtggattctgcatctcactgaaacatgtatgcgagcggggaattctgatatctatggattcctcgagcctcagtccattcagaagattcagatgatgaagaagacttctcactctttatgttacaaatgcaaccaacttggtcacatcaaagctaattgtccttcaaatgaagaatggcctgagaaaagtgataagaaaagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 20600 - DNA, 216 bp, Glycine max
  Peptide Sequence Number=SeqID_112285
atgcaaagtgcaaaaggagcagtcgcgctcagcggaccattgggctcagtgcacatccatcgcttcagcacgcttagtgtgacaagggaatctggcagagcacaagaatcaaggttgcgcgctaagcgcgagatcaactcgctaagcgaaacgtttgtctttagcccggctaagcgcatgactggcgccaagcccaaatccacttactcgcgctaa

SEQ ID NO: 20601 - DNA, 186 bp, Glycine max
  Peptide Sequence Number=SeqID_112286
atgacctcccgtggctgccacgagccgtcgttgcttgccatcggaccaccccatggagaggaacactttaatcaaagcagaatcttcaaaatccccctcggggatttgatagagaatggaactctcaacccttctttcgtggtttctttgaggttctcaaccccaaagcttacaaatttgttttaa

SEQ ID NO: 20602 - DNA, 357 bp, Glycine max
  Peptide Sequence Number=SeqID_112287
atgacctcggccgtcagtatgacagaatggggggccgacaaaaacaaggctcttgctcctacgatcctccgaatgaggggtgcggaatcgaccacgtattcgatacttgtgagacttgaaaaagtctccaccggaagactgacatctccgaaagggcgcagaatgaccacattggcctctgctgccatcaatcacacttggggtcatgaatggcaaaggcggtcggaagaccgtaagtttgtctccgttgtcatcgggcccagcgcctctgggtcacggaacagaaagggtgtggtcgacaaaagcgaggctaatttgctcctacgtatcctccatgaggaactcagacctacgtag

SEQ ID NO: 20603 - DNA, 420 bp, Glycine max
  Peptide Sequence Number=SeqID_112288
atgcctcaaaatgttctttacgatgccattgggatatatccaacggtggtatatccagtgatttttttctccattttagcttccttagctcctgaaaatctcgataactcaaaaaatacgcccggtagtgatcttattttcattatggtgaaagttggaacctcttacgtgccgatcaacgtctcattttcgccaaaagttggcccagggcttcccggtatcaacagggacaccaggatttatttattctgcgaagtgatcttccgtcacaggtgctcccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 20604 - DNA, 108 bp, Glycine max
  Peptide Sequence Number=SeqID_112289
gtcttagatcttcttcatcaatggagtcctttgtttcttgaagatcaatggcagcggaatggagaagaagaaaaggtgattggagatgccacttcaaggagaagatga

SEQ ID NO: 20605 - DNA, 443 bp, Glycine max
  Peptide Sequence Number=SeqID_112290
atggcttcgaaaaagctttccccgaagaggtctagaagagacgccgcagcggaagggtccagtgccacccctgagtttgatagtcatcgtttccggagcaccgagcaccagcagcgcttcgaggccatcaaaggatggtcgttccatagagagaggcgcgtccagcttagagaggatgagtatatggactttcaggaggagatagctcgcagacattggacatcgctggtgactcccatggctaagtttgaccctgagattgtcctggagttcaatgctaatgcttggcccacagaggagggagtgggagacatgcgttcatgggtgaggggtcagtggattccctttgatgcagatgccctcagccagttcctgggtgacccgctagttttggaggaaggccagcagtgtgagttcggccagaggaggaacagggccgatgg

SEQ ID NO: 20606 - DNA, 423 bp, Glycine max
  Peptide Sequence Number=SeqID_112291
atgggggaagttgggtactgtcgcaacctaccctttgcgggcgagcgaggcgaggctcatggcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 20607 - DNA, 171 bp, Glycine max
  Peptide Sequence Number=SeqID_112292
atgtgggatcgacacaggcttaaaggagcactcaaaccgggtgactcccaaggcctacactttgaagagtctgtcaggggtcttagcattaactcgtcgcccttaaagggacttagcattaactcgtcgcccttaaagggtcttatagtcgtgtcattgtacaatccatag

SEQ ID NO: 20608 - DNA, 393 bp, Glycine max
  Peptide Sequence Number=SeqID_112293
atgaggtggtggcggtgcgtctacggcctgcggtgcatcatcaccctgcgcctgtctaggtgtacaatacttctcaatgaaggtcgggtgatcggcggtcgaatcaccttactaggtgtgacgggaaccccgaatgactggcagagacccgtgatcaacgctggaaaccccagggcccttgatcaactgagccacatggacgcttatccgtgtcaggatggcatacaccagctgacacttcagcagagggaggtcggagttatgatcgttgggcaggacgttgctgagcagcaacatcatccacatctgagtcaaggtggtcatgctggtgcgcatgatccgcacccgtctcccggcagcggtctgggcaaaatcctgacccggaatgcataa

SEQ ID NO: 20609 - DNA, 261 bp, Glycine max
  Peptide Sequence Number=SeqID_112294
atgcaagggataacttggctcccaaagaaaaaaagtccaagtggggaagaagctgaagtccccgaggaaagcgaaaaagtgcaagccttgaaagcagagcttgaaagaatgagagtggtcaaggaaaagctaaagacatcagtcaccacgattaggaaagagtgtgacaagctaggggatgtcaacatgactacggccgaagcgttaaagaaggaaacaaagagggcccgaaaagaagaatggggcaaaaacaagttctga

SEQ ID NO: 20610 - DNA, 599 bp, Glycine max
  misc_feature (551)..(551): n is a, c, g, or t
  Peptide Sequence Number=SeqID_112295
atgggaccaagtcaaacgccttcgcttaaaaaaaggttcaatcaagtcaaggtcaagagcctagggatcaccagtctaagagagttagggcagttgatgggtcagctccagcggcaagcttttcgcaaaacttatgataaaatctgggacctagccatggtagaagtctccacagaggccattgcctccctcgcccagtattatgatcagccgttgaggtgctttacctttggggacttccagctatcacccatggtggaagaatttgaagagatcctaggatgtcctctagggggaaggaaaccatacctcttctcagggttctacccctcattagccagaatttctaaaatagtccaaatctcggcgcaggaattagaccgccaaaagcaagtcaaaaatagggtggttggaataccgagaaaatatttggaggcaaaagcaagaatcttggcagcgatcaacacttttctcgcctatcataaccacaaggaaagaccggttgtcgctatgctagccgacctatatgacaccttcgaccgaagatgtgnaaagagcaatacaaggattgtttgctgtactccagctctttatgtatg

SEQ ID NO: 20611 - DNA, 327 bp, Glycine max
  Peptide Sequence Number=SeqID_112296
atggaagagctttttaagaggtggaatgaatatcttgacagcacacgatcaagggtcaaccaaccactattgatcatttgtgatttttgtggaggagagcattacaatgacaattgtcatctctactctatgaatgactctaggtgggaacatgagttaagtccttacaatcaacatgaagaagaaagaactcctaatcttgaaagtgtgtttgaggaattcatggcataccatgctagctcaaaagccaatcaaaattcaatgaaaaatcatgaaattcatttttgcaagagctactcattagaaaattttcaagggggaccatag

SEQ ID NO: 20612 - DNA, 570 bp, Glycine max
  Peptide Sequence Number=SeqID_112297
tatgggggatggccagccttgcagaatggcagagtccattgctgggactcccattggtggagagatctcaggaagatatatcagcacaatgacttcaagattattcatcaaaatctgtctggatcacaaataccctcagctcttcaccattagtaagcagcagaacgatcttatttcaaccatgggtagcttctaccagactatttggagatgggatttgaaatggaggagacacctatttgaacatgaggagggagtagatgtggctttcttggatgagattagtgcttaccctatccaaagtcacttgaaagatacagttctgtggaaagctgaacctactgggttatactctactaggcttatcaaggataggctccctactagagttaatcttcaaagaagaaacgtgggtctgcatgaatctatttgtcctctttgccatgaggagcaggaggaggcaggccatcttttctttcactgcactcaaactattgttctgtggtgggaaaccttgagatggattaaggctattggagctttccctttttctccagcaagtcatttcag

SEQ ID NO: 20613 - DNA, 249 bp, Glycine max
  Peptide Sequence Number=SeqID_112298
atgaccggccctctcaatgagtcaatctcttgttttctcataagggtggacccttgggtactagtaccctcaccttcagagggctacacgccctcaccttcagagggctacacgtcctcgccatcaaaggactacacgcgtcctcgccttcagagggctacacaccctcaccttcagaggactacatgtcctctccatcagagcactacacgccctcgccttcaaagggctgcacgcccttgcctttag

SEQ ID NO: 20614 - DNA, 268 bp, Glycine max
  Peptide Sequence Number=SeqID_112299
atggcgatagccggcaccgtcaagctgctcgcgcagggcatcacgggacaggcgctggccttttttcatcaccagcgcatgaccatgcagatagctgtgcggacagacgcgctgcatcagggtattcaccggcacaatcagcacaccgcgctgcatggtcggcaactggtagagcgtcgacaggcgcgaggagatgatctcctgatgcggagagaagctgtcatacggcagcgtttcccagtcggccaggctgaacaccaggctatcg

SEQ ID NO: 20615 - DNA, 156 bp, Glycine max
  Peptide Sequence Number=SeqID_112300
atggataagagcttgaaggaaggagaagatgagtggagggagagggagagaaggagcacgaaattttgtgcctcaaatgagtcttggtgccctaaaatacaaaggctgaaagaccctacatttctagggtatcctacctacattgtggagccgtaa

SEQ ID NO: 20616 - DNA, 279 bp, Glycine max
  Peptide Sequence Number=SeqID_112301
atggtgaaagttggaacctcttacgtgccgatcaacgtctcattttcgcccaaaagttggcccagggcttccccggtatcaacagggacacccaggatttatttatttctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 20617 - DNA, 299 bp, Glycine max
  Peptide Sequence Number=SeqID_112302
ttcgtctttgtcgcaaactggcctgcacttctgtgactgcaaccacattgtggagttcatgtgtgtgaagttcgtctctgccacttatcgattgagggtgggaatcgattttggaagtgcattgtggttcgccttaagactcccagggcgttcttcttatttctccttctgccctaagttcgtctttgtcacaaactgggctgtgcttccgtcgaagaaaactacgaaaggaaatggggggaagcaattttggaagtccattgtggttggctttaagcctcccagggaagccatcgaag

SEQ ID NO: 20618 - DNA, 477 bp, Glycine max
  Peptide Sequence Number=SeqID_112303
atgactaggggaaatccaggtgatttacaatcctttgatcctgaaatagatagaacctttcatagattagttaggcatagtgtgcatcttgatcattttgtgcattttgagcattctgagtattctgttgctggtaattctgaatattctgattttgagcattcgactactaattttcatactgagaacatggctcaacctccacctcatgagaggactcttagggagatggctgcacttgatttcacttatgaaagcttgtgcattcaatatcctgatgagggtgttccatatgttctcaagactagactaatacatttgttgcccaagtttcatggtcttgcaggtgaagatcctcataagcatcttaaggagttccatattgtttgttccaccatgaagccccctgatgtccaggaagatcatatctttttaaaggcttttcctctttctctagagggagtggcaaaagattga

SEQ ID NO: 20619 - DNA, 201 bp, Glycine max
  Peptide Sequence Number=SeqID_112304
atggactcgggaaggttccaaattagtataccaggtaacggctgccccagtaagactttcttggaagaaatgcatcaacaatttttcatttctcgagtatgcctccattttcctattgtacatcttcaggaggtagtctttccaatgcaaaatgcaagggttgtggttgtgggtggtactgagggccccccgaggtgttag

SEQ ID NO: 20620 - DNA, 333 bp, Glycine max
  Peptide Sequence Number=SeqID_112305
atgacgagacaaatgcaatgcacgagtgacgataaagtatgggtatacatgcgtgagagcacgtggtttctagagatatcatcctctttgatatcaaacaatgtggcagaaggaactaccaacgacaacgcatcatcaaagagaaaaactctagatgaggtttcactgtcatcaagcgagtcggagactcagcatgaccacagatcaacctccacttcctatattcccatggacccagaaaaagatacaccaaatacaaaaacatccaaagagttatatggatacaagaacataaaagaaagaaagggaaacaacacaaagccgaagtcatga

SEQ ID NO: 20621 - DNA, 325 bp, Glycine max
  Peptide Sequence Number=SeqID_112306
catgatagaacttgtgaaagtggtcgacaaaagcgaggctcttgctcctacgtatcctccaatgaggaactcagacctacttgcggataaccgtaaggtgtctccgggggctaccagctcttgggtcatggtaacaaaaagcggtgtggtcgacaaaagcaaggcttttgctcctacgtatcctccaatgaggaactcagacctacttctagcttctcatctcaaggaggtgagcttagctattagagagcttctcaaggaagttttctcaaagaagcttctcaaggaagttttctcaagaaagcttctcaaggaagctacctag

SEQ ID NO: 20622 - DNA, 489 bp, Glycine max
  Peptide Sequence Number=SeqID_112307
atgaccagtaatctgcttaacctgcgccagcagcgcgcgacgcgcacgctattttttatcgccggactgggcatggccgcctgggcgccgcttattcccttcgccaaagcgcaactggcgatcaatgacggcatgctggggctgctgctgttctgtatcgccgcaggctccatcgggcgcgctgttgctcttcggcgcgatcaacggactgatggatgtcagcatgaattatcaggcggtgatcgtggagcgcgaggccggggtcagcaagatgtcgggctttcacggcttttacagtcttggcagcattgctggcgccggcgcggtgagtctgctgctgtggctgcaggttgcgcccctgctggcgctgctgccgctgtgtgcgttgattgtattgctgctgctgatgagccataccgccctgttgccccgtcgtcgcacggatgcaaaaccaacgcgcggtacgctgcgcgccctgacgcaccgtaa

SEQ ID NO: 20623 - DNA, 591 bp, Glycine max
  Peptide Sequence Number=SeqID_112308
cggttatgcgagaccgagaccaacatgttagccatcatcagcaagtaccaagaagaattaaatctagccacaacctacgagcacaaagtggcggacgaatatgcccgagtgtacgtggacaaggaggctagaggaagggtgatcgactcgttacatcaagaggcaacgatgtggatggaccgatttgctcttactttgaacgggagtcaagaacttccccgattgctggccaaggccaaagcaatggcggatgcctactccacccccgaggagatccacggactcctcagctattgccagcatatgatagacttaatggcccatataattaggaaccactacaaagaagtacaggaacagttgaaagctgacatgtcggctttgaaagagcaaatggcttccatgatggatgtcatgctaggaatgaggcaactaatggagaataacggggccaccgctgccactgttagttcggctgccgaagcagacccaactctcccagctaccgcgcaccatcctatcccaaacgtggtaggacgagaaagaagcacactggggcacatcagcaacccccatccgggatacaactga

SEQ ID NO: 20624 - DNA, 225 bp, Glycine max
  Peptide Sequence Number=SeqID_112309
atggacagattcaggttggtttacggcttagtcacaggcatggacatgaacatcggagccataatctcagttaacttcagaggggccaggaaggtaagggctcaaccagcagatgttccttcttcttctgcaccaccggctcctcccacttctgctacgcctacaccagctgcccatgactctcagcactttgaagccatgcttcagagtattcatcagggatag

SEQ ID NO: 20625 - DNA, 638 bp, Glycine max
  Peptide Sequence Number=SeqID_112310
ccgccgacgtcgccacggttgtcgagcgcgtggccgttgcgcacgcccgcctgcaccagccagaaggtgttgtcatggatctgcccggccagcgcggcgttggcgccccaactgctgtcggcggtgtcgtagtcggtcttggccagcgcgccgaaggtcttgccgtcggtcagcaggtcggccgggctgagcgtgtacaggtcggccagtccggaaatggcccccgaaccgcccgagccggcgtcggcgccacgcacgatgtccaggcgcgacagcgtattgaagtccaccgcctccaggccacccttgacgccccgggcgccgtcgtcgagccacggcagccggatgccatcgacccgcgtcagcacgcggtcgctccagttcttgatctgcagatcgtccatgcgcttgcggtcggtgcgcgtttcccatgccggcgccgccaccgcgccttcgccctggaccgtgaccggcgcgagttgcgcgacacccggctgcgacaaggcctgcaacacgaatacgccggggctgcgctcgcgcgcggccaggccgctgccggccagcaggcgggcaaagccgtcagccacggtgtattccccattcaagcccgcgccacggcgctggcccaccagcgtcgc

SEQ ID NO: 20626 - DNA, 447 bp, Glycine max
  Peptide Sequence Number=SeqID_112311
atgcagatgaaggatatcgatgttggatttacccacgttgcgtttatggtgagggatcttgagaagagcatggatttctaccgccgctatgcaggaatgaaggtgatacacacccgtgaacctgacgtcccggctgcccgcaaggtggcatggctgagcgatcatacccgccctttcgcgctggttctggtgcaggcggatgacgtgtcagatacgccactgggtaaatttggacacttaggcattgcctgtgcgtcacgcgaagagatcgatcgtaaaacagcgatggccgtcgccgaaggcgtgttacgcaaagcccccgaagaggctggcgaaccggtgggatattacgtattttttgccgatcctgatggcaatacgctggagctgtctttcgggcaacgcgtcgggcttgaagcgatacgcaccgcgcccggtttactttaa

SEQ ID NO: 20627 - DNA, 280 bp, Glycine max
  Peptide Sequence Number=SeqID_112312
atgcgaggtaaccctttagcaggtgatttagctccattggatttggagatagaagccacttgtaggaggaataatgcagagagaagaagaaaaattttgcaagataggacaacacaaccaggttcagaggaagctcaatcttctgagtcatcttctatctttccagagccaagagaaccaggagtaggtgcatctgaggttgatatcatggctgaagatcaacctaggaggattactcttgaggattactctagttcaaccgtgccgcaattcttcacaa

SEQ ID NO: 20628 - DNA, 315 bp, Glycine max
  Peptide Sequence Number=SeqID_112313
atgcctcaaaatgttctttacgatgccattgggatatatcaacggtgttggaacctcttacgtgccgatcaacgtctcattttcgcccaaaagttggcccagggcttccccggtatcaacagggacaccaggatttatttattctgcgaagtgatcttcccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 20629 - DNA, 487 bp, Glycine max
  Peptide Sequence Number=SeqID_112314
tgtggatattgctgtttctgaggcatcaaattgccaaggaaatcactgccaaacaagtccagcattggccaagaaagggaagctttctgcagggaagctgagtgtgaagtatgctatcctgcataggattggcgctgcaaactgggtaccaccagccatacttccactgttgccacaggggacacatgtcccagacattgtctcgacatcagggaaagctgctgcttcaggtgctgtgtccaaggatgctttgattgctgaactcaaggacacatgcaaggtgctggaggcaaccatcaaagccatcacagagaagaaaatggagctggaacggctgatcaaaagactcacagacagtggcattgatgatggagaagcagctgaggaagaagaagaagcagctaaggaagaagaagaagctgctgaggaagaggaagatgcagcagaggatacagaatcagatgatgattctgaagccaccccatga

SEQ ID NO: 20630 - DNA, 290 bp, Glycine max
  Peptide Sequence Number=SeqID_112315
ctgtccccccctgttcagctactgacggggtggtgcgtaacggcaaaaagccccccccggacatcagcgctggcaagtgtagcggtccccctgcgcgtaaccaccacacccccccccgcttaatgcgccgctacagggcgcgtcccattcgcccattcaggctgcgcaactgttgggaagggcgatcggtgcgggcctcttcgctattacgccagctggcgaaagggggatgtgcctccaaggcgattaagttgggtaacgccagggttttcccagtcacgacgttgtaa

SEQ ID NO: 20631 - DNA, 285 bp, Glycine max
  Peptide Sequence Number=SeqID_112316
atgttgtggaaccttacggattacgtaataatccctttttttccttccggaacgttacagaactttatggattgcgcactaacacttccttttaatttctggcatgtcacggaacttcacggattgtgctacaacacttttcttttggcttccggcatgtcttggaacttcacaaattgcctaacgatgggtgccaaatacctcgaagtggtcaaacgagggtcgcatcccaacaacggatggtcctcggacgaaattagggaattaatgaagcattgggcttga

SEQ ID NO: 20632 - DNA, 252 bp, Glycine max
  Peptide Sequence Number=SeqID_112317
atggatttatgtgtgatttgtggatgtggagagtcgacttgcaccatcgtccgatcgccacctagtaccacatatgacaggggtcaggagaccttggggacgttaggtggggtgctatttcccaaaaccaagcttgaccaatcccgacccaacccgggcatagcgagctcctggcagtcaaccgataaaagaacaaagaccacaaagcaaggaggcttgtgtggtggctggccagctatggatcttgagtga

SEQ ID NO: 20633 - DNA, 420 bp, Glycine max
  Peptide Sequence Number=SeqID_112318
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataaaagtatgaggtgtgggacagtgggaaattctcatgagcag

SEQ ID NO: 20634 - DNA, 58 bp, Glycine max
  Peptide Sequence Number=SeqID_112319
ccttgggattcgtgcagggcattctgttatgccattcattattcagagctttgtttag

SEQ ID NO: 20635 - DNA, 340 bp, Glycine max
  Peptide Sequence Number=SeqID_112320
atggcccacttggagctctcgattccatggcgcggctcaacagagcagccgcaccgtcctacctatttaaactatcctgagggaaacttcggagggaaccagctactagacggcatagttcaccatctttcgggtcccgacaggtatgctctcactcgaacccttcacagaagatcagggtcggtcggcggtgcaacccacagggggatcccaccaatcagcttccttgcgccttacggggtttactcgcccgttgactcgcacacatgtcagactccttggtccgtgtttcaagacgggccgaatggggagcccacaggccgacgccaggagcgcgcag

SEQ ID NO: 20636 - DNA, 416 bp, Glycine max
  Peptide Sequence Number=SeqID_112321
gttctatccttccaccgacaaagagttgccaaggtagtgaaaatctcagcacaagagttggaccgggtaaagcaaaacagaaatggggtagtcggagtaccaaggaagtgtttggaaggaaagggcaaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcccgatcgtcgccattttggccatgtatgacacgttcgaccggggatgcccgtctatccgctacaaggtcaccgctcgtgcgtcgaaaagggaaaggcgaattgggaccaactcttggctagcatggaggggcgtctga

SEQ ID NO: 20637 - DNA, 162 bp, Glycine max
  Peptide Sequence Number=SeqID_112322
atgggctcaaaaatctaccctaaggttcatgagaaccctaaggccttctttatcaactctagcccaatcctcttggagcctcttgctcatggctctggtaagagggctatgaaagaaaggattagagaggctcaaagagtgtttgagggctatattgagtaa

SEQ ID NO: 20638 - DNA, 129 bp, Glycine max
  Peptide Sequence Number=SeqID_112323
atggaagtatgggaggttaatgttagcctcttgaggctttctttccttttctctcctatgggagtgaggtctaagagactatggttgaaactagccaaaataaacactaaaagaggtgtgaaagataag

SEQ ID NO: 20639 - DNA, 372 bp, Glycine max
  Peptide Sequence Number=SeqID_112324
atgagcaagtccaatttcacctcgggggggttggatcataatcttgctatgttggaagaaaagtttgttactattattgatgctagtagcaatgcaaagaaagttcattataaagcttgggaaagatctaacagactcagcctaatgttgatgagaatgactgttgcaggcagtattaagacaactctccctaaaatcgaaagtgctaaaagtacgttagttcatgaagaaacgaggtttaagaatcaagaaagtcacttagtccattatgtaagccaccaagggaatcaaggagttggaaaaagattggtgaagaagcatgatagaggcaaagggccattaaagatcaatgacaattctatgcaaatctag

SEQ ID NO: 20640 - DNA, 101 bp, Glycine max
  Peptide Sequence Number=SeqID_112325
atggacccgaaatctaccctaaggctcatgagaaccctaggaccttctctttcatctctagcccaatcttcttggagtcttctatccaatgaccttgaggg

SEQ ID NO: 20641 - DNA, 894 bp, Glycine max
  Peptide Sequence Number=SeqID_112326
atggattcaagagcttacatccttagagtcaccattgcaattctttgcatctcaatgctagcttccactcttttccctgtgtgtgatgctataaatcatggaagagcaataaggggtcacaaaatccgtagaagctccccaatcaaatctttaaagaaactgaaaataaaatctttaagacatttaaacaagtacacaccatttgattcatttgggtactcagactttgattcatatgggtactcaaactttgatgattcatatggctctccctcttccctacccttaccacctttcaattcactagcaccacatccacaacctacaccatcaagttccattgctcctccaaatttggcacctccaagcataggtggcaactcctctctcccagcactctcaccagttccaagctcacctcatggtgctgtctttgggccaccaaacccaagaagcatgccaccacctccttatcccttaagcccaccaaagcatgctccaagcctaagcccaccaaagagtgctccaagcctaaacccaccaccactagtgtacctcccacctgttgtgttcccaccacccccttcaccttctacgcaccgcaaaaagccgccacaatacgcactttggtgtgtggcaaagcccacggttcctgacccaataattcaggaggccatggactatgcctgtgggtctggtgcggattgcaagtcaattcagcccaatggaatgtgcttccagcccaacactttgctggcccatgcttcgtatgccttcaatagctactggcagaacactaagattggtggaggcacgtgtgattttggtggaactgccatgctagtcactgttgatccaagtaagtatctatgtcatattcagaaatattattag

SEQ ID NO: 20642 - DNA, 549 bp, Glycine max
  Peptide Sequence Number=SeqID_112327
atggctccttctgataaaaatcaatcggcgaaacatgattctgggacttcccctgctacccatatgcacgaagcgctcacccctgaacggcttgacgacaccaactatgtcgagtggtcattgaacgcacagaacaagatcagaggaaggcagaaaacgttgggtcaagtcttggcttctggactccatgacgaaggaaatcaaatccctctttattcgcttagctacgacaaaggacatctaggacactgtgcagcaaacatactcagtcaaccaggatgcgtccaggaaaatggaagttctgttattacatactttggtaaattgcaaagattatggttggagtatgatactatcacgaatcgtaccatggaatgccctaaagatgttgagaagtacaacgacatgattaattaccaacgagtttatgtctttttagctggcctggattcacatttggatgcagttcatggtcatatccatgctatcactccccttccaaatgttcaatcagtttatgcaactgtttgtgccgaggcaaaccgctaa

SEQ ID NO: 20643 - DNA, 1275 bp, Glycine max
  Peptide Sequence Number=SeqID_112328
atgcggatcggtcagggtgtggttgcggtgatgtgccaggtgcgaatcccggtagagaccatacggataccacaccgccagcggcagcatgccaaacagctgattaaggtgcggcaggcgcgtcggatggccatgaatcagctcatgctgcagcgacaaataccaggtcggcaattcgctgcgccagagccagctgcgcgccagctgatgcaccacttcgcgctgttgcgcactgaggatgtgctgctgcagtcgattgacctggcggtcgccgccgaagaactgggggccgacggtgcctatttccgcgtacaccactttgcccgccagctgagttcaccgtttccgctgctggcggcggtcggtgccaaaaccagccgcatcgagattggtaccggtgtgatcgacatgcgttacgaaaatccgctgtatatggcggaagacgccggggcagcggacctgatcgccaacggccgtttgcagctcggcctgagccgtggctcgccggagcaggtaattgaaggctaccgctactttggctttaatccgcgcgaaggggaaaccgatgcggatatgggacgtcgtcacaccgaagagctgctggaagtgctgcgtggcgaagggtttgccaaacccaatccgcagccgatgttcccgaatccaccggggctgctgcgcctggagccatattccgaaggcctgcgcgagcgtatctggtggggctctggctcgaacgccacatcgatctgggcagcccagctggggatgaatttgcagagttcgacgctgaaggatgacgagaccggcgaaccgttccatgtgcagcaggcgaagcagattcgcgcctataaagaagcctggcaggcggcagggcatcagcgtgcaccgcgcgtgtcggtcagccgcagtatttttgccctgatgaacgacaccgatcgcgcttacttcggtcgcggcggacaggagcaggattccgtcgggttcctcgatgagaaaacccgcgccatctttgggcgtagctatgccgcagagccggagcagctgattaaacagctggcacaggatgaagcgattgcggaagccgataccctgttgctgaccatccctaatcagcttggcgtggattattgtgcgcacgtgatcgacagcattctgacccacgtcgcgccagagctcggctggcccattaatccacgcccagctcccaccacagcttatccagcgcataataacggtcgcgctgcgcctctggctggttcaagtcgcgcttccacg

SEQ ID NO: 20644 - DNA, 441 bp, Glycine max
  Peptide Sequence Number=SeqID_112329
atgtcctttcaagccttggaagtagtgagcaacgcttatgtggagtctcccccggtacaaccacgctcatctggggccacattgatggtggcttcggtgatgttgggacatggatacgagcccagaatgggtttaggccggaacgacaatggcatggcgagtttggtagagttcacagggaaccgcggaaggttcggactgggatatgagcctacgcacatcgacgtgagaaggattgccctagaaaggagggtaagaagcatgggccaacggcaaaggctgcaagtgaaaggggttcccttgtgtcacatcaacgagagctttgtcagcatgggttggatgtgcaagggatgggtcaccatgatacacaaagaaaccccgcaagagcaaccaaattgggtgcggccgtgtcctctagagttcgaattggggaactggtga

SEQ ID NO: 20645 - DNA, 438 bp, Glycine max
  Peptide Sequence Number=SeqID_112330
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggggtaggcagttcgctccaagctggactgtatgcacgaaccccccgttcagtccgaccgctgcgccttatccgggtaactattcgtcttgagtccaacccggaaaggacatgcaaaagcacactggcagcagccactggtaattga

SEQ ID NO: 20646 - DNA, 387 bp, Glycine max
  Peptide Sequence Number=SeqID_112331
atggatagagctatgctgatctttggcctagtctctcgcatggacatgaacatagaagctcttatttctggtcagatgacttctatagcccagtctagcacttctagagttgggtttcctgctctgatcaccgccctatgtagagctagaggggttgtctctaacagccttacttttgagcgcctgagcccgatcattaacttggcctacatcaggaagagctgttggaatcctaaggatctaacagtttctatccgaggggctaggagggtgagggtggtggcgcctacaagatccattccttccgttgagcagtttctaaagagtgtagcctggcctgggacccaaccttctcttcacagggaagatgaaggtcccacaacctag

SEQ ID NO: 20647 - DNA, 189 bp, Glycine max
  Peptide Sequence Number=SeqID_112332
atggtacaatcctcttgcccgctgagctcccttttctcctcggtccacagagacaaaaatatatcccttcaacacaacataggtcatcgaaaggatctcgaagacccaccaacgcacgaaagccgggatctttcagaaaatggattcctattcgaagggtgcataaccgcatggataagctcacactaa

SEQ ID NO: 20648 - DNA, 563 bp, Glycine max
  Peptide Sequence Number=SeqID_112333
agaccaagattggtcagtcggcacccttgtatcatccagagccgccgggcccgatgatacgcggagataccttacgagttgcattctgcacccttgtgtcatccagaggcggcgggcccgatgacaagcagagaccaaagaccaagattggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatgatacgcggagataccttatggttatccgcacccttttgtcatccagaggcggcgggcccgatgacaagcagagaccaaaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaagtctg

SEQ ID NO: 20649 - DNA, 348 bp, Glycine max
  Peptide Sequence Number=SeqID_112334
atggaagtgagggacaaggttgagctccttccatatagggacctagttgacctagtccaactttgcataagggtagagcaacaacttaaaaggaagcctacttcaaaatcttatggctctcactcttatataaagaaagaccaaggtcaaggcatcttaggggctgcaccttctaagcccaaagatgataaggggaagacaatagaaaagcaaccccctaaggctagtataggacacattgcttctcaatgccccttcgagaaaaccatgattatgagaggccaagacatttatagtagccaagatgagatagtggttcatgttgcaattgtagtagcacaagattag

SEQ ID NO: 20650 - DNA, 363 bp, Glycine max
  Peptide Sequence Number=SeqID_112335
atggtccatgacatctctgtcaaggtgaaactggaagtaacaaggacatcaacaatcctaaatatgtttggcagtagacgaagcagtgatgtgactcgattcatcttttgccctaattttgcaagacgagatgcttatgcgatgcatgatatgaatgcattttacggacacgagagcccggaaaattatctcttcttacttgcgcatttcgcggtgcagtgccccatgtgtacaattaagaaggtgatatggaccttccggcttcccgtgacaaaggacgagaccaacatacaatgcatgctagagataaaatgtgggagtgacttgattcgcactgatttttggagtaaaaacgtgggataa

SEQ ID NO: 20651 - DNA, 234 bp, Glycine max
  Peptide Sequence Number=SeqID_112336
atggctcctcatttctactccaaattgcaaggagaagccattttcggagtcgtaaagcacacctctatgttgtgggacttcgaatttcaggtagaaaagtgggagattttgagggttagagaagccaaatttggggttagtggaaattggagtctaaagtggcttgattctagtttaaaatgtcaattaggactagtaggaaagcttggaagagcaaatgagaaaaatgagtga

SEQ ID NO: 20652 - DNA, 489 bp, Glycine max
  Peptide Sequence Number=SeqID_112337
atgagtgagattgtgatacgccacgcggaaccgaaagattatgacgccattcgtcagatccacgcccagccggaggtgtaccacaacacgctacaggttcctcacccttcgctggaaatgtggcagatgcggctaggcgaccagcccggtattaagcaactggttgcctgtattgacgatatcgtggttgggcacctcaccattgatgttgcccagcgcccgcgccgcagccacgtggccgattttggtatctgcgtaggcgcacagtggcacaaccgcggcgtcgccagcgcgctgatccgcaccatgatcgacatgtgcgacaactggctgcgcgtcgaccgcatcgaattaacggtgtttgtggataacgagccggcaatagccgtgtacaaaaaacacggattcgagattgaaggtactggcaagcgctacgccctgcgcaacggtgagtatgtggatgcgtattatatggcgagaatgaagtag

SEQ ID NO: 20653 - DNA, 606 bp, Glycine max
  Peptide Sequence Number=SeqID_112338
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaaggtgaacccgacgtccccatccggcatcaaccaaatgaatcatccaacctcagatatggtaggcaaagatttgggaagtatgggcggcccccatgatgtgcaaattcaaaacgagcacaccttcccgccatatggcttgcctctcaactatacgccacccaatgtggcgtacactcccaataagaatacacatgaaattccccaccacaatctagccgacttcgagccttggctcggatatgccactgaagggcaagcagttggtggtataccccttgaaaacacttcggaaggccctcagtatcacccccagctacacctcttgcattccacgacaagtaaaaaccctcgtgctatggcagaaatggaaaagttggatcatttagaggaaaggctcagggccattgaaggaggtgaagattatgccttcgctaacttaaagagttgttcctag

SEQ ID NO: 20654 - DNA, 205 bp, Glycine max
  Peptide Sequence Number=SeqID_112339
gcttcccggtattcaacaagggacaccaagaatttatttattctgcgaagtgatcttccgtcacaagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 20655 - DNA, 117 bp, Glycine max
  Peptide Sequence Number=SeqID_112340
atggctcaggagcggacatggatgtcttgtgtcttgttggaacaaatctgccaagacagctaccaccagactttccttgctatggtggtatgcaaggaaagcgtcgattgctgctag

SEQ ID NO: 20656 - DNA, 729 bp, Glycine max
  Peptide Sequence Number=SeqID_112341
atggctaagtttgacccagatatagtcctggagttttatgttaatgcttggcccacagaagagggagtgtgggatatgcggtcatggggtgacccgctagtgctggaggaaggccaggagtgtgagtttagtcagaggaggaacagggtcgataggttcgacgaggaggccattgcccagctattatgcatactgggtcaggatttcgcccggatcgctgccgagaagcgggtgcagatcatgcgcaccatcatgaccaccctgacccagatgtggatgacattgctgctcagcaatgtcctgcctagtgatcataactccaaccttcctctgtcgaagtgtcagcttgtgtatgccatcctgacacggatgagcgtccatggccctggggtttctagcattgatcacgggcctctgccagtcattcaggggttcccatcacacctaggtgatgcaccgcaggccgcagacgcaccgccaccacctcatcaggctgatccagttgggtcatttggcatggagcggtatttacagcacttggttcgccagcaggcggccaaccacagggggcaggtgcagatccatgagtgtctctaccagcttagcctcaatcagcaaagccagggtttcgctccttttgcatgccttactccagatcagttcagggcggaggcaggggaggcgcctgcagaggctcctggcgatgcagaggaggcccgcatggattag

SEQ ID NO: 20657 - DNA, 123 bp, Glycine max
  Peptide Sequence Number=SeqID_112342
atggagtcgtcaactgtcacaacatgcccttttacgggcgagcaaggcgaggctcacgggtcgacaaaagcggggctcttgctcctacgtaccctcatcgaagaggaaaacagacctacgtag

SEQ ID NO: 20658 - DNA, 327 bp, Glycine max
  Peptide Sequence Number=SeqID_112343
atgacgagcacacgttgcgttcgagtcgtatcctcaaaaaaatggagattgaggaaacctagcagggtttatggctaccactgcattatcgagtggacatggaaccaagtcaacataggacaccggaatttgggtgaattctacaggttttttttcgctgcaaaactcatttcttggcgcgtgtttttggattgtgctaaagggatggcctttgtcgataactgggcggtgggtaaggagaaggtgccacttgagctgccaggtctctccaccttcgggcgtattcttttgaaggattcgtgccccctttttgcacatgttttgtag

SEQ ID NO: 20659 - DNA, 255 bp, Glycine max
  Peptide Sequence Number=SeqID_112344
atggggatcgcacccacaaagacactcaatggacctaaagaagtccaacaggccctggggtttccagctctggttacgggtctctgtcggccctacagggcgcccgttccccccaacaaggattgtgcccgtaagacacctagtggacccgaagaaggccaacagggtcttgagttgccagctctaaatacgggtctctgcaggcacagggcgaaacaccacagcagcattgggatggccggtagcgggcaatag

SEQ ID NO: 20660 - DNA, 570 bp, Glycine max
  Peptide Sequence Number=SeqID_112345
atgggctccagattacccggattatgtggtgtggactacaatggaaagaagcaccatataagagttagaaaatttagtaaccgagtctacattgctgatggtctcaaacacttcaggagggatatgggaatatatgaaggtgtgatgatcacatttgctgcgccggacaagaattggaagtttgatatccacttctcaccgccactgcatgcacagacatgtggcaggcctgtccattctgccagagaatatgtgtttactgtggatgtcgacaatcggatgattgttagactttatccattggtactgccactcgatgttgtgggttatgttaatgcaggagacggctatgttactgtccttggtgtttgtgggcattgtcacttttggaagttgagtatgcataatgggcttaaatgttttgctgacccatggttccaattcttaacagaaaacgatttgatggccggtgacgaagttgtcttttatttcaggccaaatcaacttctttgggaggttattgccagaaagcaaactgtgtgggacgaggacgaggacgactccccatga

SEQ ID NO: 20661 - DNA, 694 bp, Glycine max
  Peptide Sequence Number=SeqID_112346
catcaaattgccaaaggaaatcactgccaaacgagtccagcattggccaaagaaagggaagctttcagcaggaaagctaagtgtgaagtatgccattctgcacaggattggagctgcaaactgggttcccaccaatcatacttccactgttgccacagaatcttttgctatcaaattacccattgccttccctactgtattatgtggcattatgttgagtcagcatcccaatatgttaaactacactgactctgtgatgaagagagaatctcctctatccctgcattacaaactgtttgaagggacacatgtcccagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaggctctcagagagtggcattgataatgaagaagcagctgaggaagaaggagaagcagctgaagaagaagaagaagctgctgaggaagaggaagatgcagcagaagagacagaatccgatgatgattctgaagccaccccatgatcatcagacctttaattttggggagttgtatgaatatgagtttgagggggagactgctgctgatgatgactga

SEQ ID NO: 20662 - DNA, 657 bp, Glycine max
  Peptide Sequence Number=SeqID_112347
atgccaggcaggtcatttgacagctgcggctcacgcatatctttcttcacctactgggttacactctgtttgctaaccaagagtgcaaccaatgtccatgttgtctacttggaggcccttcgtgaccttagtatgacagagaggtacgcctggggagtggctgctctggtggattgcgacgaagaagatcgtgaagagcattcgcacgacgtcgtacagggagcgcctagactgactccggattccgaatgtctgttggatcccttatggggagcatcgggaggtccgggacttccacgtcagatcatgctattccgggtcgtgcggcagtttggctacacgcagaccattcctgctcctcctgtcgattcatgggtctcgtatgatgatatacacgacaggtggatgcactacgaggatcatatggtactagtaggtgaggtgtgcgttgtgtcagtggcgtgttccagtgactacatcgactggttcttccgcatctcccatcctttcatgacaccaggccacacattagatcctctgcctcatggtcatgccctacatccccgagtcatccctcaggccccgcagacggatatccctcccgtgccggagccaggagcattgtcgacatctgtggaggatcccagacatgcagtg

SEQ ID NO: 20663 - DNA, 243 bp, Glycine max
  Peptide Sequence Number=SeqID_112348
atgccggttgccgcttccgccatttactttctcaacctccgcggcgacgttctcatcaaccgcctctatcgcgacgatgtcggtcgggaaacctgtcgtgccagctgcattaatgaatcggccaacgcgcggggagaggcggtttgcgtattggcgctagcggagtgtatactggcttactatgttggcactgatgagggtgtcagtgaagtgcttcatgtggcagagaaaaaagctgcaccg

SEQ ID NO: 20664 - DNA, 490 bp, Glycine max
  Peptide Sequence Number=SeqID_112349
tgttctctcatactccaacctggctctgacttcccacacctcggatttgactgtggatagagctaggttaatcttgggcctagttattcagctagacatgaatgtcggagctctcatctctggacagatcacatcaatggcccagtctaactcctctagactcaagttccctgctcttatcacagctttatgtagaagaccaagggcaaggctagctgaggttccttctacatcagcagctcctcatccaacttctacatcagcagctcctcctccagcacactccatcccgacggtagagcaatttaatgaatgggtagtctggccagggactcaacctcctcttcacagggaagacgaagatcccaccgctcaggaagctgcagccacctctgaaaagtctcttgaagccactccagagccttcgacactagtggcagataccacttctccgcagcaggcagcagacccttccatgcatgaggattaa

SEQ ID NO: 20665 - DNA, 369 bp, Glycine max
  Peptide Sequence Number=SeqID_112350
ctaaggcgttggacctctaaccatctcacgaggtcgacaaaagcggggtttttgctcctacgtatcctccatcgaagaggaaatcagacctacgtagttctcgcgaatgcggtaaagttacatgttgattttatgctttttgaacggtctatgttaaccgataaaagcaaagaggaccgtttaaggcattggaccttgtcgcaatgtgcccttttgcgggtgagcgaggcgaggctcaccggtgtgctttccaaaggaggaaagatgcgcggagtcggcaccaacgtttatttgtggaaaacgtcagaaaaaccgaaggaaaccggtcaaaatgaaaattctaagttcgggagttgtatttatgcttga

SEQ ID NO: 20666 - DNA, 306 bp, Glycine max
  Peptide Sequence Number=SeqID_112351
atgttggggaagcttgggaggattgatggggacccgatgttgagagaaacgaggatatgggctacgtgggagtacgtgagctcagttggaggtgggcaacaggggatggtgggtttatgcgcgatttatgggatgtggaaaatttgttgtgcaccatcgcccgaccgccacctagtaccacatgtgatggagtggtacctggagatatgtcgcgggggtcaggagaccttggggacgtcaggtgggtgctattgcccaaaaccaagcttgacaatcccgaccaacccgggcatagtcggtcaatga

SEQ ID NO: 20667 - DNA, 693 bp, Glycine max
  Peptide Sequence Number=SeqID_112352
atggacatcctggcacttttgatcttcggggtggtcctctttccaaatgtggatgggttggtggatcgggcagcgattgatgcttttcttgccttttacgacctcaaggaaagcccggttgttgctatcttagccgatctatatgacacattcgatcgaagatgtgagaagaacaatgcaaggatcgtttgttgtacatcggctctctacatatggttggtttcacacttcttttgccaagagatgagacacgtttgcccgctagaaggccaccgctcatgcatcgagaaaaaagaggcaaactgggaccgactcttagcaagcaaagaaggagagtctgtcaattggttcccccaatggaaggaaggaagaaccaaaattcttatttcgtgtgggaaatttccaaatgttcccttaaaagggacgagggattgcatcatttacaatcccgtcctcgctataagacaacttggttaccctatgagaggggcgccatcagaggaaggcctcataccttttattacacgaggtttcaatagcaccaacacgggggtgcttcagagggtccacaaggcatgggaaatgtcgcaaaggaaggacaaggaacttaggggagtagcaacgggcccatcggcggttaccatagtggttgaaagcctacgcacaagatctagattgggctcccgagtttga

SEQ ID NO: 20668 - DNA, 195 bp, Glycine max
  Peptide Sequence Number=SeqID_112353
atgggattgtcatcatcaaaaagggagattgtggaagcaatgccttccaaggttattttgatgatgccaaagaatcaagagttaagaaaattccaaagattcaagaatcaagtttcaagaatcaagattcaagattcaagactcaagattcaagaatcaagaatcaagagaagactcaatcaagataagtactaa

SEQ ID NO: 20669 - DNA, 523 bp, Glycine max
  Peptide Sequence Number=SeqID_112354
atgttggtgcgcatgatccgcactcgtctctttgcagcggcgcgggtgaaatcttgccccagtatgcatagtagcagtgtgatagcctccctctctagtgtgctcgcacagtgtgcctcctccaatatcagggggtggcccaggaacccctctgatggtgaggacgtcgtagtcctctcaaggcgaggacgtgtagtcctctcaacggtgagggcgaggacgtgtagtcctctgatggtgagggcgtgcagccctctgatggtgaggacgcgtagtcctctaaggcgaggacgtgtagtcctctcaacggtgagggtgagggcgtgcagccctctgatggtgaggacgtgtagtcctctcaaggcgaggacgtgtagtcctctcaacggtgagggacgtgtagccctctcaaggccaggacgtgtagtcctctcaacggtgagggtgagggcgtgcagccctctgatggtgaggacgtgtagtcctctcaaggcgaggacgtgtagtcctctcaacggtgagg

SEQ ID NO: 20670 - DNA, 246 bp, Glycine max
  Peptide Sequence Number=SeqID_112355
atggagcagtatttacgacatttgttcgcagcaggcagcaactaccgggcacatagccagggcttcgcttctttttcatgccctactccagaccagttcagggcagaggtcgcatggcccagggattggcccgaggcccaagcaggagaggcgcccccagaagctcccggcgatggagaagaggcccacgaggacgaggagatggccgatttgcttgacttcttgggagggagtggagctacatga

SEQ ID NO: 20671 - DNA, 177 bp, Glycine max
  Peptide Sequence Number=SeqID_112356
atgtatacagagcgtaggcttgctttgagcactctaatttcttcaaaactcaatgagcccggtattgttatttattgtcactacctccccgtgtcaggattgggtaatttgcgcgctgctgccttccttggatgtggtagccgtttctcaggctccctctccggaatcgaaccctaa

SEQ ID NO: 20672 - DNA, 1107 bp, Glycine max
  Peptide Sequence Number=SeqID_112357
gtcttggcaagccgttggttgaaattttgccccccggtcaacttcgtggtttttgcccgttgttggcttggctagggtcggcggtgctgggttatggccccgtgctaagtttcggattggttggccccctcctcccccccgtgatcagttttgttgccaggattttgccaactttggcttgcgccccgttggctaagtctgtgcctcggtggcaaaacgagagagagccgacgaacggtagcctcttttggccaaacatagtagaagaagaaagggataccggattgattggggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctgggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggata

SEQ ID NO: 20673 - DNA, 609 bp, Glycine max
  Peptide Sequence Number=SeqID_112358
atggagctcaagactccgttgagagagtttgaaagagaccatcacgagtacatggcatgcccgtcttgggggattagaaaactgtacctttgctcaagtccaagaggagtttcttccctgacacttgaagccggagtaaagcatgctagcatatgtggtcgacaaactcacggcgtagtgaggactgtcgcggacaatacttcgagaaggcaagggagggatatggcaagccaagagaagtgggtcccgtttgcggatatactagctttgctgatctttggggttgtcctctttccgaacatagacggtttggtggacctagccgcaattgatgctttccttgcatatcaccatagcaaggagagtgcagtggtggctatcttggcggacttatttgatacctttgaccggaggtccgagaagaacagcgcacggattgtctgttgcttacccgctctctgtgtgtggttgatttcgcacctattccaacaagatgaggcagcgcaatcaattggtttcctcgatggaaggaaggaaggaggagttctttttctcatgtggggactaccctatgtcccgttgatagggacgagggttgtattactataa

SEQ ID NO: 20674 - DNA, 182 bp, Glycine max
  Peptide Sequence Number=SeqID_112359
ctgggcttagcgggccaggaagcgctaagcaccaatctcttacgggttttgaatgcttggaagctaagcgcatattgcagaaaattgttgtgttgcagaaagcgctaagcgtagcctgctgcactaagccccagatgctcacgggactttacaacttcaagttgggcttagcgcaaggctag

SEQ ID NO: 20675 - DNA, 911 bp, Glycine max
  Peptide Sequence Number=SeqID_112360
ccagagtcagaggccatttagtgaagattgatgctgattgtctcaacacattcctagagacacctgtggtattggcaaaggattacagagagattgaggctgccttatgcataccgggccgagggttcattttgaatgttgagggtcatcctgggaggattctcaggaaagatttgactactttagcccaggtgtggagtgttctctcatactccaacctggcccccacatcacatacctatgatctgacagtggacagatctaggttgatctttggcctagtctctcgcatagacatgaacataggagctcttatttctggccagatgacttctatagcccagtctaacacttctagacttgggtttcctgctctgatcaccgccttatgtagagccaaagggtttctatccaaagggctaagagggcgagggctaggccagctaagcttccttccacatctacagctcctactccagcatccacttcaacaggtggtggcgcctccaggatctattccttccattgagcagttcaaggagatggtagcctggcccgggactcaaccttatcttcacagggaagatgaaggtcccacatcccaggtaccacaacatgtggaggatgagtcatctaaggccaccattccagagccatttgatttaggggaggaggcaggtgagacacaggtaagacatgtagttgctgccactcctgagagatctcttgaggccacttcagagcctcctgcaccagtggtggacctaccctcacctcagcatacaacagttccctccactcctattctagaggtaccaaaggaaccaaccacaccagtcctggctatggacacttctcctcctactactccagtacttcatctgacagatgaggaggatgttcagacatag

SEQ ID NO: 20676 - DNA, 620 bp, Glycine max
  Peptide Sequence Number=SeqID_112361
gtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 20677 - DNA, 552 bp, Glycine max
  Peptide Sequence Number=SeqID_112362
atggacgcttctgcaggtgggaaaatcaaattgaagacccctgaagaagccatggatctcattgaaaatatggctgcaagtgacattgctattttgagagatagagcccacattcctactaaaaagagtttattggagctaacctcccaagatgcattgttggcacaaaataagttgttgtttatgcaacttgaggcattgattgaaacactaagatgtaccatctgtgggggagctcatgaatctggatgctatatccctattgaagaacaaaccactcatgaaggacaatggaggaaccaccctagaaatcaatttaatagagatcaaggtggaccatccactaggccacgacaacaagggcctagtctctatgatcgcacagtgaagctggaagagactctagctcagttcatacaggtttctatgtccaaccagaagagcacagattctgccataaagaatctggaggtccaagtgggacagctcgcaaagcaattggcggatagatcattgttcggtcgcgacaagtgcaccagatcgcgcaagtag

SEQ ID NO: 20678 - DNA, 255 bp, Glycine max
  Peptide Sequence Number=SeqID_112363
atggattcccctgacttaccagaggataatgtggacccgctccctgatgttgattctctagagaatattatgccagcatctgaggcagactctacagaggagagtggccctggagggacaacgaatagtctgatttcctcatcgcacttgaggatacgtaggagcaaaagccccacttttgtcgaccaccccaagagatcgttaatggtgcaacgccttaatgtttctctcctttcagaaccaagagatcgttaa

SEQ ID NO: 20679 - DNA, 343 bp, Glycine max
  Peptide Sequence Number=SeqID_112364
ccatgagctcgaaatctaccttaaggcttatgagaaccctagggccttcccttggatctctagcccaatctacttggagtcttctatccaatgcccttgcggggctcatgagaacctaagggccttctcttgcatctttggtccaatcttcttggagtcttctatccaatgcccttggggggtggcttggccaagagctcagccttctccttctggagggggtggggcctccgcagcccaggagcctacttctaaggagccagcagcagtagcagcagagggggaggatgagctcacccctcctaagcttttttgttttgatgcagatgctcacatagcttag

SEQ ID NO: 20680 - DNA, 684 bp, Glycine max
  Peptide Sequence Number=SeqID_112365
attctccctgctgtgatcaacaaatacctggacagaccaacagatggagtggtggatattgctgtttctgagcatcaaattgccaaggaaatcactgccaaacaagtccagcattggccaaagaaagggaagctgtctgcagggaagctaagtgtgaaatatgcaatcctgcacaggattggagctgcaaactgggtacccactaatcatacatccactgttgccacagaatcctttgctatcaaattacccattgccttcccaactgtattatgtggcattatgttgagtcaacatcccaatatgttaaactacactgactctgtgatgaagagagaatctcctctatccctgcattacaaactgtttgaggggacacatgtcccagacattgtctcgacatcagggaaagctgctacttcaggtgctgtgtccaaggatgccttgattgctgaactcaaggacacatgcaaggtgttggaagcaaccatcaaagccaccacagagaagaagatggagctggaacggctgatcaaaaggctctcagaaagtggcattgatgatggagaagcagttgaggaagaagtagaagcagccgaggaagaagaagatgctgcagcagaggaagaggaagatgcagcagaggatactgaatcagatgatgattctgaagccaccccatga

SEQ ID NO: 20681 - DNA, 255 bp, Glycine max
  Peptide Sequence Number=SeqID_112366
atggcctctggtaatcgattaccaagggtgggtaatcgattacaaggcttaaaaagtgaagacaggaagctaagatggcctctgatcgtgatggcggcgcagctaatccatgatcgagtggagatggagtgcctagagggagcttgggagaccctcgaaggcaacacgaggtgccgatttcggggcatgattcatttacggccacttcattggtgcatccagatgaacccgcgcgcacgcttcagtgtactgtga

SEQ ID NO: 20682 - DNA, 150 bp, Glycine max
  Peptide Sequence Number=SeqID_112367
atgaagatgttcttgataccacatgatgtagctccattggagcttgtagcgaaatggagaagaagaagagttgagaggagacgtcacttcaaggagaaaatgagtcaagaagaagctcaccaccataggaagccatggataagagcttag

SEQ ID NO: 20683 - DNA, 588 bp, Glycine max
  Peptide Sequence Number=SeqID_112368
atgagcgacaatacccacactacgctgagcgccaggcaggccgagcacgaccccaattttatgctgtcactcgcccgcgggctggaggtgctcaatgcttttactccccagcgccagcggctgaccatttcgcagttaagtcaaaaaacgcaaatttcccgcgcggcggtgcgccgctgcctgtataccctggcggcgctggggatggtgcacagcccggacggccgcagctatgaacttctgccgcgcgtgctggcagtgggccacgcctatctggcgggaaccccgctggcgaaggtggcgcaaacggcgctggacaatcttggtaagacgttaggtgaaagctgctccgccgccacgcttgatggcgacaacgtactgtatatcgcccgcgcggcggtcaataacttactgagcgtcgatctgggacgcggcagtcgcctcccggcatggacgacttcaatgggacgggtattgctgagcgcgctgccagaagaacaacttgaagtgacactgtcacgcgcacatcttatgcgctacacccgcataccctgtgcgaccccacggcataacgcgcggaatagctaa

SEQ ID NO: 20684 - DNA, 135 bp, Glycine max
  Peptide Sequence Number=SeqID_112369
atggtgatttttagccatgaagttgaagcggaagataaaggagaaaagatgaatggcagtgaaatggagaaggaagagagaaaggagatgccacttcaaggagaagatgagtctagaagaagctcaccaccatag

SEQ ID NO: 20685 - DNA, 99 bp, Glycine max
  Peptide Sequence Number=SeqID_112370
atggctgatggaaaactgatagagatgaagggtagaattaacctagggttaaaagggtttgaaaagccaaatctggatttagtggtaattggaggttaa

SEQ ID NO: 20686 - DNA, 684 bp, Glycine max
  Peptide Sequence Number=SeqID_112371
atgggtccgtttgaacactttgacgatctgggcgaaaccggctggtcgctgctggcgcaggcggtgaaccactggcatatgcccgccgcggagctggtgcgtccgttccgcgttctgccggactggcgtctggacgatctgatgatctccttctccgtgccgggcggcggcgtgggtccgcatatcgatcagtacgacgtgtttatcattcaggggatgggcagccgccgctggcgcgtgggcgacaagctgccgatgcgtcagttctgcccgcatccggcgctgctgcatgtggatccgttcgagccgattattgacgaagatctggctccgggcgatatcctctacatcccgcctggattcccgcacgacggctttacccatgaaacggcgcttaactactccgtcggcttccgcgggccgaacggccgcgatctgatcagcagcttcgccgattacgcgctggaaaacgatctgggcggcgagcactacagcgatccggatctgacctgccgcgaacacccgggctgcgtggagcagtacgagctcgatcgcatccgtcagatgatgatcgacatgatcggcaagccggacgatttcacaaaatggtttggcagctttgtctccacgccgcgccacgagcttgatatcgccgccgccgagccgccgtacgcgccggaagag

SEQ ID NO: 20687 - DNA, 477 bp, Glycine max
  Peptide Sequence Number=SeqID_112372
atggcatccttcaaccacatgcaatcccagtttcagtcgcagatgcaatctcagggacttgcagtgcctcctgagcctctggttggtccctccggtcctcgaatgagcacaaaggggagttgtgttgatccctcaggaaacgatcctgagacgggtgactctgacaggtgcggcttgtacatagaagcagatcctgcccgcctggttgccatcgggagagtttatgagggatccactgttgttcataacactcctttgttgcctggccaagtaaaggtgagtgtggaggaggttacagatgtagatgctccagttcctgtacccactgatgaggtttccttagtgaggcaggcacttcacaccttccttgcttggccgacacatctggtcaagtctttatcacagcaggttgtttgtgtctccggcaaaaccaccttcgaagcccgatctggagggtcgatgatccgatttatctga

SEQ ID NO: 20688 - DNA, 283 bp, Glycine max
  Peptide Sequence Number=SeqID_112373
acacttgttagcactgctacacctcttgggcttgaggttattccccaagtaaaggagttgttggatgagggggttcccacagaccctaagagaataaaggtcattcccgattggcccactccaccaacgccactcattgagttggtgaggaacaatgttcccttatgggaagatgtccatgaaaggggtgtcgagggaaggagcccagagtatgatgaacctcgggatttgaggtcaaatcctttccaaggtggaggggatgatgcaatcctaccccccaagg

SEQ ID NO: 20689 - DNA, 276 bp, Glycine max
  Peptide Sequence Number=SeqID_112374
atggcgcctaccaggcaccctctggacccggataagtccaacagggccctgggatttcccgccttgatcacaggactctgccagtcgttcggagtccccgtcgcacttagtaggttcaaggaagaggtcgcatggcctggagattggcctgaggcccgggcaggagaggcacctacagaggcaccagcagaggctcccgacgaggcaaatgaggcccgcaaggacgaggagatggccgatttatttgatttcttaggaggaagcggggccacatga

SEQ ID NO: 20690 - DNA, 276 bp, Glycine max
  Peptide Sequence Number=SeqID_112375
atgtccgccagggtccagcctatagtcttcttatgcttcttgagaactgacaacaacttctcctcttgctcatcagcaagggaggcagatataatcactggaaaactcttgctatcatccaagcttcaattctggtgtggtcggctggacagtggtggaaggggatggtttctcagcctttacctcataaagaaagtcagaggtaaaacaccaccaccaggcatgcaatcaatatcactctcagattcactctcagcatcaaattcagacatatga

SEQ ID NO: 20691 - DNA, 300 bp, Glycine max
  Peptide Sequence Number=SeqID_112376
atgccaatctccccctgcaaaagtatcagttgggtctgtgtcgtcccgacatggggatcgcacccacaagacacccagtggaccagaaaagtccaacagggccctggggtttccagctctggttacgagcctctatcagtcctacagggtgcccgtacccccccagcaaggtcatgccatcccgacatagttctacggagtgcctgtcgccccaacaaggtcattaggccccgcattaaccgggctttcatcaagaagtactgcgcccccagacgggcgcagggcgagacaccacagtag

SEQ ID NO: 20692 - DNA, 210 bp, Glycine max
  Peptide Sequence Number=SeqID_112377
ctcagcctcagtcagcagagccagggtttcgctccttttgcgtgccctaatctagatcacttcagggctgaggttgcatggcccagagattggcctgaggcccaggtaggggaggcgcccgtagaggctcccggcgacgcggaggaggcccgcacggatgaggagatgatagatttactcggtttcttgggagggagtggagccatgtga

SEQ ID NO: 20693 - DNA, 408 bp, Glycine max
  Peptide Sequence Number=SeqID_112378
atgattacgaggggtcaagacatttatagtagtcaagaagagactactttttccccttcttctagtggaagtgaagatgaagtaagaggtgaagagtctagtgaagaagtctacccccatgaagaaggtgatctactaatggttagaaggctccttggagtttccaagttgaacctcactatcattccccatccaaaaccttataaacttcaatggctcaatgaacaaggggaaatgatagttaaccaacaagtgaaggtggccaaagatcaactaactatgaaagataagagggatgaggaagaaaaactagaaaaacaaaagaaaaagaaggatagtaaggccttgtcttcaaaggccaagggggaggaaaaagaggaaaaaagattcctccaagaagattgttaa

SEQ ID NO: 20694 - DNA, 620 bp, Glycine max
  Peptide Sequence Number=SeqID_112379
atgggggataagcttcatcgtcgagagggaaacagcccggatcaccagctaaggcccctaaatgaccgctcagtgataaaggaggtaggggtgcagagacaaccagggagcgctcttgcgccgaagatgaacgggctaagcgatctgccgaagctgtgggatgtaaaaaagatcggtaggggagcgttccgccttagaggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcgg

SEQ ID NO: 20695 - DNA, 950 bp, Glycine max
  Peptide Sequence Number=SeqID_112380
atgactacctcaccaaaagaaactgcagcttctggttcacccgctgtaccatcatctccgcaccaggaacaacctgaattcaatatccaacccatccaaataattcctggtcaagcttctgtccctgagaaactggttcccagaagacaacagggagtgaagattgctgaaaaccctagccttgcaacaagtcctagggaagtagacacggagatggacaagaaaatccgcggatgttccgacatcctccgctccaatgctgaagccctcccttcacccagtgaagaggaatcaacagaagaagaggatcaagcctcagaagagactcctgcaccacgggcaccagaacctgctccaggtgacctcattgacttagaagaagtcgaatctgatgaagaacccattgccaacaggttggcacctggcattgctgaacgattacaaagccgaaaagcgaaaactcccatcaagaggtctggacgaatcaaaactatggctcagaagaagagcactccaatcactcctaccacatccagaagaagcaaggttgctatcccctccaagaagaggaaagaaatttcctcatccgactctgatgatgatgtcgaactagatgtctcgacatcaaagagggccaagaaatctggaagaaaggtgcctggaaatgttcctgatgcaccactggacaacatctctttccactcaattggcaatgtggaaaagtggaaatatgtgtatcaacgcagacttgcggttgaaagagaattgggaagagatgccttggattgcaaggagaccatggacctcatcaaggctgctggactactgaagacagtcaccaagttgggagactgttatgaaggtctagtcagggaattcattgtcaacattccctctgacatatcaaacagaaaaagtgatgattatcaaagagtgtttgtcagaggaaa

SEQ ID NO: 20696 - DNA, 453 bp, Glycine max
  Peptide Sequence Number=SeqID_112381
atgacgttgctgctcagcaacatcctgcccagcgattataactccgacctccctctgccgaagtgtcagctggtgtatgccatcctgacacagatgagcgtccatgtggctcagttgatcgctgacgccatttatttgtttgtaggtatgccacctaccaggcaccctctagacctagataagtctaacagggcccttggttttccagcattgatcacgggtctctgccaatcattcggggttcccgtcacacctaataagagccagggtttcgctccttttgcgtgccctactccagatcagttcagggctgaggttgcatgtcccggagattggcctgaggcccaggcaggggaggcgcccgtagaggctcccggcgacacggaggaggcccgcatggatgaggagatgacagatttactcgatttcttaggagggagtggagccacatga

SEQ ID NO: 20697 - DNA, 186 bp, Glycine max
  Peptide Sequence Number=SeqID_112382
atggatgggattctcatttctagtgtggcgggtgttgtccttgctgaggtgttgttggctgattcacgattcactcgaccgggatatgggttttcacccaacaaactcaatttcgtgcctagcgatgcggatgagcgccactcgatgtttccatttgcctgcatgcctttggtaatgtggggtgtg

SEQ ID NO: 20698 - DNA, 294 bp, Glycine max
  Peptide Sequence Number=SeqID_112383
atggttatgggggggtttcatcagcagactctccttccccggtctgagttcctcaatggaggatacgtaggagaaagagcctcgcttttgtcgaccacaccaccttttgttgccatgacccaagagctggtaatccgcggagaccccttacagttatccgcacctcgtcattcagtgaccccaagtgtgattgatgagcagaggccaatatggtcatttgcgccctttccggagatgtcaacatcttccggtggagattttttcaagtctcacaagttatctagaactacgtag

SEQ ID NO: 20699 - DNA, 258 bp, Glycine max
  Peptide Sequence Number=SeqID_112384
ctggattgcttctggaggaagcaacccagctcgcctaggcgagctgagcggcaacctcttctccctttttcctataaataggctgaagggtgctgttctaaggggcccggatccccctggtgatgattcaactgttttggggaaaaaaattgttttcgtgaagaatccaagccgagggcttccatacgctccgagagtttcgaacaatccggagatttcaaccgtttcgtcgttcttcgttcgtcttcggtttcaacc

SEQ ID NO: 20700 - DNA, 129 bp, Glycine max
  Peptide Sequence Number=SeqID_112385
atgacggatatggaaaatcctcccttgagatcctttatggctttgctcgtctgcaatgagattatggtactcgaccaagaatctatcgaaggggacacaataggcaatggtgtcagaaaatcgtggtaa

SEQ ID NO: 20701 - DNA, 210 bp, Glycine max
  Peptide Sequence Number=SeqID_112386
atgtcacatcctatcagagcgttatgtctcgacgtccttcagcaaaaggagtacataacaagacacaccacacaatgggtttgtcaggccacgatgttttgcgagaatgctccaaccatatgggatcagcataggcttaaaggagcactcaaacccggtgacccccaaggcctacactccgaagagtccatcagggtctctccctcctga

SEQ ID NO: 20702 - DNA, 267 bp, Glycine max
  Peptide Sequence Number=SeqID_112387
gagttgaacacagctgatatgatccgctgctacatcgctgaaagatctgtgccagttctgatcgatggggataggcatgaaggccaatcattccggttatctgagtttccctcgacaatgccggagatgttctcagatgctcttagatcgggggttgagaagtacggaagtgacagagaagtcaaccttctttgccaagggactaaactatctgctctatctgatactgaactagatgccgcaaaagtcccaactctggctcaataa

SEQ ID NO: 20703 - DNA, 510 bp, Glycine max
  Peptide Sequence Number=SeqID_112388
atgacgaaagataagaattggtacctcaaagccctacactggggcagggaggacaaaccctggcatttcagaggactacacgtcctcaccttcagagggctacacgccctcgccttcgaaggactacacatcctcgccattggagggctgcatgccctcaccttcagaggactacacgtcctcaccttcagaggactacacgtcctcgcctttagagggctacacgccctcgccttcagagaacaacacgtcctcgccttcaaagggcttcacgccctcaccttcagagggctgcacgccctcaccttcagagggctacacgccctcaccttcagaggactacacgccctctccttcagagggctacaaggcctcgccttcagaggactacatgtcctcgccttcagagggctgcacgccctcaccttcagagggttgcatgccctcaccttcagaggactacacgtcttcgcattcagaggactacacgtcctcgccttcagaggatga

SEQ ID NO: 20704 - DNA, 397 bp, Glycine max
  Peptide Sequence Number=SeqID_112389
atggccaccgctgaagccttggaacgagaaaccaagaaggcccgaaaggaagaacacgacgagctaaaggcttaccttaggtcgaaaagaaatttgtcccaacagttaagcgagactgaagggaatatgtgggccgtcatcgatgagtgcaaagagaagctaaatctagcggcgactcacgagcaaaggctagaggatgagtacgccaagatatcagcagaaagggaagcaagggaaagggtgatcgactctttacaccaagaggcaaccatgtggatggatcggtttgctcttaccttgaacgggagtcaagaacttccccgattgttagccaaggccaaggcgatggcagacacctactccgcccccgaagagattcacgggcttctcggctatt

SEQ ID NO: 20705 - DNA, 586 bp, Glycine max
  Peptide Sequence Number=SeqID_112390
atggtcgaatccttcacaacagcaacaacaacagccttattttcaaaatgctgctagcccaagcagaccatacgttcctccaccaatccagcaacaacaacagccccagaaacaacaaacagttaaggcccctccgcaaccttcccttgaagaacttgtgaggcaaatgactatgcaaaacatgcagtttcaacaagagactagagcctctattcagagcttaactaatcagatgggacaattggctacacagttaaatcaacaacagtcccagaattctgatagattacctttgcaatccgtccagaatcccaaaaatgtgagtgccattgcattgaggtcgggaaagcagtgtcaaggacctcaaccagcaacatcttcctcatccgcaaatgaacctgcccaacttcactctactccagaaaaagatgatgacaaaaatttaaagagtaagttacctaacaatttctatgcaggtgaatctaaagagaagcagcatatccctcctccattccctccaagagcaatttccaacaaaaaaatggaagagacagagaaggagatatggaaacatttagaaaagtag

SEQ ID NO: 20706 - DNA, 276 bp, Glycine max
  Peptide Sequence Number=SeqID_112391
atggagaatccgatttgagtacaaatccttctcaagagggagagaatgatgaggacatgaccaagagcaagggcaaggatccacttgaaggacttggaggaccaatgacaagggctagagcaaggaaagccaaggaagctcttcaacaagtgttgtccatactatttgaatacaagcccaagtttcaaggagaaaagtccaaggttggcccaattggcaacctaggcatcaaccttttgggagaccaaatggtggctggcttgatggctgttgggg

SEQ ID NO: 20707 - DNA, 381 bp, Glycine max
  Peptide Sequence Number=SeqID_112392
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggtaaaggctaa

SEQ ID NO: 20708 - DNA, 804 bp, Glycine max
  Peptide Sequence Number=SeqID_112393
atggtgaatcaagaggagtgggtcccgtttgtggacgtattagcattgctaatctttggggttgtcctctttccaaacgtggatggtttggtggacctagccgcgattgatgctttccttgcatatcaccatagcaaagagagcccagtggtagctatcttggcggacttatttgatacatttgaccgaaggtgcgagaagagtagcgcacagatcatctgctgcttacccgctctttgtgtatggttggtttcgcacctattccatcaagacataagacacccatgtccgctccgaagccatcacttgtgtgtcgaaaagagaagagtagattgggaccaatacttggctgggataggaggcagaacaatcaactggtttcctcgatggaaggaaggaaaagagggagttctcttctcatgtggggactacccaaacatcctgttgatagggacgatgggttgtattaactacaatcccgcacttgctataagacagttagggtaccctatgaggggagcactggcggaagagagcctctctcctttccttgtgagagatttcggcacgcaaagtttcaagattatacaaagagtccacaaggcatgggaaagcccgttaaggaaagataaagaacttaggggtatccgtaatggcatcatcggtggttatcatgaatggctgccccgctcatacacaaggacgttcggaaagagtgtgtcgagttacgagaaggaaatgcagataccgcaagagcccttgaacaagaaaccaagagggctcgcaaggaagagcacgacctag

SEQ ID NO: 20709 - DNA, 339 bp, Glycine max
  Peptide Sequence Number=SeqID_112394
atgaatgaagatcaatggacatattacagtgcgatgtccgcagaagttgatatggattttcgagatgaagaagattgtggtgtgaatgaagcacatattgattgttcagatgcttttaatacttctcaggtctttgcaacccgagaagatgttttgaagtgggctcaaacggttgcccatgaaaatgattttgttgcagtaattatgaggtctgatacatatactggtagcagaggaagaacttcatttgtgttaattgggtgtgaaaggagcggtaagtacaagtgtaggaagaaagaattcgttagaagagacacaggcactagaaaatgtggttga

SEQ ID NO: 20710 - DNA, 519 bp, Glycine max
  Peptide Sequence Number=SeqID_112395
atggaaacatgtttagcagtggaggacttattgcaacagatgatagatcgaggccgactggaagtcggcaatgaggggagtgaagagcagcatatatgtatccagtccgtagaagagggaagttttggaaggcctaagcctttggtggtatttctcaccaaaggcgcagctccccaacgccctgatacccttcaataccacacagttccgtggaggtatgcgcctccaagcgaaaggaaggaagaagccaccgacatcagctcgttgtcggccaaggtaaccaatatcatggggctgagcagcgtaacccgcagcagtcacgtgttcgcaccccctgacctgccaacacagcctacaaatgctaaagggaaggcgaagatagcggaagaacaaaatgacaaagcaatccccgctccggacgaggatattccaatgaaaagtccttctgagaaaaaggatggctgtggcaagaaagaagtgtcgctagaggaggcaggcgagttcctccacattatttag

SEQ ID NO: 20711 - DNA, 698 bp, Glycine max
  Peptide Sequence Number=SeqID_112396
gcattcgtaatggcatcattggtgggtaccacgaatggctgaaagttcatatacgaggtttagattggctcgccaagttaaaagtcgtcagcaaagagagttttgaagcaccggaagaggacgaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaatagtgaactcaagttgcgaaaggaagaaagggaccagtcgtccaaaagaagcttgtctcagcgtttatgcgagacggagaccaacatgctagctatcatcgccaagtaccaagaagagttaggtctagccgcggcccacgagcataggattgcggacgaatatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctatgtcagcatatga

SEQ ID NO: 20712 - DNA, 372 bp, Glycine max
  Peptide Sequence Number=SeqID_112397
atgggaatcgcacccacaagacacccagtggacccggaaaagtccaacagggccctggggtttccagctctggttacgggcctctatcagtcctatagggtgcccgtaccccccggcaaggggatcgcgcctgcaagacacccagtggacccgaaagaaagtcccaaacagggtcttggaggttgtcaagctctaattacgggtctctgtcagttctacggagtacctgtcacctccagcaagggcatcaggccccctactaatcgagctttcatcaagaagtactgcgccccagacaggcgcagggcgaaacaccacagcagcattgggatggtcggcagtgggaaacagacgcaccgccaccacctctag

SEQ ID NO: 20713 - DNA, 308 bp, Glycine max
  Peptide Sequence Number=SeqID_112398
tacatccggagcaactcgcacacacacttcagcagcctgtggagtggatactacctacacctactccatgtcgactagttgagctggttcaagtgatagaggtgtcatcctctgaaggggatcttgaagaggacccagaggagttacctcctgaacctgctatggacgcccctgacttaccagaggatgatgaggacccagtccctgatgttgattctccagaggatattatgtcagcatctaaggcaaactctacagaggagagtggccctggagggatagcgattagtgacaactcttcatcgtag

SEQ ID NO: 20714 - DNA, 213 bp, Glycine max
  Peptide Sequence Number=SeqID_112399
atgagttgggatcccataagttgtggaaaggaaacatcccttagcactgtcatacctcttaagtttgaggttattcctcaagtaaaggagttgttggatgagggtttggtttgtattatgaggcaccgaatccctatgataggtggtataatgaatgtgttagtggtgcaaccctcttttgtaaaatcactcatgcatccagcatcttcatga

SEQ ID NO: 20715 - DNA, 638 bp, Glycine max
  Peptide Sequence Number=SeqID_112400
aacttggaaccaaagattacaacaaccaaggaatccaagaatctagctacaatgacgatggaagctctcttcggaaatccaaggaaagaaaattctccaaatcctccaagaagattgagaacaacaacaactatacatgctttaagtgtggtaagaaaagccatatcaaatctgagtgtcctatctaccttagaaaacatggtgaaaagaaaggaaagaaagacataaaacaaaagaaagcctacagagcatgggaagatggtgtgtcaacaacttccaactcttccagtgatgaagaaattgcaaatatatacttaatggcgaagttcatgaatgatccatcaacaaatgaagaaactaagctgaaaagcgaattgaaattgtcttcaacaccaggtgagatgaatgagttaaagcaagaaaatgaaaaacttgtttcaaaatgtaaagccactacttgtgatgatacctctacttccttgaacatggatgctccattggagcttgtaggcctatcttcttcatcaatgaattcctttgcttcttggaagatgaatggcagcggaatggagaaggaagagagagaggagatgccacttcaaggagaagatgagtctagaagaagctcaccaccatag

SEQ ID NO: 20716 - DNA, 105 bp, Glycine max
  Peptide Sequence Number=SeqID_112401
ggaattggaaaggaggattggtgtcatcccttgaagaatttaagtcaagaagcaaggggccagcctgtaacgacccgcctcgtcgctacgatatcaccactctaa

SEQ ID NO: 20717 - DNA, 228 bp, Glycine max
  Peptide Sequence Number=SeqID_112402
atgggtgaagtagaggaggtgcaagagcagatgaaggccgacatggaggccatgaaagagaaaatggccacaaagatggaggccatgatgagcatgaagaagataatggaagccaatgtggttgcagttgtcgctaccagcgctgttgctaaggtggcctggccaggagaccagtcctcttcctctagaaggggtgggggcctctgtatcccaagagcctatgactga

SEQ ID NO: 20718 - DNA, 237 bp, Glycine max
  Peptide Sequence Number=SeqID_112403
atgggtggtggtgcatggccgttcttagttggtggagcgatttgtctggttaattccgttaacgaacgagacctcagcctgctaaatagctatgtggaggtctgtgatgcccttagatgttctgggccgcacgcgcgctacactgatgtattcaacgagtctatagccttggccgacagctcgcgttggctaccgttcgtcggctctctctcgttttgcctgcctggtgctaactag

SEQ ID NO: 20719 - DNA, 495 bp, Glycine max
  Peptide Sequence Number=SeqID_112404
atggcttgcctcccaaactatacaccaccgaatgtggcgtacattcccaatgaggatgtcaataactccacacccatactcattaagagccaacaacctcaatctgatcatgcacatgtctctcgacccatggaggagacacatggaatgccccaccacaatctagccgacttcgagccttgcctcggatatgccactgaagggcaagcagtttgtggtatacccctgcaaaacactttggagggccctcaatgtcacccacaaccacaaccctcacattccacaacggttaaaaaccctcatgctatggcagaaatgggaaagaggaaaggctcagggccattgaagagagttgtcctagtacccaatatcatcacccctcccaagttcaaggtgctggactttgacaagtacaaggggactacttgccccaagaaccatccaaagatgtattgtcggaagataagggcatacgcaaagatgaggaattgctaa

SEQ ID NO: 20720 - DNA, 334 bp, Glycine max
  Peptide Sequence Number=SeqID_112405
atgggtgacatagacaaggtgcaagaacaaatgaaggctgatatggaggccttgaaggatcaaatgacctccatgatggaggccatattaggcatgaagcgaatgatggagagcaacatggccgtagtagccgccactagcgtcgtcactgaggcagatcaaacccatccatccgccataaaccaagcaaaccaacccatcccagccatggtgggtcaaggaggagaggtgttggacagcaccgacgggggcacccgtgaagagcctcaggatcatgctcaggttgactttgaaccataccctatattcgccactaaggaaccggcgtgtagtg

SEQ ID NO: 20721 - DNA, 771 bp, Glycine max
  Peptide Sequence Number=SeqID_112406
atggatcgcatgctcgcctcctcgcccggcgtgattgcggtacagacgctggccggcgcgctggcaaccggcacccacggtcagggcctggcacagagttcgctggcggacgaagcgctgcatatccgcatggtgctggccgatggcagcgtgcgcgagtttcaacgcgacgacgccgatttcccggcggcgatggtgtcgcttggcgcgctcggcattgtcaccgccattacgttgcgtactcagccatttcgcctgtttacctgccataaattcgcggcgtcagccgattcactggaacaggatttgctgacgtggaatgagcagcacgaactcagcaaagcctggtggtttgtcgatgacaacctgatgcatgtctggaacgccgatgtcgccagtgcggaagacagccaggcgtggcacgaccatcagcgcgaggtgattgagcatggcgatcaggccgacagcagcctcaacgacaccatcgatcagacgctggaacacatgcatcgcgacacgcagattcacggcaaaggcggcaaacagtttcgcaccgtcacccgcttccgtgatttcaccgacatcagcggcgatatctaccagctgttttgtcgtggcatcgccgtaccgcaaatcaacgttgagattggcgtgccgctggccaaaacgccggaaatatcagcaagatcaaagcctggtacgcacagaatcgtccgcacatgcactatcccatcatcctgcgctgcaccggcgcttcacaggcgtggatga

SEQ ID NO: 20722 - DNA, 822 bp, Glycine max
  Peptide Sequence Number=SeqID_112407
atgcgtattctgattgtgggagccggtgccaccggcgggtactttggcgcgcgcctggcgcaggccggccgtgatgtgacctttctggtgcgcgagcgccgccagcagcagctgcaacagaccggactggtgctgcaaacgccggagggcagcacggtgctgcaaccgcagctggcgctggcctcgacgctgaccggtgattacgatctgattatcctgacggtgaaaagctttgcgctggaacaggcgatggaagacatcgccccggcggttggcgcgcagacgctgatcatgccgatcctcaatggtatgcgtcacattgatacgctgcgcgcacgtttcggtgacaagatgattggcgggctgtgtaagattcacgccacgctgggcgagcacggcgaagtgatgcagctctcgccgctgcacgtgctttattacggcgcgctggacggcaacaacgatgcccgtctgcagcgcgtggatgccgcactgcgtgatgcgcagtttgatagcgtgttcgccgataacattatcagtgagctgtgggagaagtggctgctgctgagcacgctgggtgccgtgtgctgtctggcgcgcggcaatacgcagcacatcctgcgttcagccggtggtgaagcgctgctacagggcattttcgccgaggtgctggcggtgatcacagccgatggctatcagcagcgcccggccgtgacggcgaagatttatgagacgctgaacaatcctgatgcggcgatgacctcatccatgtgtatttgcagacgcggtgatcggtccggtgcgtggcgtgcctggtgcgcatga

SEQ ID NO: 20723 - DNA, 306 bp, Glycine max
  Peptide Sequence Number=SeqID_112408
atgcatattatgcgatgcacagaagaatctggtggcggttggcttctaagaggaaaaaatgtcatgctttattgtcgtgaaagagaaacaacgatcacgttgtatcgtgaaataatgacatatctcatatttgtaatattcatcgacttgtccatgctattgcccaataaccacaattaccatccgcttcgcatcaataatgttttcaatagaatcctggatgcaaggatgaaattgattcaacattggaacattccatctgatggaagcttgcttgtggggcttctatggaggctggatctttga

SEQ ID NO: 20724 - DNA, 519 bp, Glycine max
  Peptide Sequence Number=SeqID_112409
atgccttatgtggaggccacagaggagtcattagaaaccgctttccaatcttttgaggtggtaagcatttcctccgtggactccttctctgggcagccttgcctgtccgatgtagcagtaatgatggcccgagttatgttggggaacggttacgaacccggaatgggtttaggcaaagacaacggcgacataactagcctaataaatgccaaaggaaatcgtgggaagtatgggttaggctataaggccactcaggccgatataaagagaagcatcgcgggaaggaagagtggtagtcaaagctcgcggttgagacaagaaggtgaaggaagcccgccctgccacataagtagaagctttataagcgcgggtctgggggatgaaggtcaagtggtcgcgatatgcgaagatgatgttccgagtacattggatttggtacgaccatgccctcctggtttccagctgggaaattggcgaatggaggaacgccccgacatttacgcaatgagcataatgtaa

SEQ ID NO: 20725 - DNA, 506 bp, Glycine max
  Peptide Sequence Number=SeqID_112410
ggacgggggaagcccgtctgatagcgctctgtgcgcgtactccgaaagggaatcggcctgcccaccctggaaacggctcagccggaggtagggtccagcggctggaagagcaccgcacgtcgcgtgcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaaccaagcgcgggtaaacggcgggacgaaaccacagccaagggaacgggcttggcggaatcagcggggaaagaagaccctgttgagcttgactctagtccgactttgtga

SEQ ID NO: 20726 - DNA, 228 bp, Glycine max
  Peptide Sequence Number=SeqID_112411
atgtcgctgcatgttctttatctttatgtattttctaggtatcccccagggattccccgtctactgtatctctcgttacaatctttcaaagaagggcaggatcatcttgagctaccttctggggtagagacaaaacatgaacagcaggaaccaatcaaggtacatagggacggatgcgagtgggggtggggtcacgaccgactgatcgttgccccttctctgcgctaa

SEQ ID NO: 20727 - DNA, 390 bp, Glycine max
  Peptide Sequence Number=SeqID_112412
atgaaagataagagggataaggaagaaaaactagaaaaacaaaagaaaaagaaggatagtaaggccttgtcttcaaaggccaaggggaagaaaaaggaggaaaaggattcctccaagaagattgttaagaaggaaaatcattttgcaacaaaaggtgatattaaaaaagcactccttcttaaacaatctttctaccttctcctatcaagggaaacatcccttagcaccgccatacctcttgagcttaaggttattcctcaagtaaaggagttgttggatgagggtttggttcacaagagcttaagtccttgtgctttgttggtgcctaaaataggcattattaggcaccaaattgtagaagcaagcttcatgatgttgaatcaagattga

SEQ ID NO: 20728 - DNA, 306 bp, Glycine max
  Peptide Sequence Number=SeqID_112413
atgaagaaagcgtacatcacatgggatgacaatgatatggaatcttctgaagattcagaaaatgaagaaataaacctctgtctaatggctaaaagttatgaaagcgatgaagaggaaaacaaagatgtgtctccaataaggctggaatgggatataaatctgaaaaacaacaaaaatttcataaaaacttctctacttccacacaaaaatataattctagttatatcacttgtttttactgtggaagaaaagggcatggcatatctacttgctactttaagaaaaactacaacaacattaaaatga

SEQ ID NO: 20729 - DNA, 312 bp, Glycine max
  Peptide Sequence Number=SeqID_112414
atgaagcagcaagcgcggtttagcaacaggagcatagcaaccttgatgaccggaaggaaacgcggaacgactagagaaggacgaataggatacgcggtcagtgctgaaagcaaaacgccgacatgccccggagtaccatccatcgctcatcaactacccagctctactactgcaactacgccgaaggtagtcggtttactgctaatcgcaatactacccgagatccgtcgtgagctagtggttgacaagtaccgtataggcccaggtgttgttgagctagtgggtgagcataatcatgggtggagtgagtag

SEQ ID NO: 20730 - DNA, 282 bp, Glycine max
  Peptide Sequence Number=SeqID_112415
atggatccagtcaagtacatctttgagaaacccgctctcactagacagatcgctcggtggcaggttttgactacaagaacaacatggccgagtatgaggcgtgcgcccttgggatccaagtggaaattgacttcaaggtcaagttactcaagggaggagaatcaaatggccgatgccgttgccactctagtgtccatgtttcaactaaccccgcacggggattttccatacatcgaatttagatgtcgtggcaagcctgcatattgctgcttgatagaatag

SEQ ID NO: 20731 - DNA, 365 bp, Glycine max
  Peptide Sequence Number=SeqID_112416
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgatgttggtatcgaggagtgtaaatcatga

SEQ ID NO: 20732 - DNA, 258 bp, Glycine max
  Peptide Sequence Number=SeqID_112417
atgaaggaaaacaaagcgaaattggccgtattatcggcgaggatatcgatatgcggcaaaggaaaattgtctttgggactgactcgattcaagtcctggatgtctcgagcttcatcctcctcagcttttgttgtaccagggaacactcaggatttagagtgtcgcaacctacccttcggcgggagggcgacgcgtgactcgcgggatgcgtgttccacgaaaggaatacgcgcggagtcgccaccaacgtttatttga

SEQ ID NO: 20733 - DNA, 369 bp, Glycine max
  Peptide Sequence Number=SeqID_112418
atgtcaaccagtgatcatgccatcctgagggacaaaacccatcaacccacaaagaaaagcctgttggtactaacatcacacgacgccttgttggcacagaacaagttgctatctaagaaacttgagatcctaacggaaacacttggttgtaccatttgtggtgaagctcatgagataggccaatgcattcccactaacgataacactcaagaaattcatttcatggggaatcagcagaggcaagggtacactcaaggagggttttcaggcttccagcaaggtccttataatcagcaaggacagtggaggacacaccctggcaaccaattcaataaagaccaaggtggatcctcaaacgagccaatttaa

SEQ ID NO: 20734 - DNA, 612 bp, Glycine max
  Peptide Sequence Number=SeqID_112419
atgctgcaggccagcccttccaaaggtgtgatccgcgaagacttcagaccagccgaaattgctgccagttatgaacaaggtggcgcagcctgcctgtccgtgctgacggatgaacaatatttccagggctcagctgactatttaaaacaggcacgcgccgcctgtagtttgccagtgctacgcaaagatttcatgatagacgcctaccaagtcttcgaagcgcgtgccatgggcgctgactgtattttgctgattgccgcggcgttgaccttggcgcaaatgcagcaactcgaagctgtcgcgcatggcttgggtatggcggtgctggtcgaagtacataatggtgaagagttagaacaagcgattcaactcaccacaccattattgggcattaacaaccgcaatctgcgcacgtttgaagtgacgttggacaccacgcttgggctgttagaaaaaatctccggcgataagattgtggtcaccgaaagcggcatttttactgccgaggatgtcaagcttatgcgcgaccatgctgtgcataccttcctggttggagaggcctttatgcgccaggacaatccgggggctgagctggccaaggtctttgcctga

SEQ ID NO: 20735 - DNA, 1551 bp, Glycine max
  Peptide Sequence Number=SeqID_112420
atggcgcggcagcagctggcgcaattggtgccgcaagatgaggcgggcatagaggccagactgttgctgatgcatgtgctagaagtgaaccatgcctggctactaacgcatgctactgatacgccagcggagattcatgcgcaaacatttcagagacatgtgcagcgtcgtttgcaaggcgaacccgtggcctatattttaggttaccgtgagttttttggcttgaagttgcgcgttacaccagacacgctgatccccaggccggataccgaaatattggttgaaacagcgctggcaaaagtaacgcccgggatgcaggtactagacttgggcacggggacaggcgcaattgccctggcaattgcccagcaggccccgcgagtgctagtcactgccgtcgatgcttctcaagacgcattatcggttgccgaaagtaatttaaagtacctgcaattgcacaacgtgagcctgtgtcttagccactggtttgatgcactgccgcaacgtgtatttgacctgatcgtgagcaacccgccttatattgaggattctgatccgcatttgaaccagggcgacttgcgctttgagccacccagtgcgctcgcctcaggtgcagatggcttacaggatatccgccatattgttgcacatgccactaaccacctgcatccaggcggctggctcatgctggagcatggctacaaccaggctgacgcggtacaacaattattgaacacacatggctttcgcgcagtcgaaaccatcaaagacctgggcggccagccccggttaacgatagggcaatggcctggccgtaaaccattgattcccggcgcattgtccgctgtagcccagttgcgcaaagcgggcattgccgtgcgttttgtcactaacaccagcacactttccttagactcactgcagcaaaaactcaatgaccttggcttcaatacagtgcctgaggaaatcatgagtgcaccacaagcgaccatccagtatctaaagaaacaagccaaccccgtctgtaaactcttattggcagatgacgttaaaaaagactttgcctgttttgaccagtctgcaaccgcagccaattatgtggtgattggtgatattggtgaccagtggtcttatgaactactgaatgaggtatttcattgcctggtgaatggcgcgcagctaatcgctattcataaaaaccgtttctggcaaacagaaactggcctgcaaatggatatcggcgcttttgtcaccggcctggaatatgccagcaatacccaggccatgctgatgggcaaaccttcacgccactttttcaatcaggtagtggacaccttacgcttgaagccttcggacattgtgatggtgggtgacgatattgatgctgatgtgggtggcgcgcaggatgccggactacatggcattctggtaaaaactggcaaataccgcgaaacctatacccggctttcagcagttgaaccggatgcgattatccaatccgtcgcagaccttcccgcattgctgggttgcttgtccattccggcccattaa

SEQ ID NO: 20736 - DNA, 318 bp, Glycine max
  Peptide Sequence Number=SeqID_112421
atgatgcaatcctaccccgcaatagcattggatagaagactccaagtagattggaccagagatgcaagagaaggccctaggtttctcatgagccttaggattaaggtttcattatttttgggtgtggaagcaatgtcttccaaggttattttgatgatgccaaagaatcaagagtcaagcaaaatccaaagattcaagaatcaagtttcaagaatcaagattcaagattcaagattcaagaataatcaagatcaagattcaagactcaagggaagactcaatcaagataagtacaaaaaagcttttccaaaacattga

SEQ ID NO: 20737 - DNA, 426 bp, Glycine max
  Peptide Sequence Number=SeqID_112422
atgcggaggactcgcctgctccttaggacacttcttcttgccacaaccatcttttttcagatggacttttcattggatatctcgtccggctgtgtccgcaggtcggggggtgtaaacacacgaccgctgcgggtcacgctgctcagccccgtgatattggttaccttggctgacaatgagctgatgttggtggcttcttccttcctttcacttggaggtgcatacctccaagggactgcgtggctgtttcggtatggaaatggaacaggtttaactaccgaggggtatcaaggctttttgggagctgcgtctttggtgaaatataccaccaaaggcttaggccttccaaaacttctctcatctacgaactgcatacatatatgctgctcttccctcccctcatcgccaacttccagtcagccttga

SEQ ID NO: 20738 - DNA, 614 bp, Glycine max
  Peptide Sequence Number=SeqID_112423
accccacaaagggtgttggtcgattaagacagcaggacggtggtcatggaagtcgaaatccgctaaggaggcgcggcggtcgctgcaaaacccagggcgcgagcccgggcggagcggtcgtcggtgcagatcttggtgggacgggggaagcccgtctgatagcgctctgtgcgcgtactccgaaagggaatcggcctgcccaccctggaaacggctcagccggaggtagggtccagcggctggaagagcaccgcacgtcgcgtggtgtccgggaagtcggcaaatggatccgtaacctcgggaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaagcgaaaccacagccaagggaacgggcttggcggaatcagcggggaaagaagaccctgttga

SEQ ID NO: 20739 - DNA, 216 bp, Glycine max
  Peptide Sequence Number=SeqID_112424
atggatacctcagagccctacactggggcaatgaaaggcaccatgcaaaaacctcaatcgaacctagggcagattataagttctcacccaataggttccctattacaaggtcacgatgaaagacaacgattggttcccagctacaaggtcatgacgaaagataacaattggtacctcaaagccttacactggggcaatgaagggcaccgtgcatga

SEQ ID NO: 20740 - DNA, 504 bp, Glycine max
  Peptide Sequence Number=SeqID_112425
atgggttctccacctgcctccactactcctcctcctcctcctacttcggacgcatcggcttcgacttcgacaccacctggtgttgagagaccagtggtgcatgttgatcctgctatagggaaggtcgacggtccctacaagaagaaattaagaacatatttggggattgtggcacgtgataggtggacatcacctacgagactggaaggaggtccctactgctcagaaggacctgatttgggaggatattcagacctcatgaggaaatgggcccttgcagccgatcaggacggtgtcgaggacactgtctgtgacaaatacgacatcagcaaggaaaagtgggcccagttttgccagactcgcagagacccttcttgggaggatgtgcgcagcaaggcacaggccatccagaagcagaatattgccccccacgttttgtctcgtgggggttatgattatttggagcagaagctcctggctgagaagaccaagaagaagctgtag

SEQ ID NO: 20741 - DNA, 306 bp, Glycine max
  Peptide Sequence Number=SeqID_112426
atggccattgtgaaggagttttatgccaacctctatgaccccgatgataaatcacctaagcaggtgatggtgagaggtcatttagtgaagtttgatgaggttaccttgaacacatttttaaagacccctgtagtgctggaagagggggagaacttgtgtacatatttcagatttgcactcttgaggcctgatcctcaagagttggctggtaagctttgtatcccaggtaggggattcgagcttaatgctaatgggcaacctttgaagattctgaggaagaacatgactactctagctcagatatag

SEQ ID NO: 20742 - DNA, 252 bp, Glycine max
  Peptide Sequence Number=SeqID_112427
atgtgtggctggtttcacacctttttctccaaggaggtaggcccgtctatccgctacaaggtcaccgctcgcacgttgaaaaaggaaaggggttgtattaattataatcccggcctcgccataagacagcttggctaccccatgagaggagtgccatcagatgaaagcatcacgcctttcattgcacggggtttcagtgaccacaacgcgagggtactccaaggagtttgcaaggcatgggatgcggcgtga

SEQ ID NO: 20743 - DNA, 207 bp, Glycine max
  Peptide Sequence Number=SeqID_112428
atgttcctccagaaggcagttgcttctggaggaagcaacctagctcgcctaggcgagctgggtagcaagctcctccctcattttactataaatacagggaggagggaagaacaaaaatgttcaaccctcttggtatctgagattcacttaaaattagtgagaaaaattgtttccgtgaagaaaatccaagccgaggcacttccgtaa

SEQ ID NO: 20744 - DNA, 240 bp, Glycine max
  Peptide Sequence Number=SeqID_112429
atgtcgtcggagtattggcgatcaaaattgccattccttggattaccaagctcatgctttctaaaaaaggttcatcaagtcaaggtcatgtatggaagtaaccaacttgcaaatcggggcaaagatgaatcgagttacatcgctactttgtttaatgcaaacacatttaggactgttgatgttcctgttacttccagtttcactttgaccaagatgtcatggaccatgttgaaaatctaa

SEQ ID NO: 20745 - DNA, 264 bp, Glycine max
  Peptide Sequence Number=SeqID_112430
atgcagtcagatgtttggggtagtataagtgatcaagggatagtaaatcatatcacaggaggaaattttgcgcagagttccattaccattaatgggtggctccgtgatttcttatgggcacaggcatcccagcctagagccttgagcattgtacaaggacgtgctgtagggagtaacacattaccttctaggtggaattgccacaacatgggcattcttcttagcaagaattattgcagtaggataatagctaggaggatttga

SEQ ID NO: 20746 - DNA, 69 bp, Glycine max
  Peptide Sequence Number=SeqID_112431
atgcaagaacaagagaagatgagtcaagaacaagctcaccaccataggaagcaatggataagagcttga

SEQ ID NO: 20747 - DNA, 291 bp, Glycine max
  Peptide Sequence Number=SeqID_112432
atgtggaagaggataaggagggtggaattggtgctgtggatgcgctgttggctccggaacgatgagctcttgaagccgaagcggaggcggatgaacccttacatttcaatcggtgaaatcaaaaggaaattgaaaaagaagaagattgcaagttacgggagtcgatttgatgaagaaatgaataagataggatggtttgaaggtttgggaatggaggaacgtcgcaagggggaagaggctgcgcagaggtttctgaaaaacgtgatatttatagaccaggacgcattgtaa

SEQ ID NO: 20748 - DNA, 144 bp, Glycine max
  Peptide Sequence Number=SeqID_112433
atggcgggtgacaagtccaaactctctgactttgtgtcaaaagatggaggatacgtcacgtttggagacaataacaaaggaaaaataacaggagaagaaaatatagggaatcaacacaaaattcagataaagaatgtgttatat

SEQ ID NO: 20749 - DNA, 726 bp, Glycine max
  Peptide Sequence Number=SeqID_112434
acttgccttggaaagagaactgggaagagctgccatggattgcaaggagatcatggacctcatcaaggctgctggactgctgaagactgtcagcaagttgggagattgctatgaaggcctagtcagggaattcattgtcaacattccctctgacatatcaaacagaaaaagtgatgattatcaaagagtgtttgtcagaggaaagtgtgttagattctcccctgctgtgatcaacaaagatctgggcagacctactgatggagtgatagatattgatgtttctgagcatcaaattgccaaggaaatcactgccaaacgagtccagcattggccaaagaaagggaagctttcagcagggaagctaagtgtgaaggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggagatacttaacaggga

SEQ ID NO: 20750 - DNA, 278 bp, Glycine max
  Peptide Sequence Number=SeqID_112435
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatccctaggcaataacgttcatggggctccgaaaaagggtgagaatggaggattgccttga

SEQ ID NO: 20751 - DNA, 171 bp, Glycine max
  Peptide Sequence Number=SeqID_112436
atggcacatcaccctccaatgtgttgggacaaagaattctcaggcggggaagggaagaatcaaaagaattctcaagcggttagtcctttgaattctcttggaagagagaagagagacacaaaagaattcagacgattagtccttgtattcttttggcaaagggagaagtga

SEQ ID NO: 20752 - DNA, 102 bp, Glycine max
  Peptide Sequence Number=SeqID_112437
atggcggttgttgaagtggaagtggtgcaatataatcaaagagcttccatgggggacaaattgttagctgctgtgtgccctggctgtttgcacttgtcatga

SEQ ID NO: 20753 - DNA, 1083 bp, Glycine max
  Peptide Sequence Number=SeqID_112438
gtctcagctcaggcttcacaagccaactccaatatgcatatccaagccgaacattcattgacacaggctcctgcagctgcttccaatacaactcaacagctgatgccacctctaacttctgactcttgggctgcaatgactgaatccattgatcattctcactcagaacaaagattgcaatcatcattgttgaatgttgataagcctgcagatgatggctacaactggaggaagtatgggcagaaacaggtcaagggtagtgagtttcctcgaagttattacaagtgcacgaatccaaactgtcctgtcaagaaaaaggtcgagcgctcgcttgagggtcatgtaactgcaattatttataaaggagaacacaaccatcaatgtcctcatcctaacaagtgctcaaaagacaccatgacttcaaatgaaaattcaaatatgcaagggaatgtagattcaacgtatcaagggacgagtacaaactcaatgtctaagatggatcccgagtcaagtcaggcaacagctgatcgtctatcaggaacaagtgacagcgaggaagtagctgatcatgaaactgaagtggatgagaaaaatgttgagcctgagcccaagaggagaaaagcagaagtctcgcagtcagatccaccttcttcacataggactgtcaccgagcctcgaatcattgtgcaaacaacaagtgaagttgatctcttagatgatgggtatagatggcgaaaatatgggcagaaagttgtcaaaggcaacccttatcctaggagctattacaaatgtacaacgcaaggttgcaatgtgcggaagcatgtggagagggcttcaacagaccctaaagctgtcataacgacatatgaaggaaaacacaatcatgatgtgccagcagctaagactaacagccacactatggccagcaatactgcatcacagttaaaatcacataacaccaatcccgagaagcataattttggcagcagaggtatgggaggaaatgaacaacagccggttttggatgatgatgtactattagtaccttttgtgtacattgaaagtgtaagttatgttgtctaa

SEQ ID NO: 20754 - DNA, 417 bp, Glycine max
  Peptide Sequence Number=SeqID_112439
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccagggcgtttccccctggcgggctccctcgtgcgctctcctgttcctgcctttcggtttaccgggcagttcgctccaagctggactgtatgcacgaaccccccgttcaggtcccgaccgctgcgccttatccggaaactatcgtcttgagtccaacccggaaagacttgcaaagcaccactggcagcagccactgggaattgattagaggagttagtcttgaagtcatgcgccggttaggctaa

SEQ ID NO: 20755 - DNA, 405 bp, Glycine max
  Peptide Sequence Number=SeqID_112440
atggataatgaagagggagtgcaagaacagatgaaggccgacctatcggccttaaaaaatcaaatggcttctatcatggaggccatgctaaagcttcagaaagctatagaggataatgctatggcggccgcttccaatacggctagggaagcggaaccggtgctacaacccgtattaaatttgggccgagacagaaacacgacggttttcgggtcggaggatccgaccccccatgaattgccccaaccagacatagtccgccacgtcccgtctccacccgcacccgttaaagagttcgttccctttgcaaaagataagggaaagattgatttacttgaagagaggctgagagcattagaaggcctcgacaactacccgttctcggatttagcggatctgtgtctg

SEQ ID NO: 20756 - DNA, 593 bp, Glycine max
  Peptide Sequence Number=SeqID_112441
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggttcaagcttgggtcatggtttggtgtatggattccttgagcctcagtccatatacaatacaaaagatagacgtgcttaatgtcaacattacatcgaaacatgggttaaggaatcccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 20757 - DNA, 246 bp, Glycine max
  Peptide Sequence Number=SeqID_112442
atgatgattggatgtggaattacttggatgttgttgaagcttgggaggattgatggggacccggcgttgaaaggggcgggggtaagggctacgtgggagtacgtgagctcagttggaggtgggcaacaggggatggtggagtggtacttggagatatgtcgtgggggtcaggagaccttggggacgtcaggtggggtgctattgcccaaacccatcctttccaatcccgacccaacccgggcatag

SEQ ID NO: 20758 - DNA, 606 bp, Glycine max
  Peptide Sequence Number=SeqID_112443
atggatgcctgggagagtttggttgattgtccttctaagcatcagtttgatgattgccttaagaagtttgaaattgtttgttcatcatggccaatgtttgttgactatgccaaccaaacatggataattccccacaaagaaaaatttgttgaagcctggatgaataaggtgatgcacttaggaaacacaacaacaacacataggctaagtttttcagaccaagggttatctgagccccaagtgaccataaccgaagagatggaaatcttatccaagcaatttgaagagtttgatgtttgtggcaaagttactcaaaagagtaaactccagaaaattgtctaccctgatctaaattttatgtgtcctcctccagaaaaggtcaacaccaaaggtgctcagaagaaaccgatgaccaaatatcaaagatcaacaaaacgtgatccattttactgggagtatgttgatgctttacattctatgcaaaatagtaattcttcaattaaacgtagtgcatcatcatctgaccaggcaattccaagaaggactatgtcaatgttggatcaatttcatccgttcattcatgattccattgaaaacattgtcgat

SEQ ID NO: 20759 - DNA, 282 bp, Glycine max
  Peptide Sequence Number=SeqID_112444
atgacaattgaagagtctatacatgtttcctttgatgagtctaatgccattcttccaagaaaggattttttagatgatatttcagattccttagaagatacacatattcatggaaatgattctaaagaaaaagacgaaggaagcaatgaggattctcaagataatggggctagaggaaataatgaacttccaagagaatggaaagcctcaagagatcatcccctcgacaacattattggtgatatatcaaaagggaaaaacctgaaaattatcctgtcatag

SEQ ID NO: 20760 - DNA, 372 bp, Glycine max
  Peptide Sequence Number=SeqID_112445
atggttaagtacgacccagagatagtcatggagttttatgccaacgcttggcccacggaggagggtgtcagagacaaatgctcctgggtgaggggccaatggatccccttcgataaggatgccattaaccagtttctggggcatccgttggtcttggaggagggccagcactgtgaggcaggacttttcccgaagcatagtggagagataggtgcgaatcatgcgcatcagcatgaccaccctaacgtagatttggatgcgttgttgctcagtaacattctccctagcgaccataattcagacttccccctgccgaagtgtcagctggtctacgccatcctgactcagggatcacgcctcctagacatctag

SEQ ID NO: 20761 - DNA, 903 bp, Glycine max
  Peptide Sequence Number=SeqID_112446
atgaaaagagaaaaatatgcctcctatagtagtcataactcttgcaacagcctaagtgaagaacttcgtgactattacgaaggaaggcataggtcacatcttagacctcactcccataggagagaaaaggaaagaaagcctcaagaggctaacattaacctcccatacttccataggaaggacaatgtagaggctaacttagattgggaaataagggtagagcaacaacttaaaaagaagtctatgtcaaaatcttatggctctcactcttatccaaagaaaaaccaaggtcaaggcatcttaggggtgacaccttctaagcccaaagatgataaggggaagacaatagaaaagcaagcccctaaggctaaggacacattactttctcaatgccccaccacaaaaaccatgattatgaggggccaagacatttatagtagccaagatgaggctactacttcaccttcctctagtgaaagtgaagaagcaaaaagggaagaatctagtgaagaaatctacccccaagaagatggacaaccattagtggttaaagagaagtgtaaggaggtaagtgtctcctccaagacgttagctaagaaggaaactcattttacaataaagacaaacattaaagaaactttccctcttagacaacctccacattttctcttttgtaaaaagacacttgctagcattgccacacctcttgggcttgagttttttcctcaaataaagaagttgttggatgagggtttggttcgcaagagcttaaatccttgtgcttttttggtgcccaaaataggtattattaggcaccaagtccctaaaataggtggtatgatgaatgttttgagtggtgcaaccctcttttgtaaaatcactcgtacacctaatatcttcatg

SEQ ID NO: 20762 - DNA, 436 bp, Glycine max
  Peptide Sequence Number=SeqID_112447
atggggttgttggaataccgaaaggagaatgctgaactgagagatataaatgtagctaccaccaaagccttggaacaagaaaccaagagggcttgtagggaagagcacgactggaacaagtccaaaagaaacttgtctcagtggttatgcgaaacagagaccaacatgctagccatcgtcagcaggtaccaagaagaactaaatctagccacgacccatgagcatagagtggcggacgagtatgcccaagtgtacgcggaaaaggaggctagaggaagggtgatcgactcgttacatcaagaggcaacaatgtggatggacctatttgctcttaccttgaacgggagtcaagaacttccccgattgctagccaaggccaaagcgatggcagacacctactccgccacagaggagatccacgaacttctcggctatt

SEQ ID NO: 20763 - DNA, 153 bp, Glycine max
  Peptide Sequence Number=SeqID_112448
atgataatctcctcagaaagatgtgtgacaagtgaggaagccaagggtatattgtggcactatcataattcaccatgtggagggcattatggtggagataaaacagcggctaaggtcttacagtcaggatttttctggccaacacatttctaa

SEQ ID NO: 20764 - DNA, 373 bp, Glycine max
  Peptide Sequence Number=SeqID_112449
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaattcgctccaagctggactgtatgcacgaacccccgtcagtccgacgctgcgccttatccg

SEQ ID NO: 20765 - DNA, 186 bp, Glycine max
  Peptide Sequence Number=SeqID_112450
atgtctgatatgccttttagaggcttgaaaagtgcgagaaaacgagctgcattttctggaaaacgcgatgaactcgctaagcgagcatgttgcgctaagcgacgcgcttactgcgctaagcgagttcatcctttaaggatgaacactcatcctcttgctgaactacctatggctaagcgaggctga

SEQ ID NO: 20766 - DNA, 462 bp, Glycine max
  Peptide Sequence Number=SeqID_112451
atgttctttacgatgccattgggatatatcaacggtgttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaaagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 20767 - DNA, 331 bp, Glycine max
  Peptide Sequence Number=SeqID_112452
atggacccttgggtactagtaccctcgtcttcagagggctgctcgcccccaccttccgaggactacatgtcctcaccttcagaggactacacgtcctcgccttcagagggctacatgccctcgcctacagaggactacacgtcctcgcctttagagggctacacgccctcaccatcagagggttgcacgcccttgccttcagagggttgcatgtcctcgccttcagagggctgcatgccctcgcctttagagggctgcacgcccttacctctagaggactacacgtcctcgcgtttagaggacacatgtcctcgccatcagaggattacat

SEQ ID NO: 20768 - DNA, 351 bp, Glycine max
  Peptide Sequence Number=SeqID_112453
atggtgaaagttggaacctcttacgtgccgatcaacgtctcattttcgccaaaagttggcccagggctccccggtatcaacagggacaccaggatttatttattctgcgaagtgatcttcccgtcacagtggcttctgtttctatcagctgtccctccctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 20769 - DNA, 936 bp, Glycine max
  misc_feature (890)..(890): n is a, c, g, or t
  Peptide Sequence Number=SeqID_112454
atggggtttgttacctggtgggagaaatattattcgacccgttcagttggagacactactatcatgatctccagacttgagagtggttttatacaaccaacggtcgaaaatatccgctcaaaccttcaagctcgaggcaaaacaatcatgacgaagaaaagtgctgaaacgtctcgagctgatgtgagacccaagaaacccactggggtgaagatccaagagtggaaacaagaagagaaggaagaagaggaaagacctcttataagaaaaagaaagttacctgcgacttcgaccaagtctactgaacaaacagaggcaggcaattcccaggctcaaatgcctaagaagaaaaagaaagtgaagcaggtcgagcctgaaccttctgtggctgttgagggtggtgagccaatcaagaagaaaaagaaaaagaccaagccttcaaaagaacaaggtgacaatcaacctgttgacgtccaaccaccttcgaccgatattgacggcactgaagtagaggctactccttctattgctgagatgggcaaccctgtcgatcaaccggactcactacaagaacaacctgccgtcgaggtacaacaaaatgtttctgtagaagaaataccctcacatgctcgaacatctcccgctcctgagacggatacagtgaatgttgaggaacagggtgaaggtcaaggcattggatccagcagtcctcatggatcgagtcagcaaagttcatccgaagaaaacttttccgatgaagaggccataaaagaggctgaagctgggggttcggacatttacccggcgtcttcaacatctaagctttccgctagcatagggatcgcagaagatacattcattcaaatgcaagacgaagaccctgctgcagnccttcgaatcctgctgaacacaagtcaagccaacacctcaaggtga

SEQ ID NO: 20770 - DNA, 267 bp, Glycine max
  Peptide Sequence Number=SeqID_112455
atgaagagcagtaccttgttcgctctctttctacttagtgccatcttcacctcttacctaccttcagccaccgctggtgatttggtcgacactgatgggctaatggcaaccctcttgaaaatggaggaacatactaattatgttgcggttcatttcgaccaattccgcaacaggcgcttcgtagtgattgaggttcaggagcatggattgtgggttatgtttcagaaacttgaatatgcatcaggattaactctttcatctgcatga

SEQ ID NO: 20771 - DNA, 1149 bp, Glycine max
  Peptide Sequence Number=SeqID_112456
atggcaacaacagtttccaacttgccaactgctatgtcaagacccaagattccttcatcacaaaggattgcaaatgtaggtcctgcacttcttggagccagatctaaggttggttcatgttataaactggcaagtgtttgtcatgttgcgtcagcacaacctttccagcaggggttgacaatgacatcaggtgctgtaaaatatgacaaaatcataacaaaggcaatgtccgagtctagttcaaacaaggaagttgcaggattgccaattgatttgaaaggtaaaagggctttcattgctggtgtggctgatgacaatggatatggctgggcaatagcaaaatctcttgcagcagcaggagctgaaattcttgtcggcacatgggtacctgctttaaatatatttgagtccagtctacgacgtggaaaatttgacgagtcacgcaagaactcatcatttttcagattacaagatggttcattgatggagattgctaaagtgtatcctttggatgcagtatatgacagtcctgaagatgtcccggaagatgtgaaagctaacaagcgctatgctggagccacaaattggactgtacaggaagttgctgaatctgtcaagaaggattttggcactatcgacatacttgtgcactcgcttgctaatggaccagaggtcagcaaactattgtccgagacatctcggaaaggatatcttgctgccctgtctgcatcaaatggatctgcaatttctcttacatacattgcttcagaaaggatcattcctggatatggtggtggtatgagttctgcaaaagctgctttagaaagtgatacaagagtgcttgcttttgaagctggtagaaagaaaagaatcagagtcaatactatatctgcaggtccattgggaagccgtgcagcaaaagcaattggcttcattgacatgatgattgactattcgtttaccaatgcaccactgcagaaagaactacatgctgaggaggttggcaacactgctgctttcttgtcatcacccttggcatcagctatcacaggtgctgttatatatgttgacaatggtctaaacgccatgggggttggagttgacagtccaatatttaaagaacttgacattccaaaagagcatcattga

SEQ ID NO: 20772 - DNA, 840 bp, Glycine max
  Peptide Sequence Number=SeqID_112457
atgaagcgagtcactgacccgttcgaccaccaggcccgagctcgactcgtcggtactgatcaccggcaaatcacctccgccgcccaaggtgactctgactccctttccctctcttgtctcatccacggtttcctcgaacaagacaccaccaacgacgactctgactcagtaattcatgactcggactgggacccagtcgactcagtggacgactcccccgactcgccgagcaactcgccgagtctctctttcttacactccaacaatgcggacccttacagaaacttacttatcgcgcacgtttcggaggcgttggagagcctcgcgtttcttcgggagcgaaacgcgtcgctcttccggcggagcgtggcggcgttcctccgggagagaaggcacgacgccgcggtgtgcgagaccgcgcgggactcctccggcggaagccacgagttcatcgacgtggtccagaccggatccgccacatgcaggtatttcgtggacctcgacttccgcgcgcagttcgagatcgcgcgcccgacgcggcggttctcggaggcgctggccgccgttcccggcgtgttcgtcgggggcgcggaggagctgaaacgcaccgtttcgacggcgtgcgacgccgcgaggaggtgtttcaggagcagagggcttccggttccgccgtggaggaagaaccggttcatgcagaacaagtggttcgggccgtgtcgccgaaccgcgagggatacttccatgggatttaacggtggtgttagttgcagggtggtggggttcgacgacgtcgtttcggaagcgggacgtggcggtggcgttgttgttcgtacgagatga

SEQ ID NO: 20773 - DNA, 2640 bp, Glycine max
  Peptide Sequence Number=SeqID_112458
atggagtcaattcaacaaaattataatgatgattccatggagcattcatctagtagtcctccaggttcgcctgatataagtgacgtagttggagccctgcagttggatcctcgagttggtgaagaataccaggtggaggtccctggcatcataaaagaatcagaacggcttcaacttcttatgaatcctgctgattcagaagttatgcttgatagctcgctttcttttgcaattggtttgcccatctcagtcacatggatacgaaatgaagtggaggatagtggacatgaaaggaatcttgccgacgttgatggaggcaaaaattcaggtcaactgggtaaaagcaaaaattatgtattggttcctggcacattgagtaactcttggagtgaagctgatgcaaaaagttttctccttggtttgtttatttttgggaagaattttattaagataaaaaaattcttagagaacaaagggatgggggaaatactgtcattttactatggaaagtttttcaaatctgaagaatatcatagatggtcagactgcaggaagataaaagggagaaaatgtattataggacagaagcttcttaatggacagaggcaacatgaactattgtctcgcttgattccccatgtctcagaagaatctaaagatactttgttgcaggtttctcagtcatatgtggagggcagaacttctgtagaagaatacattttatctataaagtctattgttggacttggtgttcttgtagaagcagtaggtattggaaaggaaaaggaagaccttacaagccttgctgtggaacttgggaagaacaatcgggtgttttcagtaccaacttgtaaagcttgggcttctcttgggcccagtgatataataaaatatttaacaggaggattgcgacttagcaaagccaaaagtaatgatctcttctgggaagctgtttggccccgcttactggcaagaggttggcactctgagcaaccaaagaatcaaggctatgtccactccaaagatcatctggtttttcttatccctggtgttaagaagttttcgaggagaaaacttgtgaaaggtgatcattactttgattctgttagtgatgtattgagcaaagtagtagctgaacctaatcttcttgtgcttgaagaagagactaaagttggtagctgcaatgatgaagagccagaaaagggattgaataaggatgaccaatttgattatcatcgtcaatgttacctcaagccccaagcttctactacagatcatataaaattcatggttattgataccagtttggtgcatggagggaagtcatctgatttaatggaatttaaatctgcaccttttaagtcagtgagtaaagttgaggtaaatgctgctggtattacaagtaaaggggccaaacatacgaggaaagtaaaccattgcaaggatatgcctgataacattgataaaaagttgacaaaattcacagtaattgataccagtaggctttatgaaggaaaattattgaaggtgagagaactgacatgtcttccagttgaattagaaaatgcttctaagatgactgttctctcaagagaaagtaaggatagctcctctgatgaagattcatcaagcatggtgacatgtgacaaaaagaacattagtaatactaatagccaaaaaggcatatctgacagtgatgctaccaaccaaaaagaagcaaatgataagccagataataatgcaaaaaaaagggtagaaagccagaaaaatcagaagacccgtgtgactgatgataatcagctaaagaggactataaagcatcaattccgtcggagggcaagatcagatcattgtaatcctatggttcttcccattaaaaggagaagattgactgcttgtgccaaggcagagacaagccgcgccattgagaattcatcaggaggcttggaatctgaaaaagtggcattctctcagttatcgagctttccagattcccaccaaaatgtttgtgattcagttagttctcggccgaatggaagttcaattgcctctttagctgacagaagtgtggaagtgaataacgaggaaatcattctcaatgaaatttgtcaatccaggagcaagtcttgtgttgaagtcgagaaatgtgaatcacagtcggcggtcaccttcaacacaccccaggttctgttgaagtctgaagatggtgaaatggtggcgacagtggaggaagatgggcagtgcaaaaaggcaaatgatccgtgtttgtcaactgatactcagggggtagtcgaaaagccacaaagatcctcttgtgatgttggttctatggaacagcagcctactaatataaatcctaggagacagagcacaagaaatcgaccattgactgttaaagcaatggagtccttgggaaatgaattcttgcatgtgcagaggagacggaaaaagaaagacatcctgtcacacattgatgctttcagcccatgccgcaaggctcgtacaagcaaaacaaagctgcatcgtcatagttcagatcatggaactgcagttttagtaaaagaaaagcatttaagtggagatcataaaatggagattgtagagttagtggaatgtttccaagccactaagctaaattaa

SEQ ID NO: 20774 - DNA, 1095 bp, Glycine max
  Peptide Sequence Number=SeqID_112459
atgatcactcttccacaaccatcttcactgaaaccgaacttgagagtgtgccccaaagttatgagggtgagagcgagcgcgggaaggaggcactgcgagttcagcagccagaacgcgccccttgagccacggtccctggcggggaagtttctgagcggcgtgttgcagaaccgccgccagctgttccacgtgcttgccaaggaagagttgaagatgctgagtgatgacagagactctgctattgctcgcatgcgtctcagtcaccactctgatgaagccttgcttcacaggaggattgcacaagtgaaagagaatgagtctatgattgctatagaagatgttatgtatttgctgattttatacaagttttccgagatcagggttcatttggttccaaagctttctagttgcatatacaatggaaggctagaaatattgccctctaaggactgggatctagagtctattcacagcatggaggttttggatatcataaggaaacacgtcagtaccgtgacaggtttgagatcaaatcctagtgtaagggagagttgggaaacgactcctattcgacaattctggcttgcccgagtctatgtcgcctccatattatatggctactttttgaagtcagtttcattgaggtacaacctagagcgaagtctgtctttgtctgaccatgatcttcatcatggtcacaagaccggcccttcatttcaggacatgtatcgttccgggccaaaagacgtgatgcttggcaacaagagtgacatacgatctgtgtggcatggtttaatcgggcaggaagaggaaatcgaggatttaacatgttatgttacgggctttcaccctggatcatttgagagatgtgccaaactgagatccaaggaagctgtgcatttggtagagagtcatagtaatgcactttttggagatgggaaatctggtttgtctcagcatgatgatgttattgtaacttcattttctagtctgaggaggctagtcttggaagctgttgcttttggatctttcctgtgggagacagaagattacattgacaatgtatataagcttaaagatcaagtggttgagtga

SEQ ID NO: 20775 - DNA, 870 bp, Glycine max
  Peptide Sequence Number=SeqID_112460
atggcaacaacagaacatcctcggagaaaactcattataaagatttactttccacgttcccaaaagcatgaggccgcctctgaggtttctgattcttgttgcggtgagaagaggagtaccgtcacttcttcgaacccaccatctcacggtaccaacactccaaacgattcaagaagcgcgtcgaaagtgtgtgagctgaagaataagaagggttattatgcgactgcaacatgggttaacattgaaaacccatcatcggaatcttctgccattgattcaagaatttcaagaaccgggtctgaagtgtgtgagttgaagaacaagaaggagggtgtgcgtgtagggtgcaagaacacagataagaagcgaaaggtcgtttactctccacgttctgaaaatcctgaagcaccctctgatgagaaaaggagaaaaacgagttcttcaaacccattatcagaagattcaagaactgtgcgtgtagagtgcaaaaagaagcgaatattgatggaccgttgcaagaagatgcagtgttgggctatgttgaagcgtttaatggtgggaagagatgcgtgggctttaaaaaaggatattcttgatcccaaggtattgtgcgttcttcataagtctgaagccataagaaagccaaagggtttggaggatattgagtcaaagttgaagaattgggattactccgaaactgatgagtttgtggatgatgtgaagcttgtgttgtcttatgctttgcaatatcctcaaaggagtgaggttcatagaactgcaaggaggatcagtgagggttttgagatcagttggaaaactatgaaggccaagtggatgcgtgacgaacaagatttgcaagagaagagatga

SEQ ID NO: 20776 - DNA, 858 bp, Glycine max
  Peptide Sequence Number=SeqID_112461
atgtatttttcacaaactccttcagagttgctagatgatggactgaaaaagcaatttagaaagagaaatccgaagatggaagacttagaagcaaagatatcagattcaaaaccagatgactcaagtcctctaaaactctacttgctcccttttcttgctccgggacacatgatcccacaaattaaccttgctcaagtttttgcctttcgtggccaccatgttactattcttaccactccttccaatgctaaactcatcccaaaacatctcaatgtccacatcttgaacttcccctccgaggaagtgggtctcccttcaggccttgagaatatctccttggccaaagacaacaacactgcctacaagatatggaaggcctcaaagcttctcaaacccgaaatcgaaaacttcttaaatcataaccctcctcacgctttgatcatagacatcatgtatacatggagatccacacttaacaatagcatccccacgtttgtttacagccccatgcccgtcttcgctctttgcgttgttgaagccatcaatcgccatcctcaaactttggcttctgattcttcacttccttatgttgtccctggtggtctcccccacaatgtcacgcttaattttaacccctcatcaactagctttgataatatggctcgtactttgctacacgccaaggaaaataacaaacatggtgttattgtgaacacatttccagagctcgaagatgggtacactcagtactacgagaaactcacccgtgttaaagtctggcaccttggcatgctctcacttatggtggattatttcgacaaaagaggcaagccacaagaggatcaggtatcggagtaa

SEQ ID NO: 20777 - DNA, 416 bp, Glycine max
  Peptide Sequence Number=SeqID_112462
atggctaacggcacagcgtgttccgcaggtggagcggggtggccagaatggctagcggatagggcaagtaccgcagggggagatgtgttgggttacaagtgtgaggtgaagtcccacattgggtttccttatgtggtgactcgtggtccacagatgtacccctcgaatctccccaacaactgtttagaggaggcagtgggagcaatgacattaaaagaggggaaggtgaagatcgagaagttcgatggcagagatttcagcttttggaagatgcagatagaggattatctatatcagaagaagctgtatcagcccttatcaggggttaagccagaagacatgaagcaagaagaatggaacttgctagatcgacagactcttggcgtgatcagattgacattaaccaagaacgtcgc

SEQ ID NO: 20778 - DNA, 303 bp, Glycine max
  Peptide Sequence Number=SeqID_112463
atggtgtttctgcaaggggtcagcaagtctgagagaatgaaagctgctatttttacagggaaggctcaggccatggccacaatcaccgccaccgcctccaccgccgccgtgcctaatggggctttcggcaccgggtttttaatccaccggaaccttctattgaccactcacgccaatcttccgtcggtggtcgccgccgacaccgctgagatccggcttcacaatggtgtggctgccactcttgttcctcagaggttggatcgggtagattcgcttgtggagggaaaagctcctgttgcttga

SEQ ID NO: 20779 - DNA, 819 bp, Glycine max
  Peptide Sequence Number=SeqID_112464
atggaaacacaggacaagatcagcgcattacctgatgaagtcttgggtcacattttgtctttcctttcaactcaagaggccatttccacaagtcttgtctctaagcggtggcagccattgtggctctccatccccatccttgatctcgatgacataacttttatccaaaatggtaaatcctactcctccttttttaattttgcttttggctccctcctagcacgtaatgtgcaacaacccctcaaacttgcacgcctccgcttcaactcttgcggatatgacaacaacttcccctactcccatttcaagatatgggtaaatgctgttattcaacgtggtcttgagcaccttcagattgagatgccccgtccatttgagttgccaaacattatcttgaattgcaaaacgcttgttgttcttaagttgtatcggttccgtgtgaatgctcttgggttagttcacttacccgcacttaaaacattgcatttggataattttactatgttggagacttggcatctagcaaaggttcttcatgagtgtcccattctagaggatttgcgagcgaataatatgtttttttacaacaagtcagatgtggtagagtttcagatcatgcccaagttagtgaaagcagagattaaagttaattttaggtttgagattcctctgaaggtagcatctaatgtggagtatctgagattcttcatcaagggtcacagatttggccatggagaccacagacctgaccatagaggttgtacatctagccatagagattgcgaacctggagatcttgttgtttgggtagggcgttga

SEQ ID NO: 20780 - DNA, 669 bp, Glycine max
  Peptide Sequence Number=SeqID_112465
atggaggaggtcgttttggtttcggcacacgctggagttgaggtggaagtgcgtgatggagtgggaggggttgcgagagagaatggcgacgtaggcgaacgtcaagaaggaggagtagggtttgtcgttttggagaaacggttcatcgtcgaggtcgaaggcggggacggaatgccacaacggcttccagcgcttggagagaaggctcgtggcaatggcttcgtgagttgggagaaagagggaaatgctagcttcttcttctcttccgtgaacctgcttcttcttctcttctccgtgaacctgcttcttctctgcgaggcgcgccaaggttgtcttcttcttctccgcgaacaggatagtaaccttagggtagaagacgagagtagaagacgccggaaaaaatgggaaaaagggctcacggcagaggcttccggaagaacctgttccggaaactttccggaagaagtgttcttccggaagttactgctcattccggaacttcttcgtcctatacttaaaatttcttccagaaacagctttttactgggaccaccaaatcttcaaatacggaacacctacttcacgggaccaccaaatcttcaaagctacacagcgtggaaagcaatagcaagaaaacgaaagaaagcaacgaaggatggagcgcagtaa

SEQ ID NO: 20781 - DNA, 486 bp, Glycine max
  Peptide Sequence Number=SeqID_112466
atgattcagttgttgttcttggtgatttttgttgagggggttctggcatttcttttgttggtgaagataggacctttgagagatcttgtgataaagagcctggatcagttgaagatggggaagggtccagctacagtgaaaaccattgctggtaccatgtctgtgattcttctttcaagtctcatgagcattatcaagatccagaacaaaggtgctaaactcggtactatgtcgcccatggatcaagttctatggagatctcacttgctcgaggcttcactcatgggaaagaaacttcgtcgattcaacaaattcattgaggatgatgaaacactgtcgtctggctgctcggtgtttggattccgtggagagatggttgctagagggttggggttctggcaaggaaggtttgccggagagaagccagtgacagacggctggtggagggttaggagagcaggcccaacgagatgcttcttctgttga

SEQ ID NO: 20782 - DNA, 252 bp, Glycine max
  Peptide Sequence Number=SeqID_112467
atggaggaaaccaggattctaataatcctggacataccttcgcatagcgaagagcctctgggtaatggggctgacgcttcactggatgattttttgcagtcattgggtctcgaaaagtatctcataggttttcaggctgaagaagttgatatgactgcactcaatcatatgactgatgaggatctcaaggccatgggtataccaatgggaccaagaaagaagatacttttagccttggagtctaaaggatga

SEQ ID NO: 20783 - DNA, 1188 bp, Glycine max
  Peptide Sequence Number=SeqID_112468
atgtctctagccgaatatctctcatatgtccctgatgatcttattgttgaaattctatcacggcttccagtgaaagatcttatgcgttttaggtgcgtttgcaaaacctggaaatccatcatctttgatccaagttttgtgaaaaaacatcttgaaagatcttcaaaaaaaatccatctcataataacccgagaagaagtcctctatgatggttttgactatgactatggtgatgcttatgccataccctactccataaatcaattattcgagaatccatcatcagatgttgatgaagatgactactatcaattaaatggttattggatcattggctcatgcaatggattggtttgtttgggtggttatcatggtgaagaagacacaatttacgaatattgggtccaattttggaacccagctacaaggatgaaatcaaggaaatctccgcgcttacatgtcaatccatgttgtcaaggattcgacccatcaaattctataggctttggatttctttatgatgatttgagtgccatttacaaggtggtgtcagtcctttcaaattgtagatccaagaaaacagaggtatgggtttacaacttaggtggcaattgttggacaaatatctttagttgcccaaatttccccattcttcgtcaaaatggaagacttgtgaatggaactattaattggctagctatcgacatgtcaagttctcattatgaagagcgaaatgatattatcgatccgttagtaattttttcagttgatttacaaaaggacacatataaatatttattgttgcctaaaggtcttgatcaaatcccagataatgatcaattgagaattgtggaattaagggatcgtttgtgcctttatcatgatcgcaatgcaacccattttgttgtttggcaaatgaaggagtttggagtagagaagtcttggactttgttgatgaaggtcacttataatcatctccagataccataccctccagatcgtccattacttccattctgtatatcagaaaatggtgaagtcttgatgttggtaaacaatgatgtgttgaatatgactttttataatcggagaaataaccgagtagaagttattccaattccaaacaacaatgcttggtggcaagctaccaattatattccaagcttggtttcgccttttcagaattaa

SEQ ID NO: 20784 - DNA, 726 bp, Glycine max
  Peptide Sequence Number=SeqID_112469
atgtctgcatcaggaggcagaggaagccaagaggaagagaagaagccttctgatcaaggagcacatattaatctcaaagtcaagggccaggatggtaatgaggttttctttaggattaaaagaagcactcagctcaagaaacttatgaatgcatactgtgatcgtcaatctgtagattttaactcaattgctttcttgtttgatggaaggagactccgagctgaacagacccctgatgagttttggagtggtggtcagggattgaagacagagaggctagagatggaggatggtgatgagatagatgcaatgctgcaccaaaccggaggtggacacaataagtttaagagggaatcaagttctctcaccattgttacaatcaaatatgaattaatatttaagtctttctgcgtcggagctgttgacgagggggaggtcaatggagagaaggatctggagggaactatcggagtccataagggcatcattgtcgacaaacctgatgaatcagaggaagaagccgagaaggtgataccttcaacaacatttgctactgctcctcttggttcgtgcaacccccacggtctctggagaccatggaggttaatggtggtggcatcgcaagtcatcaatggtgattatggatatgaagaagaaggaggaacaagagagagaaggataaatctaaaaaagaaaaaaacaaaacaaaaaagtcttaaccattga

SEQ ID NO: 20785 - DNA, 288 bp, Glycine max
  Peptide Sequence Number=SeqID_112470
gtgcaaatcgcaaaagagaatgtatactatgccaagcaagccaacaagcaaaggaaggaactggtacttgtacccggtgatgatcctggacacttgaggacaaatgtattccaagaaggaaggaatgatgagaatcatgaaactggccaaatacaggctaaagtgatgagaatcatgaaactagccaaatacaggctaaaggcccaagtggagaaggacaaaggcctaagtggagaaggacaaagcccccgagtggagaaggatgaaggcccaagtggagaaggatga

SEQ ID NO: 20786 - DNA, 489 bp, Glycine max
  Peptide Sequence Number=SeqID_112471
atgacaaagaaatctcacacttcttatccaatctatgtgcagaaactcaacattgctaaaaacttcgaatggaaccacaaccgcagttctatggatacgggctctgaccaacttgcgcaatgttttaaactctgcttgaattcctctcatatcatcttcaatttcatcataaaattcatcgccacgttcattcgtaaatgcagaaaccgagcaaaatgcgtgggtttcaagaaattgagggaattcaaatgcaagattctaacatccattcttgttctcttctttctttcgatcagcgcacgcggtagccagagggatcgtgatcgcgaaagggctcaggctagaactggtgctaaaggcaagcagaaagatgatggattgacccctgaacagcgcagggaaagagatgcaaaggcgctgcaggagaaggccgcaaagaaagcggcacagggtgcaggagggaataatgcagctggaagcaaaaaatag

SEQ ID NO: 20787 - DNA, 3519 bp, Glycine max
  Peptide Sequence Number=SeqID_112472
atgggcgcggttagggttttgaatgatggggcgaattgggaagtgatgtttgtgctgtgcattgtgttggaatggaatgtgtatgggtttgtgtctgttaatggggggggagctagtaatttgaagtgtaaatgtgtggttggtgatagtgggatgcatggatgtaactcaggatctgctctccttgtaaatgctgaggttgattccatggggggtgttgttgatggtggagttggtattggtttgaaaacctctccgcgccgagcagcaattgagaaggcccaggcagagctcagactggagtatgatgcgcgcgaagaaagaagaagggaactacaatttcttgaaaaaggagggaatcctttggactttaagttagggaatggtgcttcagttagtgttcagtctacttcactcactgatcagcaccaggagcagtttgtgaccagtgaagcaaaaggtagttttgtattgactgcctcccctcatggtgactctgtcgacagtagtgctagaccaggggtcccttctcttagtgaaccaaataccgctgacaacctcttgctttttgatggtgataatgagttgcttgaaggcgaaaagaggtctctacattcaaataaaaggaataatattgctccttcagaacaatcttctcgaattggtgggaatcaaaatgcaaaggagactgaagattctgctattttcaggccatatgcgcgaaggaataggtccaaaccaaatcatggtcctcgtgggggttcaagggatttgaagggaataatatctgatacaaacaaacaaaaggaccacaatgttctttctgtttctaagccaaagcctacaagttcaaacggtgaggttctttctaaagatccaacgtccaataatccactgggtaatgagttggttggtgtccgagcttgtcaaacagctagtggcagtgctagtgttcctgaagacaaattggatattgtcatgaataaaaacttcaaagaagatcaacgaattgtaccttctcaagatgatattgtacaaaattcagttgtcttggcttctagggaagctaaagcagttggagaaagggacctgggaacttcaggtgatcttgagccttcaccttgtgcagttactaaacaacctggaaatgaatcttgttctggtcagccaaatggatttggaaacataaaattagacagggtaggtgtaccaaatggagaccaaaattgcagtgctgcattaggcatgaagaattattcggagttctcctgtgcacagactagtttagctagagatgtaaataataataataataatatgtgtagtaatacgaagaatattgatgcaaatggaaatactgtggaacaaacatcagaatttgatcagaagctcaatttaactggctgtggagttgtaaaagaaagtagtaataccaatgctggtgaaagtggggttacttcaaacaatcaacatgctactggttacgaaaaccattttggtagtggtaatatggtcaaaagtgaggaagacatccatattaatagttctggcatgctaaacaaggtgaaagattctcccaatattaaaggactgcacaacaacggaagttccatatcaaatgctgataaagagaaaagtgttggcctgatggatcatcctaattgtatcatggaagacagttgtgaaagacttcaagttcctatggatgtatcattttcaacaactcaaactgctccggttgaaaaggttactactactactgcctctgactgtcaaccatgttctacacacaacttgaagttaccagacaaggctcttgaagattctattttggaagaggctaaaattatagaggtcaagcggaagaggattgcagagttatctgttcgcacattgccctcacagatccatagaaagtctcactggggttttgtccttgaggaaatgacatggttggcgaatgattttgcacaggagcgtctttggaagataactgctgctgcacaattatctcatcaggcatcttttacttctcggttaagatttgaaaaacaaagcgaacatcttggggtgaaaattttgtctcacaacatggcaaaggctgtcatgcagttttggaattcaattgagctccttctagacaatgatgttcctgggcgtaattgcattgatggttcagttgaatctgggaacattgattcagatgaagcttctgggaacaggaggagcaattcgaagatggtgctggcaacaagcaaatacctggatggacaaaatcccagaaaacaggtggtatttaaggtgcacagttatgctttgagatttttaaaggatagtagatctctgggaatttccagtcaagcagaagcaccaacaactcccgataaaatatctgactcaggcattgttgacatgtcatgggatgatcatcttacagaagaaaaccttttctatacagttcctcctactgcaatggaagcatacagaaagtctattgaatctcattttctacagtatgagaaaactggtagtagcattcaagaggaagttgaaacatctatgtatgatgctgcagcagaggttgcatatgacgaggatgaaggagaaaatagtacttattatttgcctggtgtctatgagggtagcagatcatcaaaatcatttcagaaaaaacacaaaaacaggataaagtcttacactcataagtccagtgaaattggaattgatttgccttatgggcgttattcaactggagctcagccatccgtgctatttggaagaaggcccgctagtttaaatgttggatcaattccaacgaaacgcatgcgtacagcttctaggcagagagttgtcagtccttttgctgtgatctctgggacagtacaggctcatgctaagacagatgcttctagtggagacaccaattcctttcaggatgaccagagtactttaaatgttggatcacagatccagaaaagtttggaggtggagtcagttggagattttgaaaagcaagtagcttatgactgtggagaaacatcagttaaaacaaagaaaaagaagtccaagaatctgggttcttcatatgatcaaggatggcaattggattctgttgtcctgagtgaacagagggatcatgccaagaagagattggatagtcatcactttgaacctaatggaagtagcggtttgtatggccagcatagtgtgaagaagctgaagacaacaaaacaatcccttgataattttgacaatgttgctccaatagctaattctattccctcccctgctgcttcgcaaatgagtaacatgtccagtccaagtaaatttattagaatcattagtggtggacgagatagggggaggaaagccaaagcacttaaggtttctgtgggacagcctggttctggaagtccttggtcactatttgaagaccaggctcttgttgtcctggtgcatgatatgggtccaaactgggagcttgttagtgatgctatcaacagtactatacaattcaag

SEQ ID NO: 20788 - DNA, 47 bp, Glycine max
  Peptide Sequence Number=SeqID_112473
tccgaacgatgttccacaatctcaaacagtgtttcttgaagaagacg

SEQ ID NO: 20789 - DNA, 489 bp, Glycine max
  Peptide Sequence Number=SeqID_112474
atggacgaaaaagagaaaggaagcacacgacgtgaacttgtgctcgaatatatgaagacacttagatttgaacaccgatctctggttaaacatctcaaatacaaatccgttgtcgctcttgtcatgggttatgatgagggtggatggtggaggttgggtcgtcagcagttgcacgggcagttatggatgacaagtggtgtggtgggcgctaaggtggtgaggcggcatgcggcaatgctggtaggggttgcaccaactttgttgaaggtgcaagggtgcatgtgttcggaggcggaatcagatctggaggtggaggcagcgtgcaacatcggaggagggtggtggggttggtgcgtgatgttgatggagtgtggcaaggttggtgagcaacgtcggaggagggaggcggggttgatgcgcaatgctttttctttcggctctctctctctcttccaaatctggtttgagatctctttttttctcctttaa

SEQ ID NO: 20790 - DNA, 966 bp, Glycine max
  Peptide Sequence Number=SeqID_112475
atgacttccatagagcaacaagttaatcttgtggtggtcgcacaaccaattaatgctattaaggatgctgatatcctcgaaagactttggaatgacttcgaagaccaactaaggaaagccaagacgatagcatcagaacatctccgacttggtggagattcatcagttgcgccaatattccctatgccagagacaaacgcatcagataacgctgatgaaacctctagaaaaactctacgcaaaaggggaagaaagacaacttccaaggttctcttccaagtgcctttttcttttcaacctcctgaattttgtttgaaggaaaacatcaacctggagatagtattattaaatcgattcaagaatgaatcaagttgggggaaccacgttcccaaattttctgtagaagaaagattaaaaaattgggtcatcgaaaaaaggaaacgcatgcaaagcaaggacaaagaaaaacctgaggctaaaatgcaagattattactatattcattcagcatcgcagaagacattacggtctcataatgaggtccttgagtttttgctcgacgtagaaattcctcgaaaaggtggtagcaagaaagcaaaggttgtcggggctgtagataatcaggtctcaggttcggcatcccatgaatcaagcagaaggaaagaaatgtcattcgcttcccaaatagtgaataagatgaatagtagtaatgaagaagagcataagggagggatggagagtatgtataagatgaagagtagtgatgaaaaagggagtaatgaattggataataaggtgatgagtgatgaattgaagaataagatgaaagatttagagaaggagattatgccgtgggatgatgatgaaatggggctatataagatggttgacattaatgaaattgaaaatgaactgatgattcaagaactgttgaaccaaccgggagaattgttgtttaatttgtga

SEQ ID NO: 20791 - DNA, 540 bp, Glycine max
  Peptide Sequence Number=SeqID_112476
atggctacaccatccacacccagctcccatcctcctccttctgagttagcaacaccttcgtcatctacatcgaacaagacaagaaaaacaacacggctaagatcattggctaacaaactagttggggcgaagaaaccagtgattcatgtggatcctgtcactgggaaagtcgatggtccccacagaaagaaattaagaacgtatttagggatcgtcgctcgagacaaggatgtattgactgttatcattgggcgaccagagcaccctagtcgtgtccgtgttgttggagctgatgtcacgatcaaacaatactttggaccgacttcaaggagctcttgcacgtctacatccatggctcccgaagacatgcaatcacaaggactcactcttcctcctgagcttgaggctagtccttctactcctcatgtcagcacaaagggaagttgtatcgatccctcgggagtttttgaggggtcgaccactgttcacaatgtccctttgggcaatgatcaagtgaaggtcagtgttgaggaagtttga

SEQ ID NO: 20792 - DNA, 231 bp, Glycine max
  Peptide Sequence Number=SeqID_112477
atgtccctcaagtcccagagtcaaatatcccttaggtcccagatgatccaaccaggaggcttgcgatgtgatcgccgagaggttggagcatcactcagcttagggctagtcacgccaggcacatcgacacatgaggtcatcaaagaatgtctcaagattaccaggagtgtcacccaggaccgcattgtgtacgtgaggtctcaacataggcgtcgtatgaatcagccgtag

SEQ ID NO: 20793 - DNA, 339 bp, Glycine max
  Peptide Sequence Number=SeqID_112478
atggagatcttccaatgctggaatcttccttttgtaaaagaaatattctttggagatcttgggaaaatttcacgtggaaagatgtttatgcactgtctaataaatcaagttcatattggcgcaacaaagagattcttgagatatataaggggtacaactgattgtggccgcgagtatcatgccattagagaagcagagaaatcaaaggaaataaatttggagcattgcaatttagaaaatcagattgcagaaattatgacaaaagccctttcaaagggcaagtttgaagtgttgagatcaaagcttgaagtattgaaaatccccaaggatgagtgttag

SEQ ID NO: 20794 - DNA, 720 bp, Glycine max
  Peptide Sequence Number=SeqID_112479
atggcagaatgtgtggcttctgcattctgtgttaaactggttacgcagagaaggcctgttagagagaggggcttctcgcgtcagattacaaatctcaagacttttcaaagaaagtattccagaagtggatgtaaatttgttcacttttctacatggaagacatttgatctgagtgtatttgggaccacacatttgaaattcactcctcgtcttcaggaacttccattaaagtgcattggtttaggggctttggttgactttaatggtgcaaaagcctctgatttggttccagttgttggccagatgcttttgatgggcagtatatttctcacttatatggctggagtaattcctgttgagaaatcttatgctagttatcaaaagactatttctgataaaaatgtgtttcctgaaagctcagacatttctggtagttcagcgaagcaaaattctggttttgagtcaaagtatgtattgaatgtggtgagagaaaaacttttaaattctctaaatgctttagctaacaaggattattctggagacatcatcgttcaatctgcaaagagacccttgagtttaagtgctgttgccaggggtccaaagttaagtctagaatctagagttttgacaaattggaatagaggccctggccttgagtttaagtgctgttaccagaggtccaaagttaaggctgctttgggttgcttttcagcaagttga

SEQ ID NO: 20795 - DNA, 342 bp, Glycine max
  Peptide Sequence Number=SeqID_112480
atggtgggacgacaacctatagaggggtctaagaagaggccgaagctgaagtcgctggtgatcataacacgggagagcacaaacacgccccatgcccaaatcctcaaagttggtattgactgcaacatctttgaaattgttgccaactacacaccagtgctagtgcaagatctgtatcctcaacaacaacgaaatgatcacaaatgtgagcctatagaagctatcatcgatgagtgttgtggtcacacttcacggaaggttcgagatactatccctgatagagtcgttccttccttcgtcgacgccattaggggtgaggagtctccacatataaagtcatga

SEQ ID NO: 20796 - DNA, 648 bp, Glycine max
  Peptide Sequence Number=SeqID_112481
atggtggaaccttacagaaggcccaaatcctttactccattggtcactatttacatggctgctttctactctggagtcattggtgctgccatcactgagcaactctacaaggaaaagtactgggaagagcaccctgggaaagcagtgcctctcatgagaccaaagttttatgggggtccttggagggtcatgggcgggactagggttgttgacattgtcagctatgcttccattatctctgacaaatgggttgcaattgcaaccgatcaattcgatcaacagcatccaaaggagaacaaagatagaaaagctctttctttatttggtgttgccatgatcattgcattgcttatcttcatgctcggaaccaccacctacaggtttaacatccagggaagtcctgacaagagccattttctccgaattggtcgtgtattcattgcagctataagaaatcgctcgagtagcctagagcaaagttctggacaattcaagaattattctatgattaagtcccgaatgagctcagaagcatgggtcttgctctctatcatagtggtggggagctttcagctttctaatttcagtgatacttttactggctacttgctggactcagtgtcatgggattggatcttacatttataa

SEQ ID NO: 20797 - DNA, 894 bp, Glycine max
  Peptide Sequence Number=SeqID_112482
atggaagggattagtgtgtgcaagaagagttcaaaattaggaaagaaagatgacctctatcatgttattcataaggtgccttatggagatagcccttatgtcaaagccaagcatgctcagttggttgataaggacccagaagcagcaatagtgttgttttggaaggcaataaattgtggggataaagtggacagtgccctgaaggacatggctgttgtgatgaagcaattagatagatctgaagaagcaattgaagccatcaaatcttttagaggcctttgttccaaacactcacaagagtcacttgataatgttcttcttgacctttacaagaaatgtggaaaaatagaggagcaaatcgaattgttaaagagaaagctaagactaatctaccaaggagaggcctttaatggaagaaccacgagaactgctcgctctcatggcaaaaagttccaagtctccatcaaacaagaaactgcaagattattgggaaacttgggctgggcctacatgcaaaaggaaaactacatgatggctgaggttgtgttcaagaaagcacaaatggtagatgcagatgccaacaaggcttgcaacttgggcttatgcctcatgagacaatctcgttataaggaagcttattacattcttgaagaagttttaatgggaataattccagggtctgatgaaatcaaatcaagaaaaagagctgaggaattgcttgaagaattgaatgctaatctgccccaacctgagtttatggatgctttgggccttgatgatgactttgtgaaagggattgatgacttgctagatgcatggaacacaaataatagaccaagaaggcttccaatctttgaggaaatctcttccttcagagatcaattggcatgttaa

SEQ ID NO: 20798 - DNA, 495 bp, Glycine max
  Peptide Sequence Number=SeqID_112483
atggacgatggaatcttcctgtgctggtcatggcttaagaatttggaaagggttttggaattcactttaatcaatggtcgatgttcaaatttgaggatagatactaatttgcgaaaattagcttgggaaaaatatgacaacacaattaaagaatgcacaaaagcattagaactgaatcctgtgtacgttaaagctttggtaagaagaggagaagctcatgaaaagcttgagcattttgacaaggctattgatgatatgaaaaagatcttagaaattgatccctcaaatgatcaagctaggaaaaccattcggcggctagagacccttgctgcagaaaaaagggaaaagatgattgatagagaagtgtttcttgatgcagcacaagtgaaagacatgggcaattctttcctgcgctaccttgggctgaaggaaaacaactttaaagcagtcaaagatccaaacactggttcctattctatctcattccaacgttga

SEQ ID NO: 20799 - DNA, 1215 bp, Glycine max
  Peptide Sequence Number=SeqID_112484
atggaagaatggtactacaagaagagccaagtgccagcatttgggagttgggattggaacgataacctacctttcacacagtgcttcgagtcagcgaggcaagctggtttgctacgatgtagtaattactctgagtctgaggaacgtgacctttatgttacaggggatttgtacgagaataatgttgtcacacccgccatgatcgttgttcctcgcagaagggcaaatgtggttgaccagcatgaaaaagaaacgaaattaaagaattggatcagtgatgatgtggatagtgaatcacccagcccaactccactgccaaggccaacttcaaaacccgttgatgaggacttgtacaagatctcaccggggcttgtttatgccaaagctaaaaaggagtatgaaacgttgagaatgaagaacggggaagccattttgaaggtcttggtgccatgtactggtcctgatacattacgagctgagactttgaggtattacgagaacttatttgtttctcatgagtcagttgctactaacccattacagaatcccgttgttcagtcattccacaataagtttacaaatgtaaatggtggaaaacatctcaatgttgatgtggaccaactttcaaactatgttccaccaactgatgaagacaacaatatgtcaaccccaaatgtccattgcatatccgcgcaagctactccactttggcgtaacggactagttgataaatcggtgttgcacaaagcttgtgaattatccccccaagaaactccagcttcagccattaatgcccccaagaaactccagcttcagccattaatccacaagaactttataaatgtaaatggtggaagcagtctcaatgttgaggatgaggaccaactttcaaaccatattacacctgcaagtgatggagacaacaataaatcaaccccaaatgtccaacacatatcaccacaagattttgggagcaaaatcccttcaaggaaacggtcacgggtggtatacctgacaccattgaaggagtgtatggaggagctttggaaattacatagaaattatggaaggcatgcagaagagcgtatattggaggataatgtgaacaacttcatacccgaaaatgagatagcaggacttggagccattcttcttaagacggatcatgatgttgcagcttctgcagatacatgtgaatcatccacagatgattga

SEQ ID NO: 20800 - DNA, 411 bp, Glycine max
  Peptide Sequence Number=SeqID_112485
atgggtttgaacggtgttcttcttggaaacagagctgcgttggcggttcgcgtggctagtgaagcagatctggcggtgcggtgtgttccgacagatcttgtggtgggttctgagctcgcggggggttacgttgtcggcgccgaagagatcaccggtgacggcagcgcttgtcggagagtggtcgtggaagacaccgggagggagagtacggagaagaaggaaggaagatcgagatttgatactaaagttaaacctgatgaacaaagtgctctgcaaagagagaattgcactgctgcagcggatggagaagacattgaagaacgtatacccgagtttcataatttaacttacattgaattcatctattttgataatgttgagtatgggcttttgatgttttacaagtgctga

SEQ ID NO: 20801 - DNA, 239 bp, Glycine max
  Peptide Sequence Number=SeqID_112486
atggcggagatgattaaacttggtgataaaatgagaagaatgagttatgaaaatgaagaaaggatggagacaatgagaaaggagaataaggatagtttgggaagaatacacaagagtagagaagccttaagtgtgaggattgaaaatatagggcaaagaaaaaaggatagatcatctaattcttctcgtgcagaagatgaggggcatgaagaggatgagggaggaaagaggaataagag

SEQ ID NO: 20802 - DNA, 216 bp, Glycine max
  Peptide Sequence Number=SeqID_112487
atgtggaccaccacgggggaggagcttgccacccagctcgcccaggcgagcaaggttgcttcctccagaagcaacagccttctagaggaagaatctggaaggcccaagtggctttcgaagaagttgcggaaactcacggattgcgcaaagacacctcttttttatttccgccacattacggaatttcacggatcgcgtaagcttgcttccctttga

SEQ ID NO: 20803 - DNA, 440 bp, Glycine max
  Peptide Sequence Number=SeqID_112488
atgggtcagctccagcgacaagcctttaacaaagcttatggtaagatctgggacctaaccatggtagatgtctccacagaggccattccctccctcgcccaatattatgaccagcctttgaggtgcttcacctttggggacttccagttaacatccacggtggaagagtttgaagaaatcctgggatgccctctaagaggaaggaaaccatatctcttcttgggattctatccctccttggctagaattgctaaaatagtcaaaatctcaacacagaaattggaccacgggaagcaagtcgaaaatgaggtggttggggtaccaaggaaatgtttggaagcaaaggcgagagtcttggcaagtcaagacgaatgggccccgttcatagacatcttggcacttttgatcttcggggtggttctctttccaaatgtggatgg

SEQ ID NO: 20804 - DNA, 391 bp, Glycine max
  Peptide Sequence Number=SeqID_112489
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgaggagttagtcttgaagtcatgcgccggttaaaggctaaaactgaaaggacaagttttggtgactgcgctcctccaagccagttacctcggttcaaggagttggtagctcagaggacccttcgaaaaaccgccctgcaaggcg

SEQ ID NO: 20805 - DNA, 423 bp, Glycine max
  Peptide Sequence Number=SeqID_112490
atgggtgtaagcctcgctgctcggaaacacccagtgctgaccacactgagagacacgaaagcgcagatcccgcatccaaccaagtctttgaccagggaacgggagaattcccactaccgctggaaggccagccgggccgtgagcgcggtgggaacgggcttcccaaaaagccagcccccgggccggggtcggcatagaatgaaaggggacggccctaatgttgttgtgttggcaaagccaacttcttgggttgcgggcggagaagagcggacgtggggactcagaccggggcgcagcgtaactaagagagccattccatttagggcgagacagaagacaggacgcactcttgacgtagatagaaggcatttctctagaaaagtctatctctatcgaaagagtgaaccgctaactgtgtggtaa

SEQ ID NO: 20806 - DNA, 266 bp, Glycine max
  Peptide Sequence Number=SeqID_112491
ttgagacctcttacgtgccgatcaacgtctcattttcgccaaaagttggccaggccttcccgctgtcccctccctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 20807 - DNA, 252 bp, Glycine max
  Peptide Sequence Number=SeqID_112492
gcggtgttgtccttgctgaggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgagggtgctgacgattgggttcctgtgttgcctacctaccaaacggtattcgtggtggcta

SEQ ID NO: 20808 - DNA, 213 bp, Glycine max
  Peptide Sequence Number=SeqID_112493
gaaaaggaaggagaagcttgccacccagctcgcccaggcgagctaggttgcttcctcctgaaggcaccgccttctggagaacttcctggaaggccaagtgggcatggcctaggatcttcttcatcaatggattcctttgcttcttggaagatgaatggcagtggaatggagaaaggaagagagagaggtgacgctacttcaaggagaagatga

SEQ ID NO: 20809 - DNA, 666 bp, Glycine max
  Peptide Sequence Number=SeqID_112494
atgggaacaaatcaaaccagcaagaggttctaccaagtcaaggtcaaaagcctaaataccaccagcatcaaggaattagggcggttgatggaacccctccaaatgcaagccttccgcaagacttacggaaagatcttagagttaaccatagcagaggtgtccatagaagccattgtatcacttacccaatactacgaccagtctttgaggtgcttcacattcggagacttccaattagtaccaaccattgaagaatttgaggaaattctaggatgtcctctcgggggaagaaaaccatatctttcctccgggtgtctcccctctttgagcagaattgcaactgtggtcaaggattcagcaagagacctagctgcaatcgacgctttccttgcctaccaccatagcaaggaaagtccggtggtagctgtcttggcagatctatttgacacatttgaccgaaggtgcgaaaagagtagcgcacggatcatctgttgcttacccgccctctgtgtttggttggtttcacacttgttccaacaagacacaagacatccatgtccgctcctgagccatcgctcgtgtactgaaaagaggagaatagattgggaccagctcttggccgggataggaggtagaacaatcagttggttcccccgatggaagtaa

SEQ ID NO: 20810 - DNA, 258 bp, Glycine max
  Peptide Sequence Number=SeqID_112495
ttgactctacgtgccgatcaacgtctcatttcgccaaagttggcccagggcttcccggtatcaacaggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 20811 - DNA, 277 bp, Glycine max
  Peptide Sequence Number=SeqID_112496
atggctttcttttgtggggcattgagaggcaatgagacctcttcccaagacattttgaagcatttaatgttgctagtcctttcttcgggaactagtcttaggggggatttctctatggtcttaccccttatcttcccttgggttttgaagggaatgtgcctcttcctaagggcactccttatgatcattccaatactctactggaggatccccatgaatccttcattccctaacaagggaagtccaccaatagagggcatacccttgaaagctaagg

SEQ ID NO: 20812 - DNA, 300 bp, Glycine max
  Peptide Sequence Number=SeqID_112497
atggcgcctaccaggcaccctctggacccagataagtccaacagggccctgggatttcccgccttgatcacaggactctggcagtcgttcggcgtccctgtcacacctagcaaggtgattcggccgcccatcacccgagcttttattgagaagtactgcacgcagagacaggtccagggtgatgcaccacaggccgcggacgtgccgccacctcatcaggctggtccagccggatcatttaacacggagcagtatttgcggcatttggttcgccagcaggcggccaaccaccgggcacat

SEQ ID NO: 20813 - DNA, 231 bp, Glycine max
  Peptide Sequence Number=SeqID_112498
atggcattgcgttccgctatcaccctaataatcatcttcatactttcttccttccatgtcgttggaattcaaatcatctccaaatcgaagctggagaagtgcgagaagaactccaattccgaggacaatctcaattgtactaccaaaattgtactcaacatggctgttcccagtggctcggtaaatagatcatattcacattacgctcctcattgtgttccagtgtgttga

SEQ ID NO: 20814 - DNA, 351 bp, Glycine max
  Peptide Sequence Number=SeqID_112499
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcggtgtggtggttacgcgcagcgtga

SEQ ID NO: 20815 - DNA, 468 bp, Glycine max
  Peptide Sequence Number=SeqID_112500
tcgggaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccggagttagtctttgaagtcatgcgccggttaagggctaaactgaaaggacaaggttttggtgactgcgctcctccaagccagttacctcg

SEQ ID NO: 20816 - DNA, 201 bp, Glycine max
  Peptide Sequence Number=SeqID_112501
atggccacaatgatggaggccatgatgagcatgaagaagataatggaggtcaatgcggttgcagttgctgctaccagtgccgttgctgaggtggacccgactcccccatctggcctcaaccaaataaatcacgccgtcttggatatggtagggaagagaggcaaagaattgggaagtacgggtggcccccattttgcgtaa

SEQ ID NO: 20817 - DNA, 183 bp, Glycine max
  Peptide Sequence Number=SeqID_112502
atggaaaagggaatgaaggattcatggggatttccagtagagtattggaatgatcttaagagtacccttaggaagaggcatcattcccgctactatgaaaggagcttatggacaagctccaaagacttagcaaggggaatgagtgttgaagaatatagaccaacaaggaactactctttttaa

SEQ ID NO: 20818 - DNA, 362 bp, Glycine max
  Peptide Sequence Number=SeqID_112503
ggccctgggatttcccgccttgatcacaggactttgccagtcattcggcgtccccgtcacacctagcaaggtgattcggccgcccatcacccgaacttttattgagaagtattgcacgcagagacaggtccagggtgatgcaccacaggccgcggacgcgccgccacctcatcaggctggtccagtcggattgtttgatacagagcagtatttgcggcatttggttcgccaacaggcggccaaccaccgggcacatgcaggagaggcaccagtaggggcaccagcagaggctcccgacgaggtagatgaggcccgcgaggacgaagagatgactgatttacttgatttcttaggagggagcg

SEQ ID NO: 20819 - DNA, 330 bp, Glycine max
  Peptide Sequence Number=SeqID_112504
atgaccttgctgggggaacgggcacccggtaggactgacagaggcccaatgttgccaaatagcaacgtcatccacgtaagggtggtcatgttggtgcgcatggtccgcactcgtctttttgcagcggcacgggggaaatcttgcctcggtatgcatagcagatgcgtgatagcctccctctctggatgtgctcgcacagttggtcgccgtccaatatcagggggcacactgaaaatgaggacgcgtagccctctaaaggtgaggacgtgcagccctctacaggcgaggatgtgcagtcctctgatggcgaggacatatggtcctctaaag

SEQ ID NO: 20820 - DNA, 402 bp, Glycine max
  Peptide Sequence Number=SeqID_112505
atggcttcaccaacaagatttctttctagcaccatgaccagaaaattattcttaaacctctatccctcagagaaattgtatgaccaagtgaaggtgcaaattgcaaagaagaatgaaagctatgccaagcaagccaacaagaaaaggaaggaagtggtacttgaacccggtgatgatcctggacatttgagggcaaatgttttccaagaaggagggattgatgagaatcctgaaactggccaaatacaggctaaaggcccaagtggaaaaggacgaagggctcaagtggagaaggacaaagctcccgagtggagaaagatgaaggcccaagtggaaaaggatgaagggcaagtggcagagacactatcaagactattaattgttactgaaggcccaaattaa

SEQ ID NO: 20821 - DNA, 510 bp, Glycine max
  Peptide Sequence Number=SeqID_112506
atgactagaggcaatccatctgacttacaaccctttgatcctgagatagataagacatttcataaattagttaggcatcatcttgtaccttttgagcatcctgagcattctgttattggtgattttgagcatcctgatttagagcattataattttgaacattctgagaacatgacacaacctccaccccgtgagaggactctaagggaaatggctgcacctgatttcacttacgaaagcttgtgcatccaataccctgatgaggatgtcccatatgttcttaaaattggactgatccatttgcttccaaagtttcatggccttgtaggtgaagacccgcacaaacatctgaaagaattccatattgtctgctccaccatgaaacccccagatgtccaggaggatcacatatttttgaaggctttttctcattctttagagggagtgacaaaggactggctatattaccttgctccaaggtccatcacgagctgggatgacctaaggaga

SEQ ID NO: 20822 - DNA, 117 bp, Glycine max
  Peptide Sequence Number=SeqID_112507
atggagtacttacttgctggcgacgttctccgcttgtccagcgccgggaagagacgacgatcagtcagtcatgaccctatcctccatttgcgtccgttcctaagtacctacaagtag

SEQ ID NO: 20823 - DNA, 561 bp, Glycine max
  Peptide Sequence Number=SeqID_112508
atggggttgaaccaagcacatgcttttaaggaaagtttcatcaagtcaaggaaagaatgcgctttacggtgccctcaccgaatgcatgctagagctagagtaatgagtgaagaaaaagacaaggtgcaagagcagataaaggccgacatagaggccctgaaagagcaaatggccacaatgatggaggccatgatgagcatgaagaagataatggaggtcaatgcggctacagttgccgctaccagtgtcgttgctgaggtggacccgactcccccatctggcctcaaccaaataaatcatctcatctcggatatggtaggacagagaggcaaagaattgggaagtacgggcggcccccattttttgcaagttcaaaacaagcatgccttcccgccatatggcttgcctcccaattatacaccacccaatgtggcgcacactcctaatgagaatgtcaataactccactcccatactcattgagagccaacaacctcaatctgatcatgcacctatccctcaacccatggggggacacatgaaataccccaccacaatctag

SEQ ID NO: 20824 - DNA, 539 bp, Glycine max
  Peptide Sequence Number=SeqID_112509
tcgtcgggcccgatgatacgcggagataccttatggttatccgcacccttttgtcatccagagtcgtcgggcccgatggacaagcagagaccaaatttggtcattctgcacccttgtatcatccagaggcgtcgggcccgatgatacgcggagataccttacggttatccgcacccttttgtcatccagaggcgtcgggcccgatgacaagcagagaccaagtttggtcattctgcacccttgtatcatccagaggcggcgggcccgatgatacgcggaaatacccgagtgaggctgacacagtcttctgcaccttttgttcctccgggaacaacaagtcatttacatgcggaaatttcatggtcacccgcgactctcgtgcttggcacccatcattaggcaattgttcaaattttgggaacgacaagtcatggtcacccgcgactctcgtgtcataccctaatttcgtctggggacctttgcttgatgacatgcgaccattctttggtccttgtgaggtgcttggcacccatcattag

SEQ ID NO: 20825 - DNA, 2001 bp, Glycine max
  Peptide Sequence Number=SeqID_112510
atgggcgtaaagcagcaatattttgggcggctgcgacatcgttcccctccaaagcgtcgtcaccgcggcggaattccgctaccatgctcgacgcaacaaacattatcgaattatgttgccgataaattaacatattctgacgatacggcgcttatgattgtcttttccgcattacaaatccgtcgcggcaccaatgtgctgctggataacgcaacggccaccattaacccggggcaaaaagtcggcctggtgggtaaaaacggctgcggtaaatccacgctgctgtcactgctgaagggtgaaatcagcagcgatgccggcaacgtcacctttcccggcaactgggcgctggcgtgggtgaatcaggaaaccccggcgctgagtaaagccgcgctggaatatgttatcgacggcgaccgcgaatatcgtcagctcgaatccgaattagcggcagccaatgcgcgcgacgatggcaacgccattgcgctgctgcacggcaagctggacgctatccaggcgtggagcatacacgcacgcgccgccagtctgctgcacggattgggcttcagccaggaacaattaatgcggccggtgagcgacttctccggcggctggcgcatgcgtctcaatcttgctcaggcgctggtatgccgttccgacctgctgctgctcgatgaaccgaccaaccacctcgatctcgacgcggtgatctggctggagcgctggctgaagagctataccggcacgctgatcctgatctcgcacgaccgcgacttcctcgacccggtggtggacaaaatcatccatatcgaacagcagacgatgttcgaatacaccggcaactacagctcgttcgagcgtcagcgcgtagccaaactggcgcagcagcaggcgctgtaccagagccagcaggaaaaagtcactcacctgcaaaagtacatcgatcgcttccgcgcgcaggccaccaaagccaaacaggcgcagagccgcatcaagatgctggagcgcatggagctgattgccccggcgcacgtcgataacccgttcagcttcagcttccgcgcgccagaaagcctgcctaacccgatcctgaaaatggagcaggtttcggcgggttacggtgagcgggtgattctggatgccatcaaactcaacctggtgccgggttcgcgcatcggcctgctggggcgcaacggtgccggtaaatccacgctgatcaaactgctggcgggggagctggagccgctggcgggcaaagtgggtctggcgaaagggatcaagctgggttacttcgcgcagcatcagcttgagtatctgcgcgccgatgagtcgccgctgcagcatctggcgcgcatcgccccgaaaacgctggagcagcagctgcgtgactacctgggcggctttggtttccagggcgataaagtcagcgaagccaccgagcgtttctccggcggcgagaaagcgcggctggtgctggcgctgatcgtctggcagcggccgaatctgctgctgctcgacgaaccgaccaaccacctcgatttggatatgcgccaggcgctgaccgaagcgctgatcgactttgaaggcgcactggtggtggtgtcgcacgatcgtcatcttctgcgttcgaccaccgacgatctttacctggtgcacgaccgcaaagtggatgtgttcgagggcgatctggatgattatcagcagtggctgagcgacctgcagaagcaggaaacgcagcaggatgccgcgccaaagcaggacaacgccaacagcgcgcagtcccgcaaagatcagaagcgccgcgacgccgagctgcgcgcgcagacgcagccgctgcgcaaagagatcgaaaagctggagaagcagatggccaaatggcagacgcagctcagcgaagccgaagcacagctggccgacagcgccatttacgagcagagccgtaaggccgatttaaccgccgccctgcagcgccaggcggagagcaaatcggcgctggaagag

SEQ ID NO: 20826 - DNA, 303 bp, Glycine max
  Peptide Sequence Number=SeqID_112511
atgcatattgttgtggtaaaacaggggcaggatcatcttgggctaccttctggggtagagacaaaacatgaacggcagaaaccaatcaaggtacttaaggacggatgcaagtgggggatggggtcacgaccgaccgattgttgccccttctctgcacgaaacaagcagagaatgtcgctgcaaggcagccccgtatcctttgtattttgcagctttcttttactatttgtttgttttaaaaaagttagctcgcctgggcgagctgggcgagcctgggcgagcgacccctgcaccaaattataa

SEQ ID NO: 20827 - DNA, 731 bp, Glycine max
  Peptide Sequence Number=SeqID_112512
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatggagaagattttggacgtctctgcaaacagtcgtttcatactgataaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 20828 - DNA, 437 bp, Glycine max
  Peptide Sequence Number=SeqID_112513
atggggcaatgcgtcgtgttgtccggaacgttcggctgctttcccaatgttgctatcgggcgagtggatgtccaagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 20829 - DNA, 264 bp, Glycine max
  Peptide Sequence Number=SeqID_112514
atggaatcctctgaagattctgaaaatgaagagataaatctctgccttatggctaaaagttacgaaagtgatgaagaggtatctttgagaaagaagtggtacatagatagcggatgctcaaaacatatgactggagatgcatcaaagtttacacatatctctccaaagaaaagcgggcatgccttaagcacaacctgcttagcgttagtcaattatgcgacaaaggctatcttgtatcatttgattctcagaaatgtcttatag

SEQ ID NO: 20830 - DNA, 339 bp, Glycine max
  Peptide Sequence Number=SeqID_112515
gctttacttggcaaatgggggtgggagctggccaataaccacaaccagccctgggctagaattttaatctccaaatatggtgggtggaaagagctgatcactggtggaaagagtaaattccactctcaatggtggcaagacttaaagggtatcttccagcagcagcacaccaactgttttgttgataacctcaagtggagggaggctcatgataatgctaatgaggacagggttcttaagatcatgtggagtctgaaaattcccccaagagctagtgctttttcatggagattattcaagaacaggctccctactagggataatctcagaaggaggcaa

SEQ ID NO: 20831 - DNA, 440 bp, Glycine max
  Peptide Sequence Number=SeqID_112516
gtgaggaagatgtcctggtaagttgtcctccctccatgccatacgtggaagccacggaggagtcactagaaacggctttccaatcatttgaggtgatgctggggcatggctacgagcccggaatgggtttgggcaagaacaacggcggcaggaccagcctggtaagcaacagaggaaaccgcgtgaagtttgggttaggctataaacctacgcaggctgacattaggaaaaatatctcagaaaggaagaacaaaggccagggcccgtggtcgggacagcgagccaaagaggccccgccatgccacatcaataggagcttcgtaagtgcgggtttaagacgcgaaggtcaagtcaccgtgatatgcgatgatgactccccgaggagatcggatttggataaagaggatgaggatgtagggcttcccccggagctggagagg

SEQ ID NO: 20832 - DNA, 183 bp, Glycine max
  Peptide Sequence Number=SeqID_112517
atgctcaatggaatgccccggggctcctccatgataagcacacgttgcgttcgagtcgtatcctcagaaaaatggaggttgaggaaccttgttggggttatggctaccattgaattattgagtggatatgggatcaagtggtctttcgtcattggaagtgcggtagacagactttgtggttga

SEQ ID NO: 20833 - DNA, 125 bp, Glycine max
  Peptide Sequence Number=SeqID_112518
gtgagaacttttgatcggcccctatgttcacttgaggctcatgcacggtgcccctcattgccccagtgtaaggctttgaggtttctgcatggtgcctttcgttgccccagtgtagggcttaacag

SEQ ID NO: 20834 - DNA, 132 bp, Glycine max
  Peptide Sequence Number=SeqID_112519
atggcgaatccagtgtcgattgcgccctataggatgtctccagtagaactagcagaggtgaaggcacaagtgcaggacctcttagtaaacatttgttcgcccaagcgtatcacgtgggagcgcggtctactg

SEQ ID NO: 20835 - DNA, 429 bp, Glycine max
  Peptide Sequence Number=SeqID_112520
atgaaaagatggtgggctatgcaccctcaaagctttgcggatttggtcttcgccagtgaaaggattgatgtgggtccgaaaagaggcaaatttgatcatcctactaggacgactgagaaaactggggcaaatgaagagggtgagaaagagggagaaacccatgctgtgactgccattcctatacgaccaagtttcccaccaacccaacaatgtcattactcagccaataacaaacctcctccttacccaccacccagttatccacaaagggccctggggcattccattgagcactgtatgaccctcaagcgtaaggattttcaagtgcaagccattggtcagtttgctcaagcgacctgtgctcctgagtttggacttccaagaccgttcaatcagagattactcgtcttgcacgttggtggggttgcc

SEQ ID NO: 20836 - DNA, 316 bp, Glycine max
  Peptide Sequence Number=SeqID_112521
tgcgtcgggtgatgctgcccaacttactgatttagtgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 20837 - DNA, 237 bp, Glycine max
  Peptide Sequence Number=SeqID_112522
atggggctccgactcagatttgatggtggaggatgcacgaacagcgctaggcaatcaattcgtggggctccggactcgatggcaatcaattcgtggggctccggactcgatggtggaggatgcatgaatatcaatcaattcatggggctccgactaagatttgatggtggaggatgcacgaacaatgctagggaatcaattcgtggggctccagactcgatggtggaggatgcatga

SEQ ID NO: 20838 - DNA, 609 bp, Glycine max
  Peptide Sequence Number=SeqID_112523
gaacgtcctgcgctaaagttatccttccatggaaagaaggttgagaaatttggcaggcctgctccagagattgaaggcttagtggctgccacaagactaagtcctttgatcgcatgttcgttgaacattggtgatcagggacttatatcggcatttgcggagaggtggcataaggaaactagtagtttccatcttcttgtaggagaggccttccacaactttgaggctcttcatgtggatgaagttgtcttgttgttagttgaattgcttgaagttagttcagaagaagcaaaagctaagacaatacaatgccatggggcatatgttagactatcctggttgcgagacatatatcgaagcaaatgtgacgcagcacaatggactgtagtagctcgagcatatttgttgcatctggtaggttgcacactctttgctaacaagagtgacacacacgttcatgtggtgttcttggacatatttcatgacctgacggcggcgagtggaagctacacatggggagatgctgcactggtccatatgtataagaatttgaatgatgcgtcaaagagcaccgccagacaacttgcaggatatatcaaacttttatag

SEQ ID NO: 20839 - DNA, 464 bp, Glycine max
  Peptide Sequence Number=SeqID_112524
gtgccacagcaggaagggggttggcggagccacgacagcgagattggcctccgcggctatatgcgaagatccttcagcaggagggtgtctggtcccttccgccgtagtctcgtgtttgccatgaagagtaccatccaaatggacctacggatgagatctcaaaccgctcttcctggactaactgccagaaaactacctgagaatgaacctggtcatgtccttccctgcattagtttagagcctcagaaggtctcccctaggtcatctctactctggctcaacacttccctgacttacgcgaaagaatcatcctcagaaaacaagcatcccggatggaaacttggcaaaggtttccaagccgtagtccaagaggcaaaggttgtttgccttgctttcaaactgacttgccttatcctattgggtgaaagtcctattactgctatacccgtctacccggtcttact

SEQ ID NO: 20840 - DNA, 300 bp, Glycine max
  Peptide Sequence Number=SeqID_112525
atgggtgaagtagacgaggtgcaagagcggataaaggatgacatggaggccatgaaagagcaaatggccacaatgatagaggtcatgatgagcatgaagaagataatggaggtcaatgcggctgtagttgccactactagcgccattgctaaaaacaagcatgccttcctaccatatggcttgcctcccaactacacaccacccaatatagtgtacactcccgataagaatgtcaataactccactcccatactcgttgagagccaacaaccccaatctaatcatgcacatgtctcttaa

SEQ ID NO: 20841 - DNA, 711 bp, Glycine max
  Peptide Sequence Number=SeqID_112526
atgtggggagcgccaaccgaagaaagtctctcgcctttccttgtgagggatctaggcgcgcaaggtctcaaggttatacaaagaatccacaaggcgtggaggagtctgttgaggaaagacaaggagcttaggggcatccgaaacggcgtcattggaggttatcatggatggctaagaattcacacgcggggcttagattggctctccaaattgaaagttattgatgaggagaacttcgaggccccagaggaagatgaagaagtccgagctctaaagttagagctagggaaggcgagactcgccaaggagaagttcaaatcagctgctacacacattcggaaggagtgcactgagttacaagaggaaaacgcggccactgcaagagctcttgaacaagaaaccaaaagggcccgcaaggaggaacatggccgagagaaattccgaggagcattgtggggtagcaacaatgagctcaagctccgaagggaggagagagatcggtcacgggcgcatggcatgatcttaaaagaagagttagttgcttgcgcgaggtccaaaaggagtttggctcaacacttggaagccatggagcaaagcatgctagctatcatagggcaatacaaggaagaattgaaccagtccatggcccatgaacacaagttagtcgaggatttgcacaagtgtatgccgaaaagaagcagagggaggtga

SEQ ID NO: 20842 - DNA, 673 bp, Glycine max
  Peptide Sequence Number=SeqID_112527
gtctccatcgtctccataagctaggccaccctatgagaggtgcaccatcagaggagatcaaatcgcctttcatcgtgcgaggtttcaatgaaactaatgcgaggatacttcagagaatccgtaaagcgtggaatatagtggaagggaaagataaggagattaggggaagtagcaatggcatcatcgacggctatcacaagtggttgaagtctagaacgcaagggataacttggctcccgaagctaaaaggcctaagtgggaaagaagcaaaagtccttgaggaaagcgaagaagtgcaagctttgaaagtggagctcaaaaaaatgagagtggtcaaggagaagataaagacaatagtcactagggtcaggaaaaagaacaagttccgaggggctctatggggaagcaccaatgagctcaagcttagaagggttgaaagggacgggtcaagggtggaaagcatggtgttagaggataagttgaaggcttgtcaaaggttgaagaaaagtttgacggaacagctaagcagaatggaagagaatatgttgaaaattattgatcaatataaggagaaggatgaacttgcgaaggtatcggctctacaagttgaaagggaagcaagagagagggtgatagaatccttgcatagggaagctatgaaatggatggatag

SEQ ID NO: 20843 - DNA, 504 bp, Glycine max
  Peptide Sequence Number=SeqID_112528
agtgcaacatacgtgcatgtggtccaccttgacgctttccgggacctcgctcatagtggtggttacgcttggggggttgccgcgctggttcatatgtacgaccagttagatgaggcttgtaggaccaccacccgacagcttgcggggtacttgacgctatttcagtgctggatctatgagcacttccctagtgtgcatcagtgcgtgactgacgacacataccaggagacgtccccacgtgcttcccggtggttgacgtcgaaggcgcacatgaagggcatcacaggagcaccctacagggcacgttgtgatggtttgaccgtcacagatgtgtcctggttgccgtacacggagcatcggggtgttaggcgtttcaggagatttcatcgttccagggtatctgcggattacattggagtgggttttttccgcatatctcaccctttcatgacaccgacccaggcagctgaccagcagagggatgcacccagctgcagaccctga

SEQ ID NO: 20844 - DNA, 396 bp, Glycine max
  Peptide Sequence Number=SeqID_112529
atgtcgatccccccctgtggaagtatcagttggtctgtatcattccgacgtaagaattgcacccacaaagacacccagtggacctggagaagtccaacagggccctggggtttccagctcgggttacgggcctctgtcggtcctacagggtgcccatccccccagcaagggatcacgccgcaagatacccagtggacccgaagaagtccaacaggttctacggagtgcccgtcgcccctagcaaggtcatgccatcatggcatagggatcgcgcccgcaagacacccagtggacccgaagaagtcccacagggtcctagggtttccagctctgattacgggcctctgtcagttctacggagtgcccgtcgcccccagcaaggtcatgccatcatga

SEQ ID NO: 20845 - DNA, 355 bp, Glycine max
  Peptide Sequence Number=SeqID_112530
atggccgaagaatttgtgaaaagctttgttcatcaagacggcgtcattgtcataacccttgatcaccccaaagagtgtttttcgaagcttgattgcttctggaggaagcaacccagctcgcttgggcgagctggatggcaacctcctccccatttttcctataaaaaggcaaaagggggttgttctaagggtcccggatccccctggctatgcatttcagctgttttgggtgaaaaaaattgtttccgtgaagaaaattcaagccgaggtgcttctgtaatgcttccgagatgtttccataagcaaatccgtgaaggttttcctccgttcttcaccgttcttcgttctacaacgg

SEQ ID NO: 20846 - DNA, 333 bp, Glycine max
  Peptide Sequence Number=SeqID_112531
ttacacttaaccaatgctttttcgacgctctcacttagcgaacgctttgctaagtgggagagtcgtttggttttccaaggccagctgcttagtggggctcgcgctaagcaggagagtcgtttgggattttttttaaaacacactgtcgcaacctacccttcggcgggagggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggctcgggagttgtatttacgcgcggggaaggtattag

SEQ ID NO: 20847 - DNA, 471 bp, Glycine max
  Peptide Sequence Number=SeqID_112532
ggaggtggttgccgcctaactcgccccagcgagctgggttgcttccatccgaaggcaccgccttctgttggaacaccttggcaggtccaagttgcacaacaatgcttcctttcgactcccgacatgtcgcggaacttcatggattgcctaacgatgggtgttaagtacctcgaagcggtcaagcgaagcggaacatcattcgggcgggtcaatatccttgctagcggaaccttcgccattgcactcgatcgtccctgcccagcagagaagaatttcgtgcgtcgttgggctcgaatgtttccggacgatgagagtaaccccgcgtgtcacctgacttcacgggtcaggacgacaaaaggtgcaggagacgatgatagtctctacgcgtcaacgggctcgtttgcccctggtgcaagagacgatgctagtctctacgcgtcaacggggtcgtttgcccctggtagacgaaag

SEQ ID NO: 20848 - DNA, 293 bp, Glycine max
  Peptide Sequence Number=SeqID_112533
atgcgtagtgatttcttagtgcaattcttcattctcaacctttttcggagccccatgaattatgttttcgttcatgtgtcctccatcttcgagtttggagccatgcgtagtgattgcttagtgcaattctccattctcaatctttttcggagccccatgaattgcgttttcgttcatgcgtcctccacccaagaaaaagaagaaggagtagagacgagattcgtcatcacggaaagggcaggacggacgaaatcagtgtcttatctttgctttcctcttatctccgataaaag

SEQ ID NO: 20849 - DNA, 314 bp, Glycine max
  Peptide Sequence Number=SeqID_112534
caatagcttttcctgatgatgaattagaaagattagcaattcctccaattggggaaacagaggggtcaactatttctgcagctggtgaatcaggaggggcagctgcttcatctgatgatgcatcaaaaatgacaatcagaggaggagatgggggaactgcttcaagctcaggcgaaaaaggtggattcaccactggagattgtgggttagctggctctgaattcacctgcacagttactgacagaggagttggagtggatgacgaagggatgtcctctgttctagctctttttcttgattccatctgtaactaa

SEQ ID NO: 20850 - DNA, 93 bp, Glycine max
  Peptide Sequence Number=SeqID_112535
atgtgggatgttgaagctggagatgattttggaaagtcacttgatgattatgaaccagagttaagggtgtctattctttttcactatccctga

SEQ ID NO: 20851 - DNA, 474 bp, Glycine max
  Peptide Sequence Number=SeqID_112536
atggatggtggtgtaaaaaagggaaagagagggatggggtttctcttgcttttggcatatcgggccccgtcggtaggcccgcacgacgggctattagctcagtgggctctcagccacatggatagtttaatgtgctcatcggcgcctgaccctgagatgtggatcatccaaggcacattagcatggcgtacttctcctgtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctgggggaccaggagattggatctagccataagaagaatagaatgcttggctga

SEQ ID NO: 20852 - DNA, 189 bp, Glycine max
  Peptide Sequence Number=SeqID_112537
atgtgctcctcaatcataaggataactacttttaagtttgaaaacgtgactgcaacaccatccacagtggattgtaggcaaaagggagcagttacaccgtcaaggaccaaggtcaatgtggatgtttttgggcgctttccgctgttgcagcaactgaaggaattcatgcgctgtgagctggaaaattga

SEQ ID NO: 20853 - DNA, 636 bp, Glycine max
  Peptide Sequence Number=SeqID_112538
atgggatcaagtcaaaagccttcgcttaaaaagaggttctatcaagtcaaaatcaagagcttagaggtcactagtttacgagagttggggcaattaatgggtcaacttcaacggcaagccttccgcaaagcctatggtaagatttgggacctagctagggtagaagtctccatggaaccgattgcatccctttcccagtattatgaccagcccctaaggtgcttcatgcgaaggatcaggattctatcttcatgcgaaggatttccaaatgttcccttaatgggagcaaggggttgtataaattataatcctgtcctcgccataagacagcttggctaccccatgagaggagcgccattagacgaaagcatcacgcctttcattacacggggtttcagtgaccccaatgcaaaggacagagagcttaggggaagcagtaatgggatcatcggtggctatcataagtggctgagagtccggacacaaggattggattggctcccaaatctaaagactgtgagagatgatgaggttaaagcttcggaagaaagtgatgaggtacaagccctaaaggcagagcttgaaagagcctgggtagtcaaagagaagttcaagtccatagccatcaaagtctga

SEQ ID NO: 20854 - DNA, 257 bp, Glycine max
  Peptide Sequence Number=SeqID_112539
atgtcctgacatcgtatccgacatcgtggatcctgcaacttcaatgcttttagcaactccagtattttcgggcagatgtcctggacattgtatccgacatcgtggatcctgcagcttcaatgcttttagcaattccaacgttaaagaagcgctactagaaggcaacctagaattggctacgaagaagctctctgcgaagcagtccaggaaaggcaccattgaagagggttctagtgtggccccacaagctgacacag

SEQ ID NO: 20855 - DNA, 574 bp, Glycine max
  Peptide Sequence Number=SeqID_112540
atgagaggagtgccatcagacgaaagcatcacgcctttcatcgcatggggtttcagtgaccacaacgcgagggacagagagcttaggggaagcagtaataggatcatcggcggctatcataagtggctgagagtccggacacaaggattggattggctcccaaatctaaagactgtgagagacaatgaggttaaagcctcgaagaaactgatgagggcagcaatagtgagctcaagctccgaaaaggtgaaaggaatcatcacgggtcaaaggcatgatctggaaggacgagctaaagggaatatgtgggccatcatcgatgagtgcaaagagaagctaaatctagcggcgactcacgagcaaaggctagaggatgagtacgccaagatatcagcagaaagggaagcaagggaaagggtaattgattcattgcaccaagaggcaacaatgaggatggatcaatttgctcttactttgaacaggagtcaagaacttccccgattgctagccaaggccaaagcaatggcggacacctactccgcccccaaggagatccacggacttctcagctatt

SEQ ID NO: 20856 - DNA, 435 bp, Glycine max
  Peptide Sequence Number=SeqID_112541
atggtcaaaagggagatgattaccgtgatggtagacaccttaccagtgttttactatgagaagttggtaggctatatgccctccagcttcgcggacttggtatttgccggggagagaatcgaagtaggtttgaagagagggatgttcgattacgtctcctccacaagtaccaatgctagaaggatcagagcaactagggcaaaatggaaggaaggagatacccatgtcgtcacttcggcgcccgcatgggtcaacccaccacagacctctcatggtacccatcagtacgcgcaacatcacttgagcttcttagctcgtgccgggaactcttccaatttagcacccatacagcctagagcgcccgcccccatccagagggaggccccccaagcttcggctccaaccacgactcgcccggccggcaatgcccactaa

SEQ ID NO: 20857 - DNA, 610 bp, Glycine max
  Peptide Sequence Number=SeqID_112542
gttccgccgaaataaccaccagctcgaatatgacgatgaggtggcctatcaggccgaagcgaagctctatgatctggctcgcggccacgaccagcggccatggtgcctgacggtcagtttcacccatccgcacgatccctatgtggcgcgcaagcgcttcttcgatctctatgcggacattcccgaactcgaccccaaaatcggaccgcttgatgaaagcggaatcgacccgcataccgagcggctgctgcgggcctgcaaggcggaggactacgacctcacccgcgaacaggttcgcgcggcgcggcaggcatatttcgccaatatttcctatgtggacgagaagatcggcgcgctgctcgatgtgatcgagcgctgcggcatggcggacgacacgattgtcgtcttcacttccgatcatggcgacatgctgggcgaacgcggcctgtggttcaagatgagcttctttgaaggttccgcccgcgttcctttgatgattgccgcgccgcaattgcaggctggccgcgtggacgcgccggtctccacgctcgacgtcctgccgacactggcagatcttgccggcatagacctcaagggcatcatgccatga

SEQ ID NO: 20858 - DNA, 291 bp, Glycine max
  Peptide Sequence Number=SeqID_112543
atgaataaacgctttattgcgatttcttcttacgccgtgtgcccccgccctttccatcttggatttgcccaaacgactcctagagtgaacgacttcctcttgctttgtcccggcctactcattgtgatgcaaagaaagatcgtcacctccttgatatccagaaagaaccggcgtgaaaaagctccatttcacaggttagcggcggaaagggcaatgccggcttcatcgacgaggaatgcttccaaccagcctaagcgtgatagctgcacccagagcaagcaacctggatag

SEQ ID NO: 20859 - DNA, 525 bp, Glycine max
  Peptide Sequence Number=SeqID_112544
atgaccaaacatcaaaggtcaacaaagcgtgatccgtcttactgggagtatgtagatgctttatattttgtgcaaaatagtaattcttctatcaaacatagtgcatcatcatctgaccagacaattccaagaaggattatgccgatgttggatcaatttcatcagttcattcacgatttcattgaaaacattgtcaatgtcaaagatgacgataactgtggatatcatgcaattgttgtcttattagacaaatttgaggaattaaagatgtccctacttgttgatggattatccatggttactatggataagtggatggatataaccgacatgggatatgtcattgcattaagatataatgttatccttgtatcgttgtctctgcaacaaagcatgacgttttttcctctcagaagtcaaccaccaacagattcttctgtgcatcgtgtaatatgtattggtcacgtctatgataatctttttgttcagtatatttatgacaccgttgtcccttaccgcctctag

SEQ ID NO: 20860 - DNA, 222 bp, Glycine max
  Peptide Sequence Number=SeqID_112545
cgagcattcgctaagcgtgaaactcagtggttgagcgcgaggaagaatccaaaagaaggtaagctatcatgttcactgagcgcaccgctccagatcatcaagtgcaccgcttcagctcatccgctaagcgagagaagcgcgcaaagccaaaatccacttatgtgcgctaagcgattcagatttgcgctaagcacgcgagcacggaccaacccacctatttaa

SEQ ID NO: 20861 - DNA, 1077 bp, Glycine max
  Peptide Sequence Number=SeqID_112546
atggcctccattgcccagtattatgatcagccgttgaggtgcttcacatttggggacttccagctatcacctatggtagaagaatttgaagagatcctaggatgccctctagggggaaggaaaccatacctcttctcagggttctatccctcattagctagaatttccaagatagtccaaatctcggcgcaggaattagaccacaggaagcaagtcgaaaattgggtggttggaatactgagaaaatatttggaggcaaaagcaagaatctcggcaggtaaaggcgagtgggccccattcatagatattctcgcattgttgatcttcggaggagtcctctttccgaatgtggatgggttggtggacctagcagcgatcgacgcttttcttgcctatcataaccacaaggaaagctcggttgtcgctatgctagccgacctatatgacaccttcgaccgaagatgtgaaaagagcaatacaaggattgcttgttgtactctagctctttatgtatggttagtttcgcacctttttcgccaagaggtgaggcatgcttgcccgctagaaagccactgttcatgcacagagaaaggaggggcaaattgggaccgactcttatcaagcaaagaaggagcatctatcaactggttccctcaatggaaggaaggaagaaccggaattcttatttcatgcggaggatttccaaatgttcccttgatggggacgaggggttgcatcagctacaatcccgttcttgctataagacaaattggctaccctatgagaggggcgccactagaggatgaactcacgcctatcgtttcacgaggtttcaataagacaaacgtggagacacttcagaaggtccacaaggcatgggaggtgttgcgaaagaaggacaaagaactcaggggcagtaataatgggcccatcggtggctaccgtaagtggttgaaagcccacgtgcaaggtttgatttggcttccgagtttgagaactactaaaagagaggaagttgaggcaccggagggagacgaagaggtgcaggcccttagggtggaactcgagcaagcctaa

SEQ ID NO: 20862 - DNA, 216 bp, Glycine max
  Peptide Sequence Number=SeqID_112547
atggaagtttggtaccttttggaggctcccaacacacttccaatttttgttacaaaatttgctagtaatgaagtgcttcatagtccaatagttcttaaggtggttggccccttgcttcttgactcaaattcttcaagggatgacaacaatcctcatttccaatttcctatatggtcactcacaaacaaggaaacaaaggatcaaaacatgaaatga

SEQ ID NO: 20863 - DNA, 612 bp, Glycine max
  Peptide Sequence Number=SeqID_112548
atggcattcaaaattgtcgaaactgatgcatcagacatcggttacggtggcatcctcaaacaacaagtacatggtcaagaacatgtcatcgcatatacttcaaacactggaatcctgcacattaaaaatatatcaagggctcttccaactctctacctgactacctcacccgtgaatttttacagaaaattcccgatgcctcctaaggtgtctagttcctccggcagaggaggaagatccagtacaaaaggaaaagaggttctactggctctaccagagccaataaccaaaaaggcaactacaacatcttctgggtcacctacccagactgggtcatcaacccagaaaggaaagcttgaagggtcattgacccagacaactaccgtcaaacctgagtcatcaactcaggaatccccaaaaccaacaacaaccaaacagaccgtggctgactatgcctggtcaatacaaactctcttggccttagaggatataggcctcaccaaaataccaaaattagccaaaaagacctgggcagaaatggcctcagaatcagacgaagattctgaaacagatctacaaaaacaaatccaaaaggccaaacagaccaaaact

SEQ ID NO: 20864 - DNA, 207 bp, Glycine max
  Peptide Sequence Number=SeqID_112549
atggatctctctaagatatgtttctacagaatgaccgttgggattttgaaaacaataacgtctggtctcccgataagcaagaatggcgtgctaagcgcaattccaaccgaggggaattacgcagagcggcccaaagttttgctaagcccaattccaactgaggggaactgtgttgagcggcccaaaggtgcgctaagcaagccctag

SEQ ID NO: 20865 - DNA, 459 bp, Glycine max
  Peptide Sequence Number=SeqID_112550
cctcaagaggctaagattaacctcccatacttctatgggaaggacaatgtagaggctaacttagattgggaaataagggtagagcaacaaattaaaaggaagtctacttcaaaatcttatggctctcactcttatccaaagaaagaccaaggtcaagtcatcttaggggtgactccttctaagtccaacgatgataaggggaagacaatagaaaagcaaccccttaaagctagtatgcaagagaagactagctccatgaagtgctttaaatgtcttggaagaggacacattacttctcaatgccccaccaagaaaaccatgattatgaggggccaagacatttatgtggaagcaatgtcttccaagattattttgatgatgccaaagaatcaagagttaagaagttccaaagaattaggagtcaaaaagcttcaagaatcaagattcaagaataatcaa

SEQ ID NO: 20866 - DNA, 428 bp, Glycine max
  Peptide Sequence Number=SeqID_112551
atggacgcgtggggtgctaataccttccccgtgcgtaaatacaactcccgaacctttcacttaaaagttcgtagatcgcgtcttttccggtttttccgacgttttcctcaaataaacgttggtggcgactccgcgcgtattcctttcgtggaacacacatcccgcgagtctcgcgtcgccctcccgccgaagggtaggttgcgacagttggcgactccactggggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 20867 - DNA, 567 bp, Glycine max
  Peptide Sequence Number=SeqID_112552
atgagtcatcattcatctagtgttaatggcaagggtactagtcataaggaccctctatctagaatcttagatgagttgagttccctcaagttatggaaagaaaaactagaaagaaaagaaaaaggaaaagagagggtaaaaataaatcaagatgagagggaacaaataagggaagaagaaagaaggaaaatactaaaagaattaagaaaagaaaaacatgcctcatatagtagtcataactcttgcaagagcctaagtgaagaacttcgtgactattataaaggaaggcataggtcacatcttagacctcactcccatatgagagaaaaggaaagaaaacctcaagaggctaacattaacctcccatacttccatgggaaggacaatgtagaggctaacttagattgggaaataagggtagagcaacaacttaaaaggaagtctacttcaaaatcttatggctctcactcttatccaaagcaagaccaaggtcaaggcatcttaggggtgacaccttctaagcccaaagatgataaggggaagacaatagaaaagcaacccattaag

SEQ ID NO: 20868 - DNA, 123 bp, Glycine max
  Peptide Sequence Number=SeqID_112553
gggaaaactgcccaggaaacccactttcaagcgaaatcctcaaaagagagtttggggcttcgtctcaaaaaggaaacaaacacccagaaaaatctagcccttccatggattcaaacagaaaac

SEQ ID NO: 20869 - DNA, 516 bp, Glycine max
  Peptide Sequence Number=SeqID_112554
atgtctttcgaccatcactactttagtctccccttcgtcatccagagaaaatcaagtccgatgacacacagagaccaacgtggtcgtctgcacccttcgtcgaagactcaatgtctatcgaccgagactactgaggtctcccctcgtcatccagaggcaagcgagcccattgacacgcagagaccaacatggtcgtctgcacccttcgtcgaagactcaatgtctatcgaccgagactactttagtctctccattttgtcatccatagacaatcaagtccgacgacacgtagagaccaacgtgagacaaccgagtctgatggcatacggagaccataatggtcactcgctttcatttttccgagactatcaatgtctccttatcatccagagacaagcaagtccgatgttccctttgctatccggagatgatcaagtccgatggcatgcagagacaaacatagtcgtctgcttcccttgtcgaaagactcaaatgtctatcgaccaaagctactga

SEQ ID NO: 20870 - DNA, 878 bp, Glycine max
  Peptide Sequence Number=SeqID_112555
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaagggtcaaccttatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 20871 - DNA, 194 bp, Glycine max
  Peptide Sequence Number=SeqID_112556
aactgtggaaagcacctgtagcgatgacaagagtgatgagcaaaatgacggcgacaacgacgaagtctatttcgttgaagcctttgggaagagacagcacttcgccgccggcgacgggcatgtcgactacaaacttggtgtagcagaaggcggagtggagggcgcagaagccggcaatggcaatttaaataaga

SEQ ID NO: 20872 - DNA, 543 bp, Glycine max
  Peptide Sequence Number=SeqID_112557
atgcataccgggcaagatttcacccaacgaccacaatgccaatctccccctacagaagtatcagttggtctatgccatgatgacataggtaaggatcgtgcccacaagacacccagtggacctggagaagtccaacagggccctggggtttccagctctggttataggcctctgtcagtcctactgggtgcccgtccccctagcaaggtcactctatcggtaaggatcgcacccgcaagacacccagtggacccggagaagtccaatagggtcctggggtttccagctctgattacgggcctttgtcagttctacggagtgcccgtcgcccccatcaaggtcatcaggacccctattaatcgggctttcatcaagaagtactgtgccccccaggcaggcgcagggcgagacaccacagcagcctggggatggccagcagtgggcaatagacgcaccgccgccacctctagagcccctcagctcatctacaacccgtggccgaccaacaggcgaccaagtccaaagccaaagatatatatatga

SEQ ID NO: 20873 - DNA, 288 bp, Glycine max
  Peptide Sequence Number=SeqID_112558
atggcatctaagaagaggaaaacaccctctacacctactcaaaccaaatttgatagatccagattcacatcccaagaggcttgggagagatacactgacatagtgttgccacgaaagctactaccagagaggaatgtggtaatctattatacagagtttgacgagttcaaggaggaactcgagagacgccattgggatgagaagctgactgatttttctaacaacaatatagacatcgccattgtgaaggagttttatgccaacctctatgaccccgaagtcacctaa

SEQ ID NO: 20874 - DNA, 370 bp, Glycine max
  Peptide Sequence Number=SeqID_112559
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccaagccagttacctcggttcaaagagttgtagcctcagagaaccttcgaaaaccgccctgcaaggcg

SEQ ID NO: 20875 - DNA, 434 bp, Glycine max
  Peptide Sequence Number=SeqID_112560
ttctatttctcgatggaggcaagggatataactcagcggtagagtgtcaccttgacgtggtggaagttatcagttcgagcctgattatccctaaacccaatcgaactccagtcgaatatgaagcgcctggatacaagttatgccttggaatggaagagaattccgaatcagctttgtctacgaacaaggaagctataagtaatgcaactaggaatctcatggagagttcgatcctggctcaggatgaacgctggcggcatgccttacacatgcaagtcggacgggaagtggctgaggagcaaaaggaggaatccgcccgaggaggggctcgctggggaattttccgcaatgggcgaaagcctgacggagcaatgccgcgtgaaggtagaaggcctacgggtcatgaacttcttttcccggagaagaagcaatga

SEQ ID NO: 20876 - DNA, 1188 bp, Glycine max
  Peptide Sequence Number=SeqID_112561
atgagtgcgacagaaggtctaatgagaggaatggaagtgattgacacaggagctgccctaagtgttccagtaggtggagcaactctaggacgaattttcaacgtgcttggagagcccattgataatttaggtcctgtagatactcgcacaacatctcccattcatagatctgcgcctgcctttatacaattagatacaaaattagccatttttgaaacaggaataaaagtagtagatcttttagctccttatcgtcgtggaggaaaaataggacttttcggtggagctggagtgggtaaaacggtactgattatggaattgatcaataacattgccaaagctcatggaggtgtatctgtatttggcggagtaggtgaacgtactcgtgagggaaatgatctttatatggaaatgaaagaatctggagtaattaatgaacaaaatattgcagaatcaaaagtagctctagtatatggtcaaatgaatgaaccgcccggagctcgtatgagagttggtttaactgccctgactatggcggaatattttcgagatgtcaatgaacaagatgtacttctatttatcgacaatatctttcgcttcgtccaagcaggatctgaagtatctgccttattgggtcgaatgccttctgctgtgggttatcaacccactcttagtactgaaatggacgatttaaccgatcctgcgcctgctacgacatttgcacatttagatgctactactgtactatcaagaggattagcggccaaaggtatctatccagcagtagatcctttagattcaacctcaactatgctccaacctcgaatcgttggtgaagaacattatgagactgcgcaaagagttaaacaaactttacaacgttacaaagaacttcaagacattatagctatccttggcttggacgaattatccgaagaagatcgcttaaccgtagcaagagcacgaaaaattgagcgtttcttatcacaaccttttttcgtagcagaagtttttaccggttcgccggggaaatatgttagtctagcagaaacaattagagggtttaaattgattctttctggagaattagatggtcttcctgaacaagccttttatttggtaggtaatatcgatgaagctactgcgaaagctacgaacttagaaatggagagcaatttgaagaaatga

SEQ ID NO: 20877 - DNA, 189 bp, Glycine max
  Peptide Sequence Number=SeqID_112562
atgatgaatcagatgatcaagatgtttgatgatgacaaaggtgatgacaaaaagctcaaaggaaagttgaagaacacttcaagattcaagaggaaagttgaattcaagaatcaagattcaaggatcaagcttccaagaatcaagatcaagattcaagactcaagattcaagaatcaagagaagacttaa

SEQ ID NO: 20878 - DNA, 297 bp, Glycine max
  Peptide Sequence Number=SeqID_112563
atgcgaagaagatcttctgtaggtgatttgattcccattgatttggagattaatgccacttgtagaaggcgtaatcaagagagaattagcaaatttttgcaggacttagaggcagcaacaattccagaggaagaacctcaatcttctgaggcatcttctagttttcctattatagaacatcctcatttagatcctattgaagactacatcatggctgaagatccaagaagagttactctggaagattattcaagttctaatgtgccacaatttttcactagcattgcacaactagaa

SEQ ID NO: 20879 - DNA, 180 bp, Glycine max
  Peptide Sequence Number=SeqID_112564
atggctgagtggactaaagcgtcggatgctaatccgttgtacaaattttgtaccgaggcacaagcaagaaaaacacagaatccacctttttcttattcttcacgccctggattacgtcctggatcgttagataggaatccgaagatgaaaagagaaacgaagaatatcactaccgtgtaa

SEQ ID NO: 20880 - DNA, 303 bp, Glycine max
  Peptide Sequence Number=SeqID_112565
atggaactactcattttaagagctaagcttagggaggaggaaagaacaaagcaacaacttaaaaggaagcctacttccaaatcatatggctctcactcttatccaaagaaagaccaaggtcaatgcatcttaggggctgcaccttctaagcccaaagatgataaggggaagacaatagaaaagcaaccccctaaggctagtatgcaagagaagactagctctataaagtgctttagatgtcttggaagaggacacattgcatctcaatgccccaccaagaaagccatgggttctaagggctag

SEQ ID NO: 20881 - DNA, 108 bp, Glycine max
  Peptide Sequence Number=SeqID_112566
ccgaggcgcttccgaaacgtttccgtaacgttttccgtgaagaatttcgcgaaggttcgaccgtcttcgacgttcttcattcgttcttcatcgtctcgatctcaacgg

SEQ ID NO: 20882 - DNA, 400 bp, Glycine max
  Peptide Sequence Number=SeqID_112567
atggcggccatatatgcacaagtcagttccatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 20883 - DNA, 222 bp, Glycine max
  Peptide Sequence Number=SeqID_112568
atgaagacccctgaagaagccatggatctcattgaaaatatggctgcaagcgacattgctattttgagagatagagctcacattcccaccaaaaagagtttattggagttaacctcccaagatgcattgttggcagaaaacaaattgttgtctaagcaactagaaaccttgaccgaaacactaagatgtaccttagatggaggagctcatgaatctggatga

SEQ ID NO: 20884 - DNA, 1112 bp, Glycine max
  Peptide Sequence Number=SeqID_112569
gtaatatagtgttctcccagaacaggggtcaaaacattaaactaaaacaacctacagctgaaagtatgaaagccggagcatttattgatgtaaatgcagccggatatgcagaatctaactataacattactcagttggtaaaagatgttcttatcgcaggagggtctacgtgtaccacagccaatgtaagtaatgtaaatgtatctcctaatctaccaacaacggatcagaacagaagctggggttattttaataaggcagggaccaactttccattttcaaaaggtattgtccttgtaactggatttgccagaaaagcaggaaataactttcaaagtgtcttaagcgatccgcttccctcaggaggtgacgttgacttagcaacagccctgaatgttaataatgccaatttaagggatgctacttatatcgaatttgactttgtacctagttctactgaagtttcttttcgatacttatttgcttctaaagaatattcaccatcaggaacttttacatgtagtatcgcagatggctttgccttattactgaaaaaagtcggtgatcctacttacactaatttagcagttttacccaatggtgcaggccctgtaagtgtaaccaatattattccttcaggcttggcttgtggtcctaaaaatgcacaatattttgcaggaatgaataatcctcaggttgaaaccaactttgacggacgcacggttcctttaacagcaaaagcaacggtaattccaggtgaaacctatcattttaaaatggttttagcggattatcaggacgtaaattttgattctgccgtttttttggaagcaggatccttcgatatcggagttcagattttaggtcccggaggagtagcgcttcctccgtctattaatatgtgtgacaatactcctcaggtacttactgcatcgattcagaatgctacggcttcctatcagtggttcttgaataatactcctattgctggagctaccaacgcgacttacacagcgacgcaaccaggagtttatacgcttcaggtgcttcttgcaggaaatacatgtcccggaacggctactgtaacgatcgtaggcggaacttcacctacg

SEQ ID NO: 20885 - DNA, 324 bp, Glycine max
  Peptide Sequence Number=SeqID_112570
atggtgatggaggagcaagaagataacgtaggggaagaaggagaagaggctggaaatttctggaggaaagagagagaagaagaaaaatctggacctttttggatgctaaaatcttgcatcgatttgtgtgccgtctcctcagttccagttcttcgcgtttctctgcacccgtcggggcccgttttcaaaggcaatcggagatggacctcagagatagtacctcctcttgaggcggcggtggtgcatttgcagctagctattggtcctcctccggctgctacagtgcttggccctacgcctgcctggggatgcaatatttcttga

SEQ ID NO: 20886 - DNA, 369 bp, Glycine max
  Peptide Sequence Number=SeqID_112571
atgaagagtcaagcagccaccatgcacccttcaatgattaatgaacaaaagctagtgttggttgttgatgagctaagagaagtgaggatgaccaatgatatgatctattatgatgccatggtgcttcaaagtgaaaacaaaagatcatggttgaggcgctcaatctcctacaatgaaatgatcaaccaaatccaccatgtcttcatcttccttggctcttccaccatctccttgggcagctccttgagcatctacaggtcttgcctccccctgaaaaataggcttgtctccaggtcatgctacaatgtccctaaactgctcgggaataggccaagggtaagggctagggtcctagcaatgctggtgtag

SEQ ID NO: 20887 - DNA, 306 bp, Glycine max
  Peptide Sequence Number=SeqID_112572
atgattatgaggggcctagacatttatagtagccaagatgaggctactacttcaccttcctctagtggaagtgaagaagcaaaaggggaagaatctagtgaagaaatctacccccaagaagaaggacaacctttaatggttaaggaggagtgtcaggaggtaagtgtctcctccaagaggttagctacgaaggaaattcattttgcaataaagacaacaaagaaacttcccctcttagacaacctccacatcttctccttttgtacaaagacacttgttagcgctgccacacttcttgggcttgag

SEQ ID NO: 20888 - DNA, 275 bp, Glycine max
  Peptide Sequence Number=SeqID_112573
atggcaagagtagcaaaagtggtgaagatctcggcacaagagttagaccgagtgaagcaaaataggaatggggtggtagggttaccaaggaagtgcttggaggagaaggcagaagctatggtagatcaaggagagtggaccttgttcattgatatattagcactcaaggaaagctcagtcattgttgttttggtcgatgcatatgacacatttgaactaagatgcgaaaagagcggtgcaagaattgtctgttgtatgcctgctctttatgtatg

SEQ ID NO: 20889 - DNA, 366 bp, Glycine max
  Peptide Sequence Number=SeqID_112574
atgtcatctttgaaagagcaaatggcttccatgatggatgccatcagacctaactctcccagctaccgcgcaccatcctctcccaaacgtggtaggacaagaaaaaagcatactggggacattagcaacccctatttgggatacaaccgggtggcttacccttatgaattaccacctaattacactccaccagtcatgcgtgacgacgtcggtcatgtcccttcccccatccctgaaggggagcctcctcaacattcggtcaaggttcacgaggatcatgcccaaggagatgtcgatttctaccccccggtcctcgtcgaggggctgacacccgtcatactgcctcaaccaaacctcccaacatag

SEQ ID NO: 20890 - DNA, 261 bp, Glycine max
  Peptide Sequence Number=SeqID_112575
atggtgaaagttggaacctcttacgtgccgatcaacgtctcattttcgccaaaagttggcccagggcttcccggtgctccagtggcttctgtttctatcagctgtccctcctgttcagctactgacggggtggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 20891 - DNA, 840 bp, Glycine max
  Peptide Sequence Number=SeqID_112576
atggccttcattattggagaatcatttggtggtagccatacccgggagggtcttcccagccaccctaccccaagtggtatgacccgggtgccaggtgtgcgtaccatagtggaactcccagacacaacattgactcctgccgcccgttcaacgagtcatggaaaggctagcgtaaacgccattcaagagggtgggccattgcgggcaaggagattaggagaggtggctacttccagacattttatctaccaatcgctgcaagcggcatgtatggtctcccatggcggaggcgaaagggacgaatgtttgtttcacctcggggagtcgcacgacatggaaacctgtcctgcggtagaaggattgcttcagcggctcatggattgcgggcagcttgaagtgtccataggagggagggaagaaccacaaatttgcatgcagtcggaagagaagaaggttcctctaacccccaaggccctagtgatatgttttactaggaaagggaccggctccacacccatatacccccggacagcgcccaagccaacgccatttgcatatcaaagtaataaggccattccgtggaagtatacccctcccgcgttcagcgaaagagttgcaaccgaagttgactccctgtcagctaaggtgaccaacatcaccggcctcagtggcgtaacccgcagtggtcgggtgttcgcttcccctcacctggtggagttgccctccaaggggaaagcgcccatggtccaagagcctacagacgtagccaccccctcgaaagaggtagatcctccagtggtaagaggggctgaaaagaaagaaggtcttcaaggaaagacg

SEQ ID NO: 20892 - DNA, 777 bp, Glycine max
  Peptide Sequence Number=SeqID_112577
atgtccaaatcttgtggatttgggatgaccggccctctcgatgagtcaatctcttgctttctcataagggtggacccttgggtacttgtacctatcacctttagaggactacacgtcctcgccaacagagggctgcacgccctcaccttcagaggactacacgtcctcgccttgagaggactacacgtcctcaccttcgtagggctacacgccctcgccatcagaggactgcatgtcctcaccttcagagggctacacgccctcgccatcagaggactgcatgtcctcaccttcgtagggctacacaccctcactatcagaggactgcatgtcctcaccttcgtagggctacacgccctcacctttagaggactacacgtcttcgccaacagagggctgcacgccctcaccagcagaggactgcatgtcctcaccttcgtagggctacatgccctcacctttagaggactacacgtcctcgccaatagagggctgcacgccctcaccttgagaggactacacgtcctcgccaatagagggctgcacgccctcaccttgagaggactacacgtcctcgccaacagagggctgcacgccctcaccttgagaggactacacgtcctcgccaacagagggctgcacgccctcacctccagaggactacacatcctcgccttgagagggctgcacgccctcacctttagagggctacgtgtcctcattttcagtgtgctccacatctgcaccgtaagagaatttaaggtcctttatccttaa

SEQ ID NO: 20893 - DNA, 231 bp, Glycine max
  Peptide Sequence Number=SeqID_112578
atgtgcagaaggaactaccaacgacaacgcatcatcaaagagaaaactctagatgaggtttcactgtcatcaagcgagtcggagactcagcatgaccacagatcaacctccacttcctatattcccatggacccagaaaaagatacaccaaatacaaaaacatccaaagagttatatggatacaagaacataaaagaaagaaagggaaacaacacaaagccgaagtcatga

SEQ ID NO: 20894 - DNA, 154 bp, Glycine max
  Peptide Sequence Number=SeqID_112579
atggttaaagcacgtcaaaagggggtacggaaaccaaacgaaatgaaaataaaagaaaaaagagggaggtggttgccgcccagctggcccaggcgagctgggttgcttctaccagaaggcaccgccttctgttggaaccccctagaaggcccaa

SEQ ID NO: 20895 - DNA, 408 bp, Glycine max
  Peptide Sequence Number=SeqID_112580
tcccagcagtttagcgccaggaatgatgccatagtcattagaggagtgcatgaggtagctacaaacccatcggcatcatctgaaactaagaagcttgaaggcaaactggatgcattggttaacttgcaacctggagcaattgagcagcctgaagcttatgctgcaaatatttacaatagacctcctcaacctcagcagcaaaatcaaccacagcagagcaattatgacctttccagcaacagatacaaccctggatggaggaatcaccctaacctcagatggtccagccctcagcaacaacaacagcagcctgctccttccttccaaaatgttgctggcccaagcagaccatacattcctccaccaaatccaacaacagcaacaaccccagaaacagccaacagttga

SEQ ID NO: 20896 - DNA, 731 bp, Glycine max
  Peptide Sequence Number=SeqID_112581
ccttctattctaatcttgaaattcaagaaggcactttgatttctgaagtttatgggataaaaatggtcattgaccaatccctattctatgacttgacccaattatctagtgaaggtgtaccatttgaaggtacattgaatgatgattggaaatttgacttctctgtgggtgttgcccgctggttggtttgcaccaaccaagcggatatgaccggaaggcttcttgttggttcattgacttttgaaagccgcgtccttcattatctcattgtgcgtatcttgcttccaagatcttcaaaccttgcacaggtttctgaggaacatcttattgtcatgtgggcttttcatacaggccgacaaattgattgggcacacttagtccgatatcacatgcataaggcattgcgattaaatgctccatttccatatcctcacttagtcactctcttccttcaacactttaacatccctcttgattctaaaccttatgttccaatcaagagatccttcttaattggtgccactgtgattgcatcttttggttaccgtaaagagcatgatggctcttgggtgaaaaaaggtgcacaacccattgaagaagaaggacacttaccattacaagtggacatgcgattcaatgagatggattcaaggatcaccaaggtcgaaggagatgtctcttacatccgcacaagctttgatctaccaccaccaccgccaccatcatcttag

SEQ ID NO: 20897 - DNA, 195 bp, Glycine max
  Peptide Sequence Number=SeqID_112582
atgggcaccaaaggttggagctttaatggagtttcaatggaggatgaagaagaaagaaaaagcaacgtgagggagagggagaaagcttctgaaatgtgggctgaccaaatggaagcagagacgtctctctatgggaggcaggatattcctaacagcccttcctatctacctactgtcattcttcaaaattcctaa

SEQ ID NO: 20898 - DNA, 311 bp, Glycine max
  Peptide Sequence Number=SeqID_112583
tttattacactgagtttgacgagttcaaggaggaactcgagagaagacactgggatgagaagttgactgattttgctgacaacaacatagacattgctattgtgaaggaattttatgccaacctctatgaccccgaggataaatcacctaagcagggggagaatttgtgtacttattccaggtttgcactcctaaggcctgatcctcaggagttggatgctaagctctgtatcccagggaggggattcgagctaaatgctgatgggcagccgttgaagatactaaggaagaacatgaccaccttagcttag

SEQ ID NO: 20899 - DNA, 177 bp, Glycine max
  Peptide Sequence Number=SeqID_112584
atggcctcctttttggtaaaacctgggaaaatcagttcacctcctatagtcgatgcagactctccaactgttttgcacccgagtaggaattaccatcagttgctcctccttctcatttttgatcatggtgaggccggttttcttcgggactacctagacgggactcaccctttggct

SEQ ID NO: 20900 - DNA, 318 bp, Glycine max
  Peptide Sequence Number=SeqID_112585
atgttagccatcataagcaagtaccaagaagaattaaatctagccacggcccacgagcacaaagtagcggacgaatatgcccaagtgtacgcggaaaaggaagctagaggaagggtaattgactcgttacatcaagaagcaacaatgtggatgaaccgatttgctcttaccttgaataggagtcaagaacttccccgattgctggccaaggccaaagcaatggcagacacctactccgcccccgaggagatccacggactcctcaactattgtcagcatatgataggcttaatggcccatataattaggaactgctag

SEQ ID NO: 20901 - DNA, 412 bp, Glycine max
  Peptide Sequence Number=SeqID_112586
atggcggcgcagctaatccatgatcgagtggagatggagtgcctagagggagcttgggagaccctcgaaggcaacgcgaggtgccaatttcggggcacgattcgattcacggctacttcattggtgcatccagatgaaccggcgcgtacgcttcagcgcactgtggagtggatactacccacgcctacaccatatcgtctagtggagccagtccaagtgatcgaggtaacgtcatccgaggaagacccagaggaagatctcgaggagctacctcccgagcctgctatggatgctcttgactttctagagggtgatgaggacccacttcctgaggtggattctcccgaggaagtcatgtcggcatctgaggcaaactctacggaggataatggcccaagagagatggcgacca

SEQ ID NO: 20902 - DNA, 652 bp, Glycine max
  Peptide Sequence Number=SeqID_112587
atggccaagttcgacccagacatagtcctcgaattttatgctaatgcttggcctacagaggagggcgtgctagatatgcgatcctgggtgaggggtcagtggatcccgttcgatgcggatgctctcagccagttcctaggataccctttagtgctggaagagggccaggaatgcgagtatggccagaggaggaatcggtccgatgggttcgatgaggaggccatcgcccagttgctatgtataccggggcaggattttgcccggactgctgctggaagacgggtgcggatcatgcgcaccgacatgaccaccctgactcagatctggatgactttgctgctcagcaacatccagcccagcgatcataattccgacctccccctaccgaagtgtcagctggtgtacgccatcctgacacggatgagcattcgcgtggctcagttaatcgctgatgccatctatctatttgcaggtatggcgcctaccaggcaccctctggacccggataagtccaacagggccctgggatttcccgctttgatcacaggactctgtcagtcgttcggagtccccgtcgcacctagcaaggtgattcggccgcccatcacccgagctttcattgagaagtattgcacacagagacaggcccagg

SEQ ID NO: 20903 - DNA, 195 bp, Glycine max
  Peptide Sequence Number=SeqID_112588
atgcgaggtttagccaagaacgttgtggccaccatagtcgaggcattgccatgccactctgccatggcacttggaaaaaactcagcaatgcgagtggaatggagaagaagaagagttgagaggagacgccacttcaaggagaagatgagtcaggaagaacctcaccaccataggaagccatggataagagcttga

SEQ ID NO: 20904 - DNA, 450 bp, Glycine max
  Peptide Sequence Number=SeqID_112589
atgacgagaaagcagaaggatatggaaaaacaagggggtgtaagcattgcacagaaatgctctatacagactgaaatccatcctcaaaacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 20905 - DNA, 773 bp, Glycine max
  Peptide Sequence Number=SeqID_112590
ggcttcccggtatcaacagggacaccaggatttatttatctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggcgaattggagctccaccgcggtggcggccgctctagaactagtggatcccccgggctgcaggaattcgataaccctgacatgcataacaggtgtataagcactgatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 20906 - DNA, 662 bp, Glycine max
  Peptide Sequence Number=SeqID_112591
attggctctccaaattgaaagttatcgataaggagaacttcgaagctctggaggaagatgaagaagtccgagctctaaaattagagctagggaaggcgagactcgccaaggagaagttcaaatcaactgctacacacatccggaaggagtgcaccgagttacaagaggaaaacgcggccactgcaagagcccttgaacaagaaaccaaaagggcccgcaaggaggaatatggccgagagaaattccgaggagcattgtggggtagcaacaatgagctcaagctccgaagagaggagagagatcggtcacgggtgcatggcatgatcttaaaagaagagttagttgcttgcgcgaggtccaaaaggagtttggcccaacacttggaagccacggagcaaagcatgttagctatcatagggcaatacaaggaagaattgaaccagtccatggcccacgaacaaaagctagtggaggattttgcacaagtgtatgccgaaaaagaagcaagagggagggtgagtgatgtgttgcatcaagaagcgactatatggatggattggttcgccttcaccttaaatagaagtcaagacctcccgcgtctgttagccaaagcaaaagtcatggccgaagtgtgtactgccccgaggagattcatgggctaa

SEQ ID NO: 20907 - DNA, 219 bp, Glycine max
  Peptide Sequence Number=SeqID_112592
atgggaacaaggggttgtattaattataatcccgtcctcgccataagacagcttggctaccccatgagaggagtaccatcagacgaaagcatcactgatgcaatcctccctaggaagggaccaatcactagaaccatgagcaagaggctccaagaagattgggctagagctgctgaagaaggccctagggttctcatgaaccttagggtagatttctga

SEQ ID NO: 20908 - DNA, 281 bp, Glycine max
  Peptide Sequence Number=SeqID_112593
ggtcttggagttgtcaagccctaattacgggtctctgtcagttctacagagtacctgtcacctccagcaagggcatcaggccccctactaatcgagctttcatcaagaagtactgcatccccaggcaggcgcagggtgaaacaccacagcagcctggggatggccagcagcgggcaacggacgcaccgccatcacctctagagttcacctcagctcatccacaaaaagccgtcaagcgtccagctcaagacgttaaagaagcgctactaggaggcaaccta

SEQ ID NO: 20909 - DNA, 216 bp, Glycine max
  Peptide Sequence Number=SeqID_112594
atggaactcacgtttgaagaagtgggagtaggcttgatgaatgagatcctccaaagaggcatagtggtgcaactctacaatgtcttggatctatccattgagaccatgcaaaaacattgccatggttgcctcttgagacttctcaatttgatccctaatcaaggaaatttccatctctttgtaatactcatccacactcctatttccttgaaatag

SEQ ID NO: 20910 - DNA, 252 bp, Glycine max
  Peptide Sequence Number=SeqID_112595
atgaatatcgaggaatccattcatgttacctttgacgaatctaatgctatcttgtcaagaaagaatatgctagatgacattgcagattctttagaacatatgaatattgatgaacaagattccaaaggaaatgataaaggaaacaatgaagatcctccagaagaagtcaaatccaataatgaacttccaagagaatggaaagcttcaagagatcatcccctcgacaacattattggtgatatctcaaaaggg

SEQ ID NO: 20911 - DNA, 351 bp, Glycine max
  Peptide Sequence Number=SeqID_112596
atgcggcaccaaattcctatgataggtggtatgatgaatgtgttgagtggtgcaaccctcttttgtaaaattaccaatgcatccaacatcttcatgattcacatacatagggactcattaggtagtgatcaaggggttcctacagaccctaagagaataaaggtaattcctgagtggtccactccaccaacaccactcattgagttggtgaggaaccatgttccctcaagaaaggggttttcaaaccttaccctactccaactgtcataccctaatttcgtccggggacctttgcttgatgacatgcgacctttctttggtccttgtgaggtgcttggcacccatcattag

SEQ ID NO: 20912 - DNA, 204 bp, Glycine max
  Peptide Sequence Number=SeqID_112597
atgaaaattctcttgataccacatgatgtaactccatgtggagcttgtaggccttggatcttcttcatcaatggagtcctttgcttcttgaagatcatggaagcggaatggagaaggaagaaagatgattggagacgccactccaaggagaaaatgagtcaagaacaagctcaccaccatatgaagccatggataagagcttga

SEQ ID NO: 20913 - DNA, 1023 bp, Glycine max
  Peptide Sequence Number=SeqID_112598
atgacttcgcctcccgtatctggaaaggtgtacatggcttcacaactgactgatgcatttgcgcgtaagttttactacttgcgcctgtcgattaccgatgtgtgtaactttcgttgcacctactgcctgccggatggctacaaaccgagcggcgtcaccaataaaggctttcttaccgtcgatgaaattcgccgggttacgcgcgccttcgccagactgggcaccgaaaaagtgcgcctgacaggaggagagccgtctttacgccgcgactttaccgatatcatcgccgctgtgcgggaaaacgacgctatccgccagattgcggtcacaaccaatggttaccgtctggaacgcgatgtggcgagctggcgcgatgcgggacttactggcattaacgtcagtgtcgacagtctggacgcccgccagtttcacgctattaccgggcaggataaattcaaccaggtcatggcagggattgatgctgcatttgaggccggttttgagaaggtcaaagtcaataccgtgctgatgcgtgatgttaatcatcaccagctcgacacctttctgaactggatccagcatcgccctatccagctgcgtttcatcgaactgatggaaacgggcgagggcagcgagctcttccgtaagcatcacatctctggtcaggttctgcgtgacgagctactgcgtcgcggctggatccaccaattacgtcaacgcagcgacggtcccgcgcaagtcttttgccatccagattacgccggagagattggccttatcatgccgtatgaaaaagacttctgcgccacttgcaaccgcctgcgcgtttcctccattggtaaactccatctctgcctgtttggtgaaggcggcgttaacctgcgcgatctgctggaagacgatacccagcaacaggcgctggaagcgcgtatttcagcggcgctgcgggagaagaaacagacccatttcctgcatcaaaacaacaccggtattacgcaaaacttatcgtacattggcggctaa

SEQ ID NO: 20914 - DNA, 705 bp, Glycine max
  Peptide Sequence Number=SeqID_112599
atgggcaagaaatactttagatcggctccacggaccttctacacttcttcctccatggctcccgaagaactagagcagctgactcaacaaatcaaggaccagctggaggagttgatcatagaaaaagtgactcgacggatgatgtcatccttcagccagatgcagtcccagtttcaatcacagatgcaatcacagggacttgcactacctccggagcctgagggaacgatccagacacgggtgactcatacaaatacgggttatacatcgaagaaaattctccacgcttggtttcccctaggaagagtttatgagggatccacaaccgttcacaacatccctttgttgcatgatcaaggagctgtgggaccagcaaaacctgtagataggccggatcatgaggttatgtgggatgctaccgtgttcggggtgtttaatgaagacttccccttgtacataaagcatgaagatttgtctgaaatagcacacggtggtcaatgtctcagcatctctgttatacagttgtggactttgcatctgattgagacaagtatgcaagcagggaatttcgatgtctatggattcatcgagccacaatccatccagagatctgggcaatcacaatttgaatcaaaaagttacatgaagaactggatgcagaattcaaaatggaatgtctacctaggcgcctacatgaatgggtaa

SEQ ID NO: 20915 - DNA, 153 bp, Glycine max
  Peptide Sequence Number=SeqID_112600
gattcacttgaaattagtgagaaaaattgtttccgtgaagaaaatccaagccgaggcgcttccgtaacgcttccgagacatttccgtgagcgatttcgtgaagattctccaccgttcttcatcgttcttcgttcgttcttcggtcttcaatcg

SEQ ID NO: 20916 - DNA, 162 bp, Glycine max
  Peptide Sequence Number=SeqID_112601
atgaccaagccgatgttggatcaatttcatccatgcattcataattccattgaaaacattgttgatgtcaaagttaatggtatggatggagattcatggtctttggttcgtaaccatttgcttaaagagcttgaaaaatggttaccatggataagtggatga

SEQ ID NO: 20917 - DNA, 342 bp, Glycine max
  Peptide Sequence Number=SeqID_112602
atgagatcaagtcaagtgccttcacttaaaaggaggttctatcaagtcagggtcaagagcctagggaccaccagtctaaaggagttagggcagttaatgggtcaactccaatggcaagcttttcgcaaagcttacggtaaaatctgggacctagccatggtagaagtctccacaaaggccattgcctccctcgcccagtattatgatcagccgttgaggtgctttacctttggggacttccagctatcacccatggtggaagaatttgaagagatcctaggatgtcctctaaggggaaggaaaccatacctcttctcagggttctacccctcattagcctga

SEQ ID NO: 20918 - DNA, 1305 bp, Glycine max
  Peptide Sequence Number=SeqID_112603
atgggaaagggaagaatcaaaccacaaaaaggagagacgactttgtttatcactgatatgacaaaggctaatgtttctctccctggaactataaaatgggatgaggtaactcttcctgaaaaatgggtcatggataaggctacaccttcaatccccaaacttgccccttccatagagcaaatcaaacaggataattctagtaaggtagagataaccttcaataggagaaactgtttctcatccagaatagaagcttcaagacaatctgagtatgaattgacaagaaggtctttctcagttaggacccgatccattccagtaggattatctagatttgagtcacacaaccaagtttctagtataaacctccaaggattatatatgacttctagtatacctaggaccacgtataatcaggaaccagaagaagaccaaaagtcaattcaatctccaacatacttttctatccatgaaccttatgatcattttaggggagcaaaaaggcaacaaatccaagacaagttttataaatttgtcgaaaaggttaagatcaattttcctttctttgattggtttcatgtgtataccaccaaagaaaacatagactacccttggcaacatgacataataagcgactcaacaaccaatgtcattaccaattggcaaatcaaagatggtgagttaatccaatcggaattacctcccacaactcagtaccaacttccaaagatcaatgacaacagtgataaacttgtcatggccacaccttttaaaacaaaggatgtcaatgaagaaataaccctgaaggatattagaagcctaatggaacaggctaattacaccaacaaataccttctggtgttaggggaatctattagtaaagaaaagatctttactaagcctaaggaccacgagttgtcaacatcacatgttccaaaagaaaaacctttgttcgaaccttttaaggttagcgaaaacgcaaaacaaaaattcagggaacttaggaaacacaaatctcctacggaagagattggtgataacaatagtgaattattaagtaagattaatagtttacttaagaccattcccaaaaccccacagccctcggaggaatcatccaagataaggactagaaacacctccaagctaattaattccatcaacgaagatagtgaaaaaattcaaaacaagcatctgaagaaggttcagtgtctaaaaaagaaatcaatccaattaacaccaaacattggaaaccaccttctaagctttattaccaaagaccaactacccctaatcttctactag

SEQ ID NO: 20919 - DNA, 273 bp, Glycine max
  Peptide Sequence Number=SeqID_112604
atgcccttttgcgggcgagcgaggcgaggctcacgggtgcgctttccaaaggaggaaaaatgcacggagtcgccaccaacgtttatttgtggaaaacgttggaaaaaccgaaggaaaccggtcgaaatgaaaattctaagttcgggagttgtatttacgtttgaggaagtcgacaaaagcaggacttttgctcctacgtaccctcctttggagaggaaatcagacctacgcagttatttcttaagagtgaatcaagcgattctttttacttga

SEQ ID NO: 20920 - DNA, 231 bp, Glycine max
  Peptide Sequence Number=SeqID_112605
atgtgccagaagtcaaaagagagcattgttgcgcgatccgtgaagttccgtaacatgccggaaatcaaaaggaagcattgttacgcaatccgtgaggaggtgcaaatagcaaccaagcccacttgggccttccaggatgttcctccagaaggaggtgccttctggaggaagcaacctagctcgcctgggcgagctgggtggcaagctcccccctcattttcctataaatag

SEQ ID NO: 20921 - DNA, 537 bp, Glycine max
  Peptide Sequence Number=SeqID_112606
atggagaaaaaaatcactggatataccaccgttgatatatcccaatggcatcgtaaagaacattttgaggcatttcagtcagttgctcaattgttcacccttgtgggggccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgaattacaacagtactgcgatgagtggcaggcggggcgtaatttttttaggcagttattggtgcctagaaatattttatctgattaa

SEQ ID NO: 20922 - DNA, 492 bp, Glycine max
  Peptide Sequence Number=SeqID_112607
atgcctctaatcattggtttcttttaccgcttagatagaactcagcccgggagctcccgcctgatcctgagggaaacttcggagcggacgtgcacgctactaagacggtcgtcgattaggtctttcagccctatacgaccaggtcgcacgacgatttgcacgtcagtatcgatgcgggctctccaccaatttcctctggcgaatcggccaaaccgtcaggatattcacaaccatctttcgaggcgggtagctcgcgagtcactcaaccccacagaacattacagggtcggtcggcggtgcaacccacagggggatcccaccaatcagcttccttgcgccttacgggtttactcgcccgttgactcgcacacatgtcagactccttggtccgtgtttcaagacgggccgaatggggagcccacaggccgacgccaggagcgcgcagtgccgaggcacgccaagggcgcgcgctgccatccacaatcgcgatga

SEQ ID NO: 20923 - DNA, 234 bp, Glycine max
  Peptide Sequence Number=SeqID_112608
atggggtattgggcagtaggatacatagcaggaggatttgaaaatcattatggcattcaagatttccaagggttttctcatgtggagcttccgggatatcttttctgtagcttggagaggaattattcgaacagaagaagatacatggtcctttacaagaatgttaagaccataagaagctcatgcatttgggatcctcacttagttgcggctgtagaagctctttctcaggag

SEQ ID NO: 20924 - DNA, 548 bp, Glycine max
  Peptide Sequence Number=SeqID_112609
atgcagaattttgctgtcaaaataggtgcagcaggattttggcttgtgcagaaaaatgcttgtgtgtggttggctatggaaagtctagtgcagaatgagttctggatagttttctgcctttgctctgtattgcttggctgtgatagcttgtgctgtttgaatgttgttttgcttggatgttgtggaagcttgggaggattgatggggacccacgcgctttgtggatgtggaaacttgttgtgcaccatcgcccgaccgccacctagtaccacatgtgatggagtggtacctggagatatgtcgcgggggtcaggagaccttggggatgtcaggagagctcctggcagtcaacagataaaaggaacaaagaccacaaagcaagggggcttgtggtggctggccagctgtgaattttgtgtgatatatgggttgtggctctggcttgaaaacgaggtcagaaagctgagggcttctggtaatcgattaccaaggaggtgtaatcgattaccaggcttagaattgaaggcaacaggttgtagaggcctctg

SEQ ID NO: 20925 - DNA, 834 bp, Glycine max
  Peptide Sequence Number=SeqID_112610
gagaagttcaagttggccgcaacacacattcggaaggagtgtgccgggttacgggaagagaatgcaattaccgcaaaagcccttgaacaagagaccaagagggctcgcaaggaagagtatggccggaataaatttcgcggagctctatggggtagcaatagtgaactcaagctgcgaagggaagagatggaccagtcgcgagcacatagcatggttctgaaagaggagttagttgcttgttcaaggtccaaaagaagcttgtctcagcgtttatgcgagacggagaccaacatgctagctatcatcgccaagtaccaagaagagttaggtctagccacggcccacgagcatagaatcgcggacgagtatgctcaagtatacacggaaaaagaggctagaggaagggtgatcgactctttacaccaagaggcaaccatgtggatggatcggtttgctcttaccttgaacgggagtcaagaacttccccgcttgttagccaaggccaaggcgatggcagacacctactccgcccccgaagagattcatgggcttctcggctattggaaaaacaccataactaaacgcgccacaaggcatccctatcgcaccagatccaaatctagaacgatgggtgatcaagaggagacacaggaacagatgaaagccgacatgtcagctctgaaagaacaaatggcctccatgatggaggccatgttaggtatgaggcagctcatggagaagaacgcggccaccgctgccgctgtcagttcggctgccgaagcagacccgactctcttggcaactgcgcaccatcctccctcaaacatagtatga

SEQ ID NO: 20926 - DNA, 138 bp, Glycine max
  Peptide Sequence Number=SeqID_112611
atggcagaacaagctaaacaggcccatggctactacacctgcctcgcctcctcttcctcctcctgcagtagcatcagcgtctccgtctaccttgaagctgacacacaaagccacacaactacaatccttggccactag

SEQ ID NO: 20927 - DNA, 474 bp, Glycine max
  Peptide Sequence Number=SeqID_112612
ttaccctcaccgttgagaggactacacgtcctcgccttgaaaggactacacgtcctcgagaggactacacgtcctcgccttagaggactacacgtcctcacctcagagggctgcacgcccttacccagaggactacattgtcctcgccttaaaggctacacgccagctcaccttaggttaccctcacgtgagaggactacacgtcctcaccttgagaggactacactcctcaccattcagagggcattgctacgccctacactctccagaggactacatgccatcctccctgcgagagtggtctacacgtcctcaccttggaggtgctaccacgccctcgacctgaagaaggactacagggccctcgggccagcagagggctgcacggcctctcacctccagaggactgcccactccctccctgaaggtgcacgtccatcaggtaagtatgcacatcgctcaactgatttctga

SEQ ID NO: 20928 - DNA, 423 bp, Glycine max
  Peptide Sequence Number=SeqID_112613
atggattgggaccagctcttggccgggataggaggtagaacaatcagttggttcccccgatggaaggaaggaaaagaaggagtccttttctcatgtggaaggtacccaaacattccgctggtaggaacgaggggttgtattaattacaatcccacgctcgctataagacaactagggtaccccatgaggggagcatcgacggaagaaagcatgtctcctttccttgtgagggatctcggcgcacaaaattccaagactatacaaagaatccataaggcatgggaaaccccgttaaggaaagatcaagagcttagaggcattcgtaatggaccatttggtggggacgaagaagtccaagctctcaaaagcgagttaggaaaggcaaaactcgccaaggagaagttcaaggtggctgctacacac

SEQ ID NO: 20929 - DNA, 318 bp, Glycine max
  Peptide Sequence Number=SeqID_112614
attattgatgaccagtgggtgtgggaggctgatattagtggaaggtactcggttaagagtgcttgtagtgtgcttagacaggatgtactagaggaggctccagctgaagcatttaaggaattatggaagctcaaagtcccatctaaagtggctatgtttgcgtggaggttactcattgataggctgccaaccaaagataatttgaggaggaaacagcaaagtacttccgctttggtgggaatccttgtcttgggtgaatatggtggttgtcttcccacaacacccaagacagcactttatccagcacatgcatcaatc

SEQ ID NO: 20930 - DNA, 273 bp, Glycine max
  Peptide Sequence Number=SeqID_112615
atgtcacggaacttcacggatcgcctaatgatgggtgccgagtacctcgaagtggtcaaacgtgggtcgcatcccaacaaacatatggcgcaaaatgaccataatttgtctctgcgtgccctcggtcacgatcgagcctgggtggcaaggcgtagaatgaccataatttgtctctgcgtgccaccggacacgatcgcctctggatggcaaaaaggtgtggggaatgaccataatttgtctccgcccacctctcgactcactgtccctgaatga

SEQ ID NO: 20931 - DNA, 633 bp, Glycine max
  Peptide Sequence Number=SeqID_112616
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggatttcaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 20932 - DNA, 716 bp, Glycine max
  Peptide Sequence Number=SeqID_112617
aggactacacgtcctcgccagcgtagggctacacgccctcacctttagaggactacacgtcctcgccaacagagggttgcacgccctcacctttagaggactacacatcctcgccttcagaggactccacgtcctcgccttgagaggactacacgtcctcgccttgagaggactacatgtcctcaccatcagagggctgcacgccctcacctctcagaggactacatgtcctcgccttgagagggctacacgccctcaccttggaggactacacgtcctcgccttgagaggactacacgtcctcaccatcagagggctgcacgcccttacctccagaggactacatgtcctcgccttgagagggctacacgccctcaccttgggtactagttaccctcaccgttcagaggactacacggctaccgccctcaccttcgggactacacgtcctcaccttgagaggactacacgggggcatgccctcacctttagaggattgcacgtccttgccatcataggactacactccctcgccttcaaaaggcgacacgtcctgaacttcagagggctacacgccctcgcctttagaggactacgcgtcctcactttcattcttgggccaccccctgatattggaggagggccaactgtgcgagcacaaccagagagggaggctatcacacagctactatgcataccggggcaagatttcacct

SEQ ID NO: 20933 - DNA, 966 bp, Glycine max
  Peptide Sequence Number=SeqID_112618
gtcctctttccgaacgtggacggtttggtggacttagccgccattgatgatttcctcgcatatcaccatagcaaggagagtccagtagtggctatcttggcagatttgtttgacacctttgatcggaggtgtgagaaaaacagtgcacggattgtctgttgtttacccgctctctgtgtgtggttggtttcacacctattccaacaagacacaagacacccgtgtccgcttcaaagttatcactcatgcgccgaaaaaggaagagtcaattgggaccaacatttggctgggataggaggcagcgcaatcaagtggtttcctcgatggaaggaaggcaaggagggagttcttttctcgtgtgggaactaccctaatgttccattgatagggacgaggggttgtattaactataatcccgcacttgccataagacagctggggtaccccatgaggggagcgccaacagaagaaagtctctcgcctttccttgtgagggatctaggcgcacaaagtctcaaggtgatacaaagagtccacaaggcgtggagaagtccgttgaggaaagacaaggagcttagagggcatccaaaatggcgtcatcggtggttatcatggatggctaagagttcacacgtgaggaacttcgaagctccagaggaagatgaagaagtccgagctctaaaattagagctagggaaggcaagactcgccaaggagaagttcaaatcagccgctacacacatccggaaagagtgcaccgagttacaagaggaaaacgcggcctctgcaatagcccttgaacaagaaaccaaaagggcccgcaaggaggaacatggtcgaaagaagttccgaggagcattgtggggtagcaacaatgagctcaagctccgaagagaggaaagagactggtcacgggtgcatggcatgatcttatggcacccgatcggaaccagcagcagagtatga

SEQ ID NO: 20934 - DNA, 504 bp, Glycine max
  Peptide Sequence Number=SeqID_112619
atgaccatgattacgccaagctcgaaattaaccctcactaaagggaacaaaagctggtaccgggccccccctcgagttctaaagccttcaggcgtaatctctcacccttcagataccaatagtgctcaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 20935 - DNA, 351 bp, Glycine max
  Peptide Sequence Number=SeqID_112620
atgtgtagtcctctaaaggcgaggacatgtagccctctaaaggtgagggcgtgtagccctacaaaggcgagggtgtgcagccctctgaaggcgaggatgtctagtcctctgatggcgataggtagtagtacccaagggtccacccttatgagaaagcaagagattgactcattgagagggtcggtcattcaaaaatattggacattagattggatgtaccctccactagaactgatccacaagagatgtaccctctcttgttctcagtcaaacccaagtagatgtaccctctacttgtaccacaaaggatgtaccctccaatgtgttaagacaaagatcttaggtgattaa

SEQ ID NO: 20936 - DNA, 264 bp, Glycine max
  Peptide Sequence Number=SeqID_112621
atgtcaaagcttatggtaactgtggatatcgggtcggttgccggtttattaggtatgggtgaagacttttggtcggtggttcgttaccatcttcttaaagaacttgggaatttctcagaagactatacccgactctttggtggcatggagagatttgaggaattaagaatgtcactacatgttgatgggttaaccaaggtgactatggataagtggatggatataacagacatgggacatgtcattgcttcaaggtttatttaa

SEQ ID NO: 20937 - DNA, 683 bp, Glycine max
  Peptide Sequence Number=SeqID_112622
atggtgaaagttggaacctcttacgtgccgatcaacgtctcattttcgccaaaagttggcccagggcttccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 20938 - DNA, 374 bp, Glycine max
  Peptide Sequence Number=SeqID_112623
gtccccctgcggctgcggagggcccccctcacaatgaggtctcgttgttcttggaggagggccctcctcctttcttccagaccgcgaatgcggtccaggatccgttgcatggctgcagccacaagcgctggatcgatgggaggcaggtgctcccaaaaggcagccaggatggagcaatcctcactcgacagctcgaaagcggatcagtacaaacccacgtgatccgtattcgcttacgtaccaggcgtgcttcgtcgtaccctgacaactcctctttcactggcttctacttgtcttttactggcttatttgtacccagcttcatgatggaactcccctcggccaatcgtcactcgacagcagctccgtcctag

SEQ ID NO: 20939 - DNA, 442 bp, Glycine max
  Peptide Sequence Number=SeqID_112624
ggccctgcaccttgggtactagttaccctcaccgttgagaggactacacgtcctcgccttgagaggactacgcgtcctcaccatcagagggctatgcacgccctcaccatcagaggactacacgtcctcgccttgagagggctacacgccctcatcttggagggctacacgccctcaccttgggtactagttaccctcaccgttgagaggactacacgtcctcgccttgagaggactacacgtcctcaccatcagagggctgcacgccctcacctcagaggactacatgtcctcgccttgagagggctacacgccctcatcttgggactacacgtcctcgccttgagaggactacacgtcctcaccatcagagggctgcacgccctcacctctagaggactacatgtcctcgccttgagagggctacacgccctcaccttgg

SEQ ID NO: 20940 - DNA, 369 bp, Glycine max
  Peptide Sequence Number=SeqID_112625
atggctgatcgaggagggggaggaaatagaccacaacgtaggactcttggtgactatgcttatcaacaaggaccaaagcattacaacaacatagtcattcctcctttcaacaacaaggttatggagccaccaccactcagtttgattggctcacacccctttgctggaatggatcatgaggatccatacacacatttgtctactttcatggagttacacagtaccatgcagattttgagaagcttcacggtagtttgtgttggatggttagttaatatagtggttactgggaagaagggttttatttgtattcacaaaggtgggttagtgcctgattggttgaatcacacgatttgggctacagtttaa

SEQ ID NO: 20941 - DNA, 231 bp, Glycine max
  Peptide Sequence Number=SeqID_112626
atgctaaagttgtcagataacatcataaggttccatagaagagttgttctaggtatactagaagtagtatctagaccttggagattaaccgtagggaactggttatgtgacttggatctagttaaccctacagggattgaacgagttcttattgaaaaagaccttctagccgattcatattcagacctagaggcttctatccttgatgaaaatgaattttttctattgaag

SEQ ID NO: 20942 - DNA, 268 bp, Glycine max
  Peptide Sequence Number=SeqID_112627
gaatttacaagatagtggaactctcaagcgggttgcttggggactggatgtaggcacaggggcgagctgttacttcatcttgaagcaaccttgctcacccgagcgagctggttacttcaccatgaagttatttagtggcccaggcgagccaggggctagcttggacaagccagggggaagtaaagataaggacactaatttcgttcaagcgatcttgctattcggtcaggcaactggcgaacaaggaagtgaaaccgagaaaacataa

SEQ ID NO: 20943 - DNA, 345 bp, Glycine max
  Peptide Sequence Number=SeqID_112628
atggataggaaaatgcaaggatcatgcatgagtgaacataacatgcggactgtgaaaatagaatgtatgcagttggcagaacaaaagaatctaatggaaaggatccaaaagtccccttctagtgacaactccaaagggtggtttcatgtaactttactagcttctagagatatcatcctcttaggtaatacattgtggcgatatggactatcagcgacaatgcatcaccaaaagaggaaaactctagatgaggcttcactattattaagcgagtcggagacccagcatgaccacagatcgacctccactccttatggctcacatataccggggtatagggcctaa

SEQ ID NO: 20944 - DNA, 651 bp, Glycine max
  Peptide Sequence Number=SeqID_112629
atgaatttcggcgagggacgcctgaacgcatggtggcggaaaacgtttgaattccgccatcatgcgggtttatctcgggaaagctccgcaccgccaatcagaaccggagacacgcccgtgtcagatatctccgactatatcgtctctcatttcaagcgctcctctcgtgaaatcggcgaggtggaacggcgcattctcgagctggcgcaccagaaaaagctggtttcgagcgatattaatgcggaattttccgccggcgccagtttcggcgacaggctggcagacaagatcgccagggtcggcggttcctggagtttcatcctcggcttctgctttttcctgattttctgggctatcatcaacaccatcgtactgaccacccgcgctttcgatccctaccccttcatcttcctcaatctgcttctttccatgctggcggccattcaggcgccgatcatcatgatgtcgcagaatcgtcaggccgcccgcgaccgcttcgaggccgccaaggattatgaggtgaatctgaaggcagaactggaagtgctttcactgcatgaaaagatcgatgtgaaagtgctggccgaactggctgcgctgcggcaggaccttgcagcacttcaccgccacgtcacccgcagggaagactga

SEQ ID NO: 20945 - DNA, 108 bp, Glycine max
  Peptide Sequence Number=SeqID_112630
ttagagactcgaaatcgggcaaaagcagaataccctgatcaacgaaatcttgaatcatctatctcaaaccaagaaaaagatattgaaaacgattattggatccgctag

SEQ ID NO: 20946 - DNA, 807 bp, Glycine max
  Peptide Sequence Number=SeqID_112631
atgtggatgggtttggtggacctggcagcgatcgacgcttttgtcgcctatcatgaccacaaggaaagcccggttgtcgctatgctagccgacctatatgacaccttcgaccgaaggtgtgagaagagcagtatgaggattgtttgttgtactctagctctttatgtatggttggtttcacacctttttcgccaagagttgaggcatgcttgcccgctagaaagccaccgttcatgcacagagaaaggacgggaaaattgggaccaactcttagcaaacaaagaaggagcatctgtcaactggttccctcggtggaaagaaggaagaaccggagttcttatttcgtgcggaggatttctgaatgttcccttgatggggacgaggggttgcatcagttacaatcccgttcttgctataaggcaacttggctaccctatgagaggggcgccactagagtatgagctcgtgcctaaggtctgcaaggcatgggaggtgttgcaaaagaaggacaaggaactcaggggcagtaacaatgggaccatcggtggctatcgtaagtggttaaaagcccacgtgcaaggtttggattggcttccaagtttgagaaccactaaaagagaggaagttgaggcaccggaggaagacaaagaagtgcaggcccttagggtggaagtcgagcaagcccaaacagttaaagaaaggttcaaatcagcagctctgaaaatccgaaaagagaatactgaactgagagatgtaaatgtggctaccaccaaagccttggaacgagaaactaagagcggcttgtag

SEQ ID NO: 20947 - DNA, 325 bp, Glycine max
  Peptide Sequence Number=SeqID_112632
tttgatacctgcttcgaagatctctaccttaacccagggattttttgtcggtgctgtatctgataactttgacgaaaggattcagcagaagatttttcattccgagattgtcgtagacaatgttaagctttctcaagaaatgaaaagttttcagcagataccatcaatccgatcctttattgatgaagacgggaatgattctatgacgaggcagattcaggataattacagagaaattaagtcagatattctcaatatcatcacagatgaaatggaccgaataaaaaatgatcctgaattgcagcatttattgaaatcggattaa

SEQ ID NO: 20948 - DNA, 722 bp, Glycine max
  Peptide Sequence Number=SeqID_112633
tgaacctctacgtgccgatcaacgtctcatttcgccaaaagttggcccagggcttcccggtatcaacagggacaccaggatttattttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcgcgagcgaaatggcttacgaacggggcggagatttcctggaagatgccaggagatacttaacaggaa

SEQ ID NO: 20949 - DNA, 76 bp, Glycine max
  Peptide Sequence Number=SeqID_112634
agatatattcatcaatttcgatcttttcgatcgagatgtatgggattcatgggtctatgtgtctataatagatcct

SEQ ID NO: 20950 - DNA, 444 bp, Glycine max
  Peptide Sequence Number=SeqID_112635
atggcttccatgatggatgccatgttaggaatgagacatcttatggagaataacgtggccaccgctgctgctgacgagaaagaagcacactggggcacatcagcaaccgccattttggaatacaaccgagtggcttacccttatggattaccacctaattacatgccactagtcatgcgtgatgacgcgggtcatgtcccttcccccatccttgatggggaacctcctcgacagtcggacgaggttcacgaggatcgtagagagtatgcccaaggagacatcgatttctaccccccgggtccccatcgaggggccggcacccaacatactgccttagcccaacctcccagcacaaccaatattcttgtccacagaaggaccacccccgacagcggaagaatgaaggaaactcgatctcatcgaagagagattgagagctattga

SEQ ID NO: 20951 - DNA, 534 bp, Glycine max
  Peptide Sequence Number=SeqID_112636
ttcttggagacccgattagtgttagaggagggccaggagtgcgagtttagtcagagaaggaaccgggctgatggatttgacaaggaggccattgcccagctgttatgcataccgggtcaggatttcgcccggaccgctgccgggagacgggtgcggatcatgcgcaccagcatgaccaccttgacccagatgtggatgacgttgcttctcaacaatgtcctgcccagcgatcataactttgacctccctctgccgaagtgtcagttggtgtatgccatcctgacacggatgagcgtccatgtggctcagttgatcgctgacgccatttatttatttgtaggtatgccacctaccagacaccctctagacccggataagtctaacagggccttggggtttccagcattgatcacgggtctctgccagtcattcggggttcccgtcacacctagtaaggtgattcgaccgccgatcacccgggccttcattgagaagtattgcacgcctagacaggcacagggtgatgcaccgtag

SEQ ID NO: 20952 - DNA, 321 bp, Glycine max
  Peptide Sequence Number=SeqID_112637
atgatacgcggagataccttacagttatccgcacccttttgtcatccagaggcggcgggcccgatgacaagcagagacaaaatttggtcattctgcacccttgtatcatccagaggcggcaggcccgatgatacgcggagataccttacggttatccggacccttttgtcatccagaggcggcgggcccgatgacaagcagagacaaaatttggtcattcggagggggtatcatccagaggcggcgggcccgatgatacgcggagataccttacggttatctgcacccttttgtatcatccagaggcggcgggcccgatga

SEQ ID NO: 20953 - DNA, 126 bp, Glycine max
  Peptide Sequence Number=SeqID_112638
atgaactcgctaagcgagcatgctgcgctaaaactcgctaaacgctcttaccgcactaagcgagttcatcctttgaggatgaacacttatcctcttgctgaactacctgtggctaagcgaggctga

SEQ ID NO: 20954 - DNA, 336 bp, Glycine max
  Peptide Sequence Number=SeqID_112639
atgtcttccaaggttattttgatgatgccaaagaatcaagagttaagcaaagtttcaagcaaagattcaagaatcaagtttcaagattcaagattcaagattcaagaaaaatcaagatcaagattcaagactcaagattcaagaatcatgagaagactcaatcaagataaagggtacatctacttggggattgttatactgagaacaagagagggtacatctcttgtggatcagttcaagtggagggtacatccacttgggtgttcaaagagaacaagggaaggtacatcccttgaggatctttggcttgtaaaggattttagaaggttgaaataa

SEQ ID NO: 20955 - DNA, 292 bp, Glycine max
  Peptide Sequence Number=SeqID_112640
ggaggacccttgggtacacgccctcgcctttagaggactacatgtcctcgccttcaaagggctgcatgccctcgccttcagaggactacacatcatcccctgtagaggactacacgtcctcacctttagagggttgcacgtcctcgcctttagagggccgcacaccctctcctttagtgggttagacgccctcaccttcaaaggagggcgatcaactgtgcgagcacatccagagagggaggctatcacacagctactatgcatactggggcaagatttcacccgtgccgct

SEQ ID NO: 20956 - DNA, 252 bp, Glycine max
  Peptide Sequence Number=SeqID_112641
atgattcatttgcttgaggccggatggggacgtcgggttcaccttagcaacaacgctggtagcggcaattgcaaccgcattgggcttccattatcttcttcacgctcatcatggcctccatcattgtggccattttctctttcatggccttccatgtcggccttcatcttctcttgcacctcctctgcttcacccattactctagctctagcacgagttcggaaagaatgcaatgagcaatgcaaccaatga

SEQ ID NO: 20957 - DNA, 299 bp, Glycine max
  Peptide Sequence Number=SeqID_112642
gagaggtgactatcaacttggatgacgtggcatcgttgctgtatttgtcgatcataagggtgttccatagcttcaagcagcttcatgtcgacaacattgtctatatgttggtggaattactcgagagtgagacttacacttggggtgttgttgcacttgtgtatatgcatgataatttaaataaggcatcaaagagcacgacgaggcaacttgtaggatatatcactctgttacagtgttggatctacgagcatttcttgtttattggttctgccatagctgtcaaggattatgactag

SEQ ID NO: 20958 - DNA, 381 bp, Glycine max
  Peptide Sequence Number=SeqID_112643
atgacccaagagctggtagcccgcggagacaccttacggttatccgcacctcgtcattcagtgacccaaagacaaaatttggtcattctgcaccctttgtcatccagaggcggcgggcccgatgacacgcggagacaaaatttggtcattccgcacccctttgccattcagacacaatcgtgtccgatggcacgcagagacaaaatttggtcattctgcacccttgtgtcatccagaggcggcgggcccgatgatacgcggagataccttacggttatccgcacccttttgtcatccagaggcggcgggcccgatgacaagcagagacaaaatttggtcattctgcacccttgtgtcatccagaggcggcgggcccgatga

SEQ ID NO: 20959 - DNA, 147 bp, Glycine max
  Peptide Sequence Number=SeqID_112644
atgggtcggcgttcgcttactcgaacccccttagggatactaggctgcctcccagctgcgcttctcgcttgttcggagctggacatgggacgacgatccgtcgatcatgggcctagcctctactcgcatccgtccctaagtacctga

SEQ ID NO: 20960 - DNA, 552 bp, Glycine max
  Peptide Sequence Number=SeqID_112645
atgaatgtcagagccctcatttcagggcagattacttctatggcccagtctaactcctcaagacttggatttcctgctcttagcacagctttatgcaggaccagaggagttgcctccgacaatcttgtctttgaacgactaagcccattcattaatttggcatacataaggaagaattgttggaaccctgatgatccaacaattattattaggggggccagaagaccaagggcaaggccagttgagactccttctacatcagcagctcctcctccagctcgtattgcagcagctccttctaccccacctcctgtagagtttcaacgtttcgaagccatgcttcgaagcatacatcatgggcagattattttgctgcaaacctggccatggactcaacctcctcttcacagggacgacgaggatcccgccgctcaggtaccacatcagccatcggatgagtcatcagagtcttccacccctgagcccttgatcaggaagaggagggaggaggttcagacatgggacacccaggaccaatcacaggatctttaa

SEQ ID NO: 20961 - DNA, 210 bp, Glycine max
  Peptide Sequence Number=SeqID_112646
atgaagaagatcctaggcctacaagctccaatggagcttgcatcacaacccaaatttacgttgcatgaagtgaagaccgtaaacactgtgcagtttcggaggtattgtgcgtctgtccacataaggaccttgggagaccccattatttctgtgcctatgttgctatgtggttggcctaagaattgtgtaaccgagcatgaaagcaaataa

SEQ ID NO: 20962 - DNA, 899 bp, Glycine max
  Peptide Sequence Number=SeqID_112647
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattaacttgaacccaaacatatcttcattccacaaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 20963 - DNA, 183 bp, Glycine max
  Peptide Sequence Number=SeqID_112648
atgtcgcaacctaccctacaattggagtgtgaaggcaacatcgataagccaaagcgtccatctccaagggagaaaatgagtggagtcgccaccaatgtttatttgaggaaaacgttagaaaaactgaaaagaggaaaggtattagcaccctacacacccgtcacaagggacgatagcctttaa

SEQ ID NO: 20964 - DNA, 567 bp, Glycine max
  Peptide Sequence Number=SeqID_112649
atgaagggcatcacaggagcaccctacagggcacgttgtgatggtttgaccgtcacagatgtgtcctggttgccgtacacggagcatcggggtgttagggcgtttcaggagatttcatcgttccagggtcagctaagatggggtcctatgatcgtcacagttcgaccggagagggtggtacgccagttcggttacatccagagcatccctccgccgcctgttagtgcacgattgtcacacgatcagatagatgacaggtggatggagtttgcggatcacttactacctgcgggtcagccttgtctagtgcctgggcaggcagctgaccagcagagggatgcaccagctgcagaccctgaggactacatacagccgcccagcccccaggatgattacgagggatatgaggcgattgcacagaggttggagcgtgtgctcaaccttaggatagtcactgcaggcacagagttatatgacattatgcaggactgcctgacgatcgcgagagggagacccagtgctgatgggacggtcagggctcgtcagagacgccgcacggaccattga

SEQ ID NO: 20965 - DNA, 60 bp, Glycine max
  Peptide Sequence Number=SeqID_112650
aatgacagtggcagggtgcagggagtaagattctggggaggagccgtcgagccgacgtga

SEQ ID NO: 20966 - DNA, 336 bp, Glycine max
  Peptide Sequence Number=SeqID_112651
atgtacctcgtattcaacagtgctttgaaaggacttgatgatactccacaacctaaatccaaggctgctactaggtggattgttgttgagtattttaatgaagttagaccattggaagcagagagattcaaggcacttcacatccaccaatgttgtaaattttacgttaacattggtttttttaaaaccaatgttaacgataatactttcaacatcggatgtgacgacgaagacgatgagaagagagggctggcgatagcgacgatatgtgagggttcgaaagaggtttgggcacaaagagagacaatgagatcttgggcgcaagagctcgagtga

SEQ ID NO: 20967 - DNA, 453 bp, Glycine max
  Peptide Sequence Number=SeqID_112652
atgaatcttgaggatctcggccttagctttgtcgagaccactcttcaatttttctcagccttctctatatttaccttatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 20968 - DNA, 239 bp, Glycine max
  Peptide Sequence Number=SeqID_112653
atgtcggactctgacattcgggctgttttccccttggaccgggcaattctaaccgagcctgaaggggcagtcaatcttggtgcagccccttcgtctaaaagcgggaggaaaggtatatttccatgggacacctctattgctttaataggaaaatggcgtcggcttgggcactgtcggggggtactcagacctggagccgatcacaatcctagtgaaacatattaccagggcttctgggg

SEQ ID NO: 20969 - DNA, 453 bp, Glycine max
  Peptide Sequence Number=SeqID_112654
atgaccaccctgacgcagatttggatgacactgcttctcagtaacatcctccccaacgatcataattccgatcttccccttgccgaagtgccagttggtctacactatcttgacccagggatcatgcctctcagacactcagtgggcccagaaaagtccaacagagcactggggttttcggccttgatcatgagcctctgccagttctatggagtgtcggttactcccacaaagcttatccggcctcctattaacagggccttcatagagaagtattgcatgccaaggatggagcttcagatgcacaccgaccagcaggcagccaatcataggggggcaggacccgcaaggacccctaaagaggaagatagagctcaggaacatgatgacatggccgatgtgatggacttcttccttgtgaagtcgcttggcgaggatcacctaaaattgtga

SEQ ID NO: 20970 - DNA, 144 bp, Glycine max
  Peptide Sequence Number=SeqID_112655
atggctcaacgcatcaatgaaggaagaggtgtagaaaaaggtgcatgttggagaggcttgcaggacatgcttattactgcttcttggatggatactctggatacaatcagattgcagtggaccccaaggatcaggagaagatag

SEQ ID NO: 20971 - DNA, 441 bp, Glycine max
  Peptide Sequence Number=SeqID_112656
atgaccatgattacgccaagctcgaaattaaccctcactaaagggaacaaaagctgttataatgtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 20972 - DNA, 207 bp, Glycine max
  Peptide Sequence Number=SeqID_112657
atggacaactttcagtcttgtgtcattctaggagaatcggatgtgaatattctctttccgattcctcgcctgtggctcccagcagtgcccgctcccgatcccgctcctgttatcgattatgcactagacgctgtgattaatagcccccttgagcaatttgagattatcccgttgattcctatgctctattcccgactcgaaatctag

SEQ ID NO: 20973 - DNA, 594 bp, Glycine max
  Peptide Sequence Number=SeqID_112658
atggaggtcatgatgagcatgaagaagataatggaggtcaatgcggctgcagtcgccgctactagtgtcgttgctaaggtggacctgactcccccatctagcctcaaccaaataaatcatccaacctcggatatgagcaagtatgccttcctgccatatggcttgccccccaactttgcaccacccagtgtggtgcgccctcccgataagaatgtcaattactccactcccgtactcatcgagaaccaacaacctcgatccgatcatgcatatgtccctcaactcatgggggagacacatgaaataccccaccacaatctagccgactttgagtctctccttggatatgccgctgaagggcaagcagttggtggtgtgcccctaccaaacactttggagggccctcagttcctccaactaccacaacccttgcattttgtggcaggaagaatccctcttgctatggcggagaagggaaagttggatcatatagaggaaaggcatagagccgttgaaagaggtggaagttatgctttcgctaacacggcggaattgtgcttagtacctgacatcgccatccctccaaagttcaag

SEQ ID NO: 20974 - DNA, 214 bp, Glycine max
  Peptide Sequence Number=SeqID_112659
cgcaacagggggatttaccagcatggcaatatcctcaaataatcatacaacaaaggtgatgcaagctccattggagcttgtaggcctaggatcttcttcatcaatggattcctttgcttcttggaagatgaatggcagcggaatggagaaggaagagggagaggagacgccacttcaaggagaagatgagtctagaagaagctcaccaccatag

SEQ ID NO: 20975 - DNA, 462 bp, Glycine max
  Peptide Sequence Number=SeqID_112660
atgtcttccaaggttattttgatgatggcaaagaatcaagagttaagcaaagtttcaagcaaagattcaagaatcaagtttcaagattcaagattcaagatccaagattcaagaattatcaagatcaagattcaagaatcaagagaagattcaatcaagataagtattaaaaagtttttcaaaacattgagtagcacaagaagttttcacaaaatcattaccaaagatttttactctctagtaatcgattaccaaaagagggtacatctacttggggattgttatactgagaacaagagagggtacatctcttgtggatcagttcaagtggagggtacatccacttggattttcaaagagaacaagggagggtacatcccttgtggatctttggcttgtaaaggattttacaaggttgaaagaaatctcaagaaccgcaggttgcttggggactggatgtag

SEQ ID NO: 20976 - DNA, 108 bp, Glycine max
  Peptide Sequence Number=SeqID_112661
gaaaaggaaggagaagcttgccacccagctcgcccaggcaaactaggttgcttcctccagaaggcaccgccttctggagaacttccgggaaggcccaaatgggcctag

SEQ ID NO: 20977 - DNA, 446 bp, Glycine max
  Peptide Sequence Number=SeqID_112662
ctcagttggaggtgggcaacaggggatggtgggtttatgcacgatttgtggatgtggaaaacttgtggtgcaccatcgcccgaccgccacctagtaccacatgtgatggagtggtacctggagatatgtcgcgggggtcaggagaccttggggacgtcaggcgagctcctggcagtcaacagataaaaggaatagagaccacaaagcaaggaggcttgtgtggtggctggccagctgtgaatcttgctgtggaggcctctggtaatcgattaccagtctgtgtaatcgattacacagaggaatgggtcactggtaatcgattaccaaagaggtgtaatcgattaccaggcttgaaagctatgagggctgtggaggcctctggtaatcgattaccagtctgtgtaatcgattacacagaggaatgggtcactggtaatcgattacag

SEQ ID NO: 20978 - DNA, 496 bp, Glycine max
  Peptide Sequence Number=SeqID_112663
gcaataagcttaccaaggcgatgatcagtagctgtcgagagatgatcagcacactgggactgagacacggcccagactctacgggaggcagcagtggggaattttccgcaatgggcgaaagcctgacggagcaatgccgcgtgaaggtagaaggcctacgggtcatgaacttcttttcccggagaagaagcaatgacgttcgccgtcaaatcccagggctcaaccctggacaggcggtggaaactaccaagctggagtacgagacgaaagctaggggagcgaatgggattagataccccagtagtcctagccgtaaacgatggatactaggcgctgtgcgtatcgacccgtgcaatgctgtagctaacgcgttaagtatcccgcctggggaaaccttaccagggcttgacatgccgcgaatcctcttgaaagagaggggtgccttcgggaacgcggacacaggtggtgcatggctgtcgtcagctcgtgccgtaag

SEQ ID NO: 20979 - DNA, 750 bp, Glycine max
  Peptide Sequence Number=SeqID_112664
atggacggagggctggcggcgatggtgacggtggcgcggacgtgcgtggacgcggtgcacctcttgcacgtgtggctgcagttcaggctggcgtacgtgtcgcgggagtcgctggtggtggggtgcgggaaactcgtgtgggacgcgcgtgacatcgcgtctcattacctgagatcgttgaaggggttctggttcgacgcattcgtgattctcccatttcattcactctatcccacactgccaagtacaaacactcgcttctttcgttctatcttctttctcactcgcacgtgtttgccacttcggtcttcactttggagattggaggagaacagtggggtaattgaaaaaagtaacgttaataacaccttttcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcacaccccgtcagtagctga

SEQ ID NO: 20980 - DNA, 303 bp, Glycine max
  Peptide Sequence Number=SeqID_112665
atgcttgccaaacgcaaagagctgacctttggcaatggcgatcccaactccacctccggctaccttgtccctggctactacgtcttcgccaaaaacaacgcctccgccagcgacttcaaacgcacggtaaacgccagccatgaaaccaacgccctggccgtggccaacaagcaggtggatgtcgcgaccaacaacaccgagaacctcgacaaactgaagacctcagcaccggacaagctgaaagagactcaaggttatctggaaatcacctctcatccccggcgacccgattgtctggcgtaa

SEQ ID NO: 20981 - DNA, 420 bp, Glycine max
  Peptide Sequence Number=SeqID_112666
atgggcccatttttgtctgacccgcagaaacccctcgtgggaggcataggccgtctagaagaaaaagaccgcccccacatgttgtctcgtgggggttatgattatttagaacagaagctcatggctgagaagacaaagaaaagattgaaggaatctgctcagtccagaagcactgagggcgtcattgaccctccatctcccatcagacgacacgtgtcacagggttcgtttgtcccccatggacgtcaggatctcctaactgttgccattgggcgaccagaacaccctgaccatgtacgtgctgctggagtcagtgtcaccatcaagcaatacttcggattggttcaacgaagctttcgcagttcgtcctccatgcctcccaaagaactcgagcagctgactcaacaaatcagggactag

SEQ ID NO: 20982 - DNA, 600 bp, Glycine max
  Peptide Sequence Number=SeqID_112667
atggtggatattgatgtttctgagcatcagattgccaaggaaatcactgccaaacgagtccagcattggccaaagaaagggaagctttctgcagggaagctaagtgtgaagtatgcaatcctgcacaggattggcgctgcaaactgggtacccaccaatcatacttccactgttgccacaggtttgggtaaatttctcattcagaatcatttgctgtcaaaattacccattgccttcccaactgtattgtgtggcattatgttgagtcaacatcccaatattttaaactacactgactctgtgatgaagagagaatctcctctatccctgcattacaaactgtttgaggggacacatgtcccagacattgtctcgacatcagggaaagctgctgcttcaggtgctgtatccaaggatgccttgattgctgaactcaaggacacatgcaaggtgctggaggcaaccatcaaagccaccacagagaagaaaatggagctggaacggctgatcgaaagactcacagaaagtggcattgatgatggagaagcagctgaggaagaagaagaagctgctgagagagagatgcagcagagatactga

SEQ ID NO: 20983 - DNA, 204 bp, Glycine max
  Peptide Sequence Number=SeqID_112668
ggcttccccggtatcaacagggacaccaggatttatttatttctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 20984 - DNA, 648 bp, Glycine max
  Peptide Sequence Number=SeqID_112669
atgccgaagaagcccacggcgcaggatgtgcggctggccgaagtagcccaggccccagcccatcagcgagatgatgccgatgaaggtggcgcccttgagcatgtcgaagttggccgggttcgccgcatcgatggcagcgaaggtggtgtcgaagccgccagtggagatcagcacgatcaccggggtgaggatcagcgcaaagatcatcagcgaagcctgcacggtgtcggtccagctcactgccaggaaaccaccgacgaaggtgtaggcgatggtcgctgcggcaccggcccacagggcggtttcgtacggcatgccgaaggtgctctcgaacaggcgggcaccggcaacgatgccggaagcgcagtagatggtgaagaacaccaggatcacgatggccgagatgatccgcaacacgccgctgttgtcttcgaagcggctggagaagtagtccggcagggtcagtgcatcgccgttgtgctcggtctgcacgcgcagacggccagcgacgaacagccagttcgtaggcaccgacggtcaggccgatggcaatccaggcttcggacaggccagagaaatagatggcgcccggcaggcccatcagcagccagccgctcatgtcggaagcaccggcggaaagcgcggtaa

SEQ ID NO: 20985 - DNA, 1410 bp, Glycine max
  Peptide Sequence Number=SeqID_112670
atgaaggactctatagttctatactcagctttgggaaggggacacctagtttccatggtggaactaggcaaactcatactaacccaccacccttcactttccatcaccattcttttcctaaccccaccccccaaccaagacacacccacctcccccaccgccttcacctgcgacgccacctccaaatatatcgccgccgtcagcgccgccaccccctccattaccttccaccgcatccctcagatctccatccctactgtcctccctcccatggccctcaccttcgagctctgccgcgccaccacccaccacctccgccgcatcctcaactctatctcccaaacctcaaacctcaaagcaatagtcttggacttcataaactacagcgccgcacgtgtcactaacacgcttcagatccccacttacttctactacacttccggcgcctccaccctcgccgttttcctttatcaaactatctttcatgaaaactacacaaagtctctcaaggacctcaacatgcacgtcgaaatcccagggttaccgaagatccacaccgatgacatgccggagacggtgcaggatcgtgcgaaagaagtttaccaggttttcatcgacatcgccacgtgcatgagggacagtgacggggttatagtaaacacgtgtgaagccatggaagagagggttgtggaagctttttccgaagggttaatggaaggaaccacgccgaaagtgttttgcattggacccgtcattgcttctgcttcttgtagaaaggatgataacgagtgtttgagttggctcgattcacaaccgagtcatagtgttttgtttctgagtttcggaagcatggggagattctcgaggactcagttgggagagattgctattgggttggagaagagtgagcaaaggttcttgtgggttgtgaggagcgagttcgaaaatggtgactcggttgaaccaccaagtttggacgagttgttgccggaagggtttttggagaggaccaaggagaagggaatggtggtgagggactgggccccacaggcggcgatactgagtcatgactcggtgggtgggttcgtgactcactgcgggtggaactcggtgttggaggcggtttgtgaagctgtgccaatggtggcgtggcctctctacgcggagcagaagatgaataaggtgatcttggtggaggaaatgaaggtgggtttggcggtgaagcaaaacaaagacggcttagtgagttctaccgagttgagggaccgagtcatggaactcatggactcggacagagggaaagaaattagacagaggatttttaaaatgaaaatcagtgccaccgaagcaatgacaaaaggtggatcttcaatcatggctttgaataggaaatataagactgatcattaa

SEQ ID NO: 20986 - DNA, 240 bp, Glycine max
  misc_feature (10)..(10): n is a, c, g, or t
  Peptide Sequence Number=SeqID_112671
atgtggcttncaagagccaatgaaccggcaagcagtcttctggtcatatccgcttggttggtgcaaaccaaccggcgggcatcatgcacagaaaaatcaaacttccaatcatcgtccagtgcaccttcaaatgggtcaatgattgaacgagaggagaagaggtttgtgtaccgtatatgttgttcttccgatgagaacaatgaggaggaggaaatggaggaaggaattggagtatcctga

SEQ ID NO: 20987 - DNA, 207 bp, Glycine max
  Peptide Sequence Number=SeqID_112672
atgtcacgaaaccttatggattatgcaatcgtcccctcttttggcttccggaatgttacggaactttacggattgcgcattacacttccctttcactcccgacatgtcgcggaacttcacggattgcctaaccgatgggtgccaagtacctcgaaggtggtcatgccaaaggtcggcatcccaccaaataggatgggccccggatga

SEQ ID NO: 20988 - DNA, 337 bp, Glycine max
  Peptide Sequence Number=SeqID_112673
ggatcgcaccccacaagacacccagtggacccgggaaaagtccaacagggccctggggtttccagctctagttacgggcctctatcaatcctacagggtgcccggatcgcgcctgcaagacacccagtggatccgaagaagtccagcaggttctacagagtacctgtcacctccagcaagggcatcaggccccctactaatcgagctttcatcaagaagtactgcgtctccaggcaggcgcagggcgaaacaccacagcagcctggggatggccggcagcgggcaacagacgccccaccatcacctctagagttcacctcagctcatccacaaaaag

SEQ ID NO: 20989 - DNA, 1056 bp, Glycine max
  Peptide Sequence Number=SeqID_112674
ggtgctccagtggcttcctgtttctatcagctgtccctccctgttcagctactgacggggtggtgcgtaacggcaaaagcaccgccggacatcagcgctggcaagtgtagcggtcccgctgcgcgtaaccacccccccccgccgcgcttaatgcgccgctacagggcgcgtcccattcgccattcaggctgcgcaactgttgggaagggcgcccccgtgcgggcctcttcgctattcccccagctggcgaaagggggatgtgctgcaaggcgattaagttggggcgaattggagcttccccgcggtggcggccgctctagaactagtggatcccccgggctgcaggaattcgatctcgccgattatttgctacacggcggttacgatacacacctgcggcgcttgcgccggttgctggcgcagcgccaaagtatgatgcgtcaagctatcacccatcatttcccgtccacggtgaaagtcagccaacccgacggggatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcatagaggggtaaagcctggggtgcctaatggaggagggctaactcacattaattgcgttgcgctcactgcccgctttccagtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcgaaaatggcttacgaacggggcggagatttcctggaagatgccaggaagatacttaacagggaagtga

SEQ ID NO: 20990 - DNA, 354 bp, Glycine max
  Peptide Sequence Number=SeqID_112675
atgtttgataaacaggcagctgtgtctccagcaaagcctccagataggccggatcctgaggtggacgatcccctatatttgatgacattgaccatcccacaactttttttgaagcctttccaggttatgtgggatgctatcgtgattggggtgtttaatcaacacttcccattttacatcaagcatgaagatctctccgaaactgcacacgatggtcaatgtctcagcatatctattatacaattgtggattctgttaattaggaaagctttgaaaagtgttgtttttcaccttctcgctaagccaatctgttggcttagcgagcattcactaagcgcaacactcatgggctaa

SEQ ID NO: 20991 - DNA, 235 bp, Glycine max
  Peptide Sequence Number=SeqID_112676
gatgaggctgctacttcaccttcctctagtgaaagtgaagaagcaaaaggggaagaatctagtgaagaaatctacccccaagaagaaggacaaccattagtggttaagagaagtacacttgctagcattgccacacctcttgggcttgagtttattcctcaagtaaagaagttgttggatgagggtttggtttgcaagagcttaaatccttgtgctttgttggtgcccaaaatag

SEQ ID NO: 20992 - DNA, 153 bp, Glycine max
  Peptide Sequence Number=SeqID_112677
atgggtgccaagcacctcaaagcggtcaagcaaaggttgcatgccatcaaacaatggtccccggatgaaattaggcctaaattacaaaacctcgatccctcgtcagaccgaatcaatccaagcttcgtcctcagatccctcttgttggactag

SEQ ID NO: 20993 - DNA, 291 bp, Glycine max
  Peptide Sequence Number=SeqID_112678
atggtggaagaatttgaagagatcctaggatgccctctaggggggaggaaaccatacctcttcacagggttctatccctcattagctagaatttcaaagatagtccaaatctcagcgcaggaattagaccacaggaagcaagtcaaaaatggggtggttggaataccgagaaaatatttggaggcaaaagcaagaatcttggcagcgattgacgcttttctcgcctatcataaccacaaggaaagcccggttgtcgctatgctagccgacctatatgacaccttcgactga

SEQ ID NO: 20994 - DNA, 362 bp, Glycine max
  Peptide Sequence Number=SeqID_112679
agcacactcaggaagttcattacatgggaaatcaacagagacaaggatacaaccaaggaggattttcgagattccagcaaggtccctataatcagcaagggcaatggagatcacaccctagcaatcaattcaataaggaccaggccctgaaaaaccttgagatccaggtgggtcaactggccaagcagttagctgagaagtcatctagcagctttggagcaaataccgagaagaatcctaaagaagagtgcaaagttgttataataagaagcaggaagcttgtggtggctgaggatgaggatgttgttgctttgaaggagcaagtttctttgaaggacactacttataaaaaagaagaatga

SEQ ID NO: 20995 - DNA, 536 bp, Glycine max
  Peptide Sequence Number=SeqID_112680
gactacacgtcctcaccatccagaagggctgcacgccctcatcctccagaggactacatgtcctcgccttgagaggggctgcacgtcctcaccttgggtacaagttaccctcaccgttgagaggactacacgtcctcgccttgagaggactacacgtcctcaccatcagagggctgcatgccctcacctccagaggactacatgtcctcgccttgagagggctacacgccctcaccttggttaccctcaccgttgagaggactacacgtcctcgccttgagaggactacacgtcctcaccttcagagggctacagtcctcgcatcagaggacttcatcctcgccatcagagggctgcacgcccttacctccagaggactacctgtcctcgccttgagagggctacacgtcctcaccttgggtactagttaccctcaccgcgagggtacacgccctcgccttgagaggactacacgtcctcaccacagagggctgcacgccctcacctctagaggactacataagtcctcgccttga

SEQ ID NO: 20996 - DNA, 444 bp, Glycine max
  Peptide Sequence Number=SeqID_112681
atggcttccaaaaagagaaagagtattggtacaaggcccacatatcagtatgatacaaggaggttccactcctttgaggcctggacccgatacacaaataatgttctaggaagacatatactgcctaagaggaaggtagaaatataccatactgagctggacgagtttaaggctgaattggagacgtgtaacttccataaatgccttaccaatttagttgacatcagcatagatctagttttggtgaaggagttttatgccaatctttacagccctaaaggaccttcaccaaagcaagtcagggtcagaggccacgtggtgaagattgatgtagacaacctcaacacctttctagagacacctgtggccaccctgggaagattctcaagtggtggaggtgtctctcatactcaactggctctactttcccacaccccggactga

SEQ ID NO: 20997 - DNA, 126 bp, Glycine max
  Peptide Sequence Number=SeqID_112682
atgcagaaaggtcttcggaccagacaatatctgaacaatacagaactgtcaccaggaaattatttgcaaaatcaagtcatgacatatctatggttcagaattaggataaaacacttacctgtgtga

SEQ ID NO: 20998 - DNA, 756 bp, Glycine max
  Peptide Sequence Number=SeqID_112683
gacttccagctagtgccgactgtgaaagagtttaaagaaatcttgggatgcccactgggcggaaggaagccatatcttttctctgggttctatccctccacgacaagagttgccaaggtagtgaaaatctcagcacaagagttgaaccagcaatcgacgtttttctcgcctatcataaccacaaggaaagtccggttgtcgctatgccagccgacctatatgacacctttgaccgaagatgtgaagaaagcaatgcaaggattgtttgttgtactccagctctctatgtggggctggtttcacacctttttctccaagaaggtaggcccgtctatccgctacaaggaaggaagaatcaggattctatcttcatgcgaaggatgtccaaatgttcccttgaggggaacgaggggttgtattaattataatcccgttctcgccataagacagcttggctaccccatgagaggagcgccattagacgaaagcatcacgcctttcatcgcacggggttttggtgaccacaacgcgagggacagagtgcttaggggaagcagtaatgggatcatcggcggctatcataagtggctgagagtccgcacacaaggattggattggctcccaaatctaaagactgtgagggacgatgaggttaaagcttcggaagaaagtgatgaggtgcaagccctaaaggcagagcttgaaagagcccgagtagtcgaagagaagttcaagtccatagccatcaaagtctga

SEQ ID NO: 20999 - DNA, 147 bp, Glycine max
  Peptide Sequence Number=SeqID_112684
atgcgtgaaaagttccacagctacctaggcgtagtggcgcgagaaaaggttcccattatccacaataattggaaagacgtacctgaaacgctaaaggagattgtgtggaatgacattctaggagcaggggtagtattttatccttaa

SEQ ID NO: 21000 - DNA, 426 bp, Glycine max
  Peptide Sequence Number=SeqID_112685
atgcataaggcattacgggccaatgcacctctcccttaccctcaattgataactctatttttgtgtcattttcaaattacgcttgatgatgaaccatttgttcaagtcaagcattcctttgctattggtgctggtgcagtgacttcttttggataccgtaaggatcaaaatggtcaatggctgaagaaagatgcacttcctcctcaatatgagcgtattccttctcctcctcctcagcgagatgattcagtcctcatgactgaagttctttccgagttacggggtcttcgttcttatgttggtgaacgtttcgactcactggatactcgctttgccggaatggatattcgcctcacacagcttgaagaagatgtgggttacattcgtcagagtttcgatcttccaccaccacctccaccttcttag

SEQ ID NO: 21001 - DNA, 201 bp, Glycine max
  Peptide Sequence Number=SeqID_112686
atggcacgcagcgtgtccgcttcgtgcccctattcaaaggacctatatgggagggagctaactaggcttttagtgataattcccaaggtggtcatatctctcttgatggtttctagaggaattaatgaaacattgggcttaatcccggattttggttatggacttgaagagggcaaattaagcagcgcttaccttagttaa

SEQ ID NO: 21002 - DNA, 230 bp, Glycine max
  Peptide Sequence Number=SeqID_112687
atgaggaagcaaacatacaagaagtccccctatggctcttcaacttggaaagataaggagacatttaagaaggagagaggatcttcattcaaatttcatgagaaaggtgcttcccttggtaatggggatatcactagtgcatcttcttctagcttttctagttcttctagtgagagtgaaagtgaatgtgatgtacaacccctagaaggtgatcttttgattgttaggag

SEQ ID NO: 21003 - DNA, 54 bp, Glycine max
  Peptide Sequence Number=SeqID_112688
gcaacggaggtttggatgactccacttccggtgaaggaagataagtcagggtag

SEQ ID NO: 21004 - DNA, 661 bp, Glycine max
  Peptide Sequence Number=SeqID_112689
tcttgggttattgggttgggattttcaggtctttgttgggttcggtaaactacatgggtatggcgttttcagtggtcatcacacgggtaaatttcacggtgatctgctggatttgcaatacaaggatggtgatgttgatgcacatcacaaaactgtggaggagaaagggaaagaagttgatggttttgtggttgataatgaccatgttgtggatgattatgatgacttggaaggagttgcagagaaaaagttggttaaaatgaaaaaccatccttatacagaaaaaaacaaaaacaacgtggctggtgttgaatttcatggggacaatgatggagacgtgaatgaccaaggcaatactgatgataattactcaagtgaggagttgattagtgataatactgatagtggagaggaagacaaccctagaccaatatatgtgatgtatagaagtgaagacgtgaggaaggaattccaatttaaagctgatatggagttcaaatcattgaaagaatttaaggctgccattcaagaacactcagctctaaatggtaaggagcgagcaaggttggagagaaaatcacttacagagtcaagacttgttgaagtaagcacagatgtggcagagtatttcataacaaaaatgctaactctcattggatag

SEQ ID NO: 21005 - DNA, 714 bp, Glycine max
  Peptide Sequence Number=SeqID_112690
atggcggatctcaaatccatcgctgactgcatgatttccaacggctacgcgaaggaatgtatcagcgtgtacacgacgatgagaaaatcgatcgttgacgaaggcatttatcgcctcaacgtggagcagttgagcgcttcgaaggttaacaagatgcactgggatgtgctcgagtttaaaatcaagagctggttggaggcggttaagatcgccgtgaggacgctcttcgcccgagagaggatcctctgcgatcacgtcttcggtgcgtcgcaatccatcagagaagcttgcttcgctgatgtttctagaagcggagcatctcttttgttcggattccccgaactcgtcgtgaagacgaagaaatcgccgccggagaagatcttccggatgattgacatgtacgcggcaatcgccacgctgtggctggagatcgaatcgatattctcgctcgattcaacaaccgctgttaaatctcaagcctacggtcttcttctccgactctcagagtccgtacgaacgagtctattggagtttgtgaccgcaattcagaaaggctcgcccaaatcgacggcgaacttcgccggcgtgcattccttgacagtgcaagtgatgaatcacttgactactctcgcggattatagcaacgtgctctcggaaattttcttagacgtgccaccgccgccgaggtcgccgttgccggaatctacttataca

SEQ ID NO: 21006 - DNA, 1059 bp, Glycine max
  Peptide Sequence Number=SeqID_112691
atggccacaaaacaagttacttctatggttcatgtagatgatgactacattgacatggaactatgttcctccccaaacttcttctcttattcccttagctctccaccatccaacagagagtttgaattccaaatgagtgaaaaagagtcatcaacttctccagctgatgatctcttctacaagggaaaactccttcctcttcaccttccccctcgtttgcaaatggttcaaaagctcgtagaaaactccaccaatgccaactttgagtacatcaaatcagattcagctttggaacacagaacctttcccttcaccactgaccttagagtgccttcaacaaatgccaacaccccttttgaatccaacatctctccttcagaatcacgccgtgtgagcagtgatgtgagcccaaatgaataccaactggggtggttttctgacatgaacaagtacaaccttattggtgatcttcctaagaagtcttggcccaagaaactgaaacagatgaagcagttctggcttggtcagagactcaaggcctcaagggcttacctgaaaactttattcaacaaatctggttgctcagacaagttctgcgccagtgctgcagcaagcaacaacattggagcggagaagaagtcatcaaggtgcaaagagtgtcagaacaagtacatgaaggttgcaaggagaaacccttttgagagtttctatgatggcaagcaccaggtaacttgttctatcatgaagagcatcaaaagagagatgcttgaagttgaagatgatttctgtgaccacaggaggtctttctctggggttggtcagcgacattgttccacaaaggcttcatctttgtccacatcttcatccgggtcctcttcttcgtcttcatctttttctttcagctcagctgggtactatgatttgcaacttttcaagaggagcatcagcgcgaattatgagttggaaagttcaattgagggagccattgctcattgcaaacagtctctgcagcagtgtggttcaaagaatggttcggatgatagcaggatttgttcttaa

SEQ ID NO: 21007 - DNA, 384 bp, Glycine max
  Peptide Sequence Number=SeqID_112692
atgtcaggggattcttgggccttatgggctattaccattgattcatcagtagaaatgcccaacattgtgaatttaatgtgtttcaacttcaatttcagcgaggcttgtgcgcttagcgagaatcacgcgctaagcgagacactcaacccgcttagcgagttgggagaatctagaggagaaattgagaagcatctacgcgctcagttcgtcatcagctcgctcacgagccttcgaggacagaaagccctttttaaggctgaagttggaaaaatcaagggggtgcctgaattgggacggagagagcagaacagaagcgcaaaacaaagcaaggacgccaaaaatctcagctttcaagaggatcttaggtttaggagtaatttctag

SEQ ID NO: 21008 - DNA, 369 bp, Glycine max
  Peptide Sequence Number=SeqID_112693
atggaagcaacttctttctggtttttcactgccttacatattgtctgggatgggaggaattctccacacaatgcatgtgcttatgcttttcaagcactgtgctatggatctctactcttatcgaagcacagctactatgttttttgcttctcctctggtcacacagaagcagtagcagctggttcacaattcaaagcatcatctgcggttgtgattgctaaattctgtgcacttggaaatatgagcttagatggatgcaatggaagaagtctcaaggattgcaatatatgttcactatgtaatgcagcaaagaatgaattttttttagctgataatatggagaaaaaggtgttaagagtcccacattag

SEQ ID NO: 21009 - DNA, 270 bp, Glycine max
  Peptide Sequence Number=SeqID_112694
atgtgggttgtggttgtgcgtttcgcagaggagaaggaggagcagcgcggcgtcgaggtcgcgctgccgtgtggtggtggacagaggcggcgacgtggcggtgaggaggtggagggaggagaggaggtggcgggcgatgaggagggtcttctgggggagtgtgagagtgtggagatggtgaaggcaaagagtggaggtaggatagattgtagattacctgatttagttactgaaggcggtagaaaatctggaaggttttatgtgggataa

SEQ ID NO: 21010 - DNA, 1329 bp, Glycine max
  Peptide Sequence Number=SeqID_112695
atgggcaaatccgcctccaccaccgccgccgccgccctcgtcctcctcctcttcttcatttccccatcaaccgcagagatcaaaaccctcagcataacctccgacacccgccccatgatcctgctggagaaattcggcttcacccactccggccacgtgtcgatcgcggtctcctccgtctccgtggtagcctcaggtgggtcccagcctgatccttcacgattagggttttttcttctgagcgaagagtccctcctccaagtcctgaccgagatccagcaaaaccctagcttctgcgtcctcgactcccgctacaccatgcacctcttcaccttccgcaaactctctccccctcccgcggccaccgccaactacacctaccccgtcacaatccccaacgaatactccatcttcttcgccaactgcgcccccgaaacctccgtctccacgctcgtccacaccgagctctacaacctcgacgccgattccgaacactcccgcgactacctctccgccggccaaacccatctccccactctcttctctctcttctccgtcgcctacttcgccttccttgccctgtggatttacatctgctactccaacaagctctcactccaccggatccacctcctcatggcggcgctcctcctcatgaaggccctcaacctcctctgcgccgccgaggacaagcactacgtaaaggtcaccggcaccccgcacggctgggacgtcctcttctacatcttccagttcatccgcgtcgtcctcctcttcaccgtcatcgtcctggtcggcactggctggtccttcctcaaacccttcctccaggagcgcgagaagaaggtcctcatgatcgtcatccctctccaggtcctcgccaacgttgcctccgtcgtcatcggcgaaaccggtcccttcatcaaggattgggttacttggaaccaggtcttcctgcttgttgacattatctgctgctgcgccatcattttccctattgtgtggtccatcaggtcgctcagggagacctccaagaccgacgggaaggcagccaggaacctggccaagttgaccctcttcaggcagttctacattgttgtcattgggtacttgtatttcacccgcattgtggtctttgcgttgaagaccattgccgcttacaaataccagtgggttagtaatctcgccgaggaggctgctagtctcgcgttttatgttgtcatgttctatatgtttaggcctgtggagaagaatgagtactttgtgctcgacgaagaggaagaagaggctgccgagattgcgcttagggatgaagaatttgagctttga

SEQ ID NO: 21011 - DNA, 657 bp, Glycine max
  Peptide Sequence Number=SeqID_112696
atggaagaaacaacatcaaccatcatcatggctgcactctccaccctcacaccttcccaattctcagatctcactcgctccattatctccgccaccaaccaccaccatcgccgcctctcctccctcctctcctccccaacgctcttctctttaacccttcaccatctccacactctcacactcccccagaagaccctcctcatcgcccgccacctcctctcctccctccacctcctcaccgccacgtcgccgcctctgtccaccaccacacggcagcgcgacctcgacgccgcgctgctcctccttctcctctgcgaaacgcacaaccacaacccacatgccctcgaggcaccgttctccgaatggagaaaaaacttgagcaaagtgttctctgattcgttgttaactgtttctcttgcaccccttgggacggcttgtgggtgcgctgaattgcggcggagggaaggaggcggcttcggcggcgataatggtggcgctgccgtcggtggaggtgaggcacagtgggagggagtgcgtgatatgcaaggaggagatgggaataggaagggacgtgtgcgagttgccatgtcaacacttgtttcattggatgtgtattttgccgtggctggggaaaaggaacacgtgtccttgctgcag

SEQ ID NO: 21012 - DNA, 1113 bp, Glycine max
  Peptide Sequence Number=SeqID_112697
atggttagatcgtgttggaagcctattgctgatggtgatgaaggagatgggagtgggagagttgatggacttctatggtacaaggatttggggaaccatctttatggggaattctcaatggctgtggttcaggccaatagttcattagaggatcgaggtgaactagagtctggaccattgggttctaatcacttgggtcctcaagggacctttataggtgtttatgatggccatggtggaagtgaggcctcacagtttgttagtgacaatctcttctgcaatctcaaaaggctcgcagctgaacatcaaggtgtgtcagaacatgttatcaaaagggcttactcagcaacagaggagagttttctgtctcttgtgaagaaacagtggctgagtaagccacagattgcatccactggcacttgttgtttggtgggggtaatttgcaatggcatgatatatgttgcaaattctggagactcccgggtggtgctaggaagattagagagagcaacaagggaaacagaagctatacaattatctacagaacacaatgttaaccaagaatcagtgagagatgaacttcggtcaaagcacccctttgattcacaaatcgtggttttgagacaaaacgtttggcgtgtgaaaggcctcatacaggtttcacgatccataggggatgcatatctgaagaaagcagaattcaacagggatcctctaccagccaagtatagactagcagaaacattcttcaggccaattcttagttgtgagccatcaacatcatcccacacactccaccctgatgatcaatttctcatatttgcttctgatggcttatgggagcatcttaccaaccaagaggctgttaacatagtcagcaacaacccacctaacggaattgctagaagacttgtgaaagctgcacttagagaagcagctaagaagtgtgaaatgagactttctgacctccaaaagattgagcaagggatgaggagacacatccatgatgacataacagtgattgtggtgtttctcaatcccaaactcactgagaatacttctctctgtggttctcctctttcaatcaagggaggtgggtctaccaattcctag

SEQ ID NO: 21013 - DNA, 333 bp, Glycine max
  Peptide Sequence Number=SeqID_112698
atgaatttctttgctggtttattgctacttcttatgccagaagaaaatgccttttgggcatttgctggcattattgatgaatattttgcaggctattatactgaggatatgattgaatcccaagtggaccagcttatttttgaggaattaatgcgtgaaagattttaccaaactgatgggaatagtctcaatgttgattcagaagtggattccctaccacatctccaggaacaggttgtctcctctgcagtctgcacctcaacattcagttccctcttccattcccccctcccagcaaaaaggcctatatttgtgaagaatattgaaatttaa

SEQ ID NO: 21014 - DNA, 1290 bp, Glycine max
  Peptide Sequence Number=SeqID_112699
atggcgattagtgaagtttctgagctgtgtgagcgatttagtataaagtatacgatgcatcgtttctggttctggatgttcatgttcgagcaaagatcttctgtgtgtgtacgggttgtccagatgagtgttgatggcgacggcaaagagctgagagaactgaatcagtgcttacgagatgggaagaaaattgctggtggggaacgtggtttatacgagggcgatgaagtgaaatgtaatggagttgctgaagaagttaagattggaaagggggggattgtggagtcctcctctgtccagcagcatataccacagcctcaaggggcaataatttgttgggagaggtttttgcatattagatcccttaaggtcttgcttgtggagtatgatgactctacccgtcatgttgtcactgcactgcttcgcaattgtagttatgaagttattgacgcagcaaatggattgcaagcttggaagatattggaggatttaaccaatcatattgatctcattttaactgaggtggcaatgcctggcttatcaggcattggtctactatacaagattatgggccacaaaacccggaaaaatattccagtagttatgatgtcatctcatgattctatgggtttagtctttaagtgtttgtcaaagggtgctgttgactttctagttaaacccatacggaagaatgagcttaaaaacctgtggcagcattctagtgggagtggcagtgaaagtggcacacaaacccagaagtctgtaaaatcaaagagtcttgagaagtttgataataattctggaagcaatggcgaagatgataatggaagtataggactgaataatggggatggaagtgacaatggtagtggcactcaggtggttttgccggggattgagaattctgatatgggattgatgaatatagggaaagagtgtgctcttgttggactaggatggaatgctgttatcacttgttacttgctagttgctagtaaacagtttaacagcaaacaccacaagtcatcagcatactggtttaggactaacttgccagtattgccatatggaggtcatgttctaattctgagctcatggaccaaacatgctgtagaagttgatagtcctaaaccagtttcccactgggataaaatagctgagtgccctgacagtacctgtgctcaagttgttcactccaatgctgaaattggtgagaacaaggtggttcctctagctgcgaaggagtgtccagaacagaaggaacaacttggtaagggccaagtgccttga

SEQ ID NO: 21015 - DNA, 3135 bp, Glycine max
  Peptide Sequence Number=SeqID_112700
atgatgccattgacgcctgaccagtctaacaagaaagttgggtcgggcatggcggcttctccgtcaccgttcctgacgcctcgcccggaacggcgccgtcccgattcaaggggttccgattggggctccaaccgtcaggacaaggataaagagaccaacgtccaagttttgcttcgatgcaggccattaagcgatgatgagctcagatcgaacgttcccaaggtggtgacatgtaatgaaaacaaaagggaagtctcagttatgcagactctagctaacaaacaagtagatagagtgttcacctttgacaaggtattcggacctaaatcacagcaaagatcaatatacgaacaagccattgccccaattgtcaatgaagttctcgatggtttcaattgcactgttttcgcttatggccagacagggactggtaaaacttatacaatggagggtggaatgagaaataagggtggtgatttacctgctgaggctggtgtcattccaagagcagtgcgtcaaatttttgatattttggaagcacaaaatgctgattatagcataaaagtgacattccttgagctttataatgaagagataactgatttgttgtcccccgacgagaattctaggccgacagaggaaaaacaaaagaaacctataacccttatggaagatggaaagggtagtgtgtttgtgagaggccttgaagaagaatcagtatacagtttgaatgaaatttacactctgttggaacgaggagcatcaaaaaggcgcactgcggaaacattgcttaacaagagaagcagtcgttcgcattcagtcttcaccattactgtgtatgtgaaagaaacagtgattggtgatgaagagttaattaaatgtggcaagctcaatcttgttgatctggcaggatcggaaaatatattgcgttcaggagcacgtgaggggcgtgctagagaagcaggggagataaacaagagcttactcaccctgggacgtgtcataaatgcgcttgtggaacattctcctcatgtgccttacagagatagtaagcttacaaggattttgcgagactccttgggagggaaaacaaaaacatgtataattgctactatttccccgtctgcttattgtatggaagaaacacttagtacattagactatgctagccgtgcaaaaagcataaagaataagcctgaggcaaaccaaaaggtttcgaaggctgttttgttgaaggacttgtacatggaaattgataggatgaaagaagatattcgagcagctagggaaaagaatggtgtatatatttctcatgaaagatttgccaaggaagaagctgaaaagaaggcaaggaatgagaagatagagcaattagagaatgacctcagtcttagtgagaagcaagtggacagcttccgtgagctctatttaacagagcaagaacagaaactggaattagaaagcgagcttaaggattgcaaggtgaatttggaaaaaaccagcaacaacttgcatgatctccaagagaattacaagctattagtttcaaccttgaaggagaaggaacgcaccatttccaagctactgaaatcagaaaatgccttgattgtgcgtgcaaaggaaatgtgtactgatctgcagaatgcatcggatgatattaatttactgtcctcaaagttggatcacaaagaaagactggaggcagaaaatcaaaaaacaattttgaaattcggatctctcttaaatgagagcttaaaggacttgcatacaaccattatgggatctgtttctcaacaacataaagaacttagaagcatggaagatcatgtcagctcctatcttgccagtaaaaatgatgctgcacaaactctagagtcaaggatcaacaaaatgacaggaatttacacttcaggggtggagaccctgaaggagctagctaatacattgcacatgaaagcttcatctgatatggaacagattcaatctaaagtttcctcgcaaacattggccattgaaaattttcttgccactgctgttcatgaagccaaggatgtaatatgcaacatccagaattctcttgacgagcaaaagcagctgctagcattctcccttcaacaacaagaaaaaggattacaacaaagtctgacttcggcacgggtagtttcagaggcagctgtaaacttctttgatgacattcatctacgttcttcaagagtcatgaaaattcttgaagaaaatcaaaatgagaggttccagcagttaactaactttgagaagaagttcaaggaagaggttgagagagaggaggagcaggccttagagaaaattgcagaaattttggcagccttgacatctaagaaaactgctatggtctcagaggcatcaagacatatgcaggacacaagcatgcaacagtctaagagattgcagctagagatgctcaacatgcagcaagtttcaaaagatggtactaaggaagttggtgagtatgtagagaatgtgaaaagtcattatgtgcaacaaatattctcagccagtgatattaaagctaccatggagaattgcctcttggagtgctcaaaaacagtggacaattctaagaagcagtgggaaagtgccaacttgtccctctgtaatctccagaagaacaatctggcagagatacaatcctcagtgaaggaaaacatcttgacaaatcatattctgaatcaagaatttgtgtctgcatcattatctatgaattcagattatgatgtagtaacacgcaacctgcgggcagatgtaaatggtgcactgatgctggaccatgagaataagaaggcaattgattccatgactacaagatggttggagcagcttaactcattacaagataagaatggtgaagatgtatcaaatatcaatgttcaagcagaaaaaagcctggttaaagattacttggttgaccataatgcaagatctcagaaaagaattataccagttcccagcccagcatccattgaggatatgagggcaacgatcatagagaactcattaaaattgatccaaacagaaagcaaaatcacacgtctggcagcatctccaaatagaactcctttcgcagacgtgaattcagtcaatgacgactgtagttag

SEQ ID NO: 21016 - DNA, 2279 bp, Glycine max
  Peptide Sequence Number=SeqID_112701
gtgtggaacctgatggaggtttggttattgaatttaatgatggttttcggagtgagctggggtgtgagaatgctagggatgttgctgaaaatggtttgctgagctttgcgttgaataatgtgactcaagggggtgataatgatgcggttgagtgtacgcaggaggttaagaatgatggtttggtgaatttaagcgcggttgtggagaatgatggcaagagaaatggtgctgatagtttggttactaaagatggcatggaagattcacgtgccatagaagttgcaacctaccaattacaagatgggattccgtgtatggaagctgtggatgtcaacgctgaagaatctttgcatgtgaaagacttgtcaaggaattgcctggagctaaaaccttcatgtgagccagcctttcaggtagatgcaaatgtagatgtgatgcagaatcaaaccgtggtcgttgatgtttctgaaggactatttgagaatattcaaaatgagtgtcatggttttgatcttgttgtggatcttaattcttacaaaagcatgcataaggttggcacgtactggggatcagtgtcttcggaaatgaatttctgtgtgtctgatttagtatggggaaaggtgactggccatccttggtggccaggtcagatctttgatgcctcagctgcatcagagaaggcaaagaagcacctcaaggaaggctgtcacctgatagcgtattttggggatggaacatttgcttggaatgatgtgtcaatgcttaaaccatttcagacacatttttcacaaatggagaagctgagcaatttggaaaatttccaccatgctgttgattgtgctttagatgaggtctcgagacgggttgagttcagcctatcctgccattgcatgcctgaagatgtgctttctaagattaaaactcaagtaattagtaatgctggaatcaacaatcagtcgtgtagaagaaatggaggggacagaattatgaatgcaatgtcttttgaacccatgaaacttgtcaattttgttaaatcattagcacagtcgccacttgttgaatctgataggctggattttgtaattgcacgttcccaattgtcagccttctattgctcaaagggttattctcaactacctgagttcccagtgcttggtgtgttgttcgagaatgatatggaaactctactcatgagggagaaagagcaatgtgattatcaaacccatgtcagctttttgcaacaggatcacaagcacatctctggggatagcaagtggcacgggaagaaacttaaacttctgtcagatttgatgtctgagaagggcttctgtatttcaaatggtgaaggcacatcagaacaggaggctaagtcagttccacagcgtcgaggcaggaaaaggaagacagctttcaatacttcagaagattatttccataattcccaaaatggaaggctcacccaattacagtatgcttctacaaatgacatgaggtctcaactctgcttggctgccaaggatccaactggagaaagttgctctagtgacatggtacatttctttgcagaatttagaaaattcattagccatgattattatgcttccctggatcaggaaatgtctttggaacgaatgaactatgatgagaccggagtaacctctacagcagcattggcttctatgacacctgcaatggagccttgcagtgattcttattggactgatagaataatccaaagcattcccaaggagctatcattgacaaaataccagaatgagagagtggtttttttacctgagactctaactgaggctaatcctctttctttcaagttgcaaccgtctgctgaaactaccacagatttatgttataagcagcaagatactgatagaaatcttggatcagaatcttctaagcttgtggaacatttggatgggagttctaaagagaacttctgtcccactgctctgacactgaaatttacaaacttcgattctgttccttcaacaaccgatctcaacaacatttttggccgctttgggccactgattgaatcaaagactgaactgctagagaggacaaaccgtgccagagtggttttccaaagacgttcggatgctgaaactgcctttagtagtgctggaaaatacagcatatttggaccttcacttgttagttaccgcctcaagattttgcctcgtaagccaccacaaggtacaggaaagcgaggcagaaaaagaagaaaagaaacaagttctgtggatggcacagcagtttga

SEQ ID NO: 21017 - DNA, 417 bp, Glycine max
  Peptide Sequence Number=SeqID_112702
atggtgaagcacaccaaagatcatctttgttctaggagatgtggatttgaagacattattggctcttttggatttcatggtgtgctactcctggtgttggaaaacttggtggaaaattcattgccttatctcaagtatagctataaaaagtacagggttcgacacaagaagaatgagaaaggagaagcaagagaaaagttccagtttatttctagagtagagaaagaatacctgaagccctcttactctgctagcattggtgaggagcttgaagatgggctatttgatggagtagtcgaagcacgagccctcctcatggttttaggtgggattcaggagtcaatgacagaaatagaatgcaggttggaggatttgtttggtcagacaaaactgacagataataaggttaaagaataa

SEQ ID NO: 21018 - DNA, 255 bp, Glycine max
  Peptide Sequence Number=SeqID_112703
atggagttgataattgacagactaccaactgttgataatctctctaagagaaatatccaattgaatgatgaggaaaagaagggtgttttctgtttggagttggaggaatctgctggacattgccgtgctcactttcaacaacttccatgggtgatgaaatctgctgcggaaaaatcgcggtggcaagttgtttggggttatttggagtgtctggtactcaagaaatcaatgcaaattccagaatatagaggttga

SEQ ID NO: 21019 - DNA, 1282 bp, Glycine max
  Peptide Sequence Number=SeqID_112704
atgggtagtgataatgtcaaaagaaggagggagggagaaaacgaaggtaaagatgtgtatgaaagtgaggatctattgaaagtgtttcactggcggggcaaagtgcgagaggccaggggagtcatatgcacaagtagtccatggagcttcttccatgggaaatggtggagatacaagaaatacagggatagtgagaaggagtggttcattgccatgttcgaaacaattgacaaatggacttcagatgaaagaacaagggagagtatagtcaagatcaaatgtagagaggagtatccaatacagacaaagggtaggtgctactatactgaccacgagattcctgatgatgaactatctgtgttcataatggagaatgaagatatctcattatcaggatcagaatggtcaagagaggaagaaaccaaccatagagaaagctttcaggaggctattagcgacgatgctgacatgacgttgggacaaattgctcaaaactgtagcaaaaggagcaaggggaaagtaagaatggatgaagaagaagggacaatgcctaggccagagaaaaagaaaaagagggtggagcttgaggaaggaaaggtgatggaggtagaagtaggtaaggataaggaagtcctagagggattcgttgggaagaccaacagggagggtgatgctggcagtcgggaaagccacatagatgtaaaggatgatagggaaggccatattttaagccgtcaaaagggaaacataaatctgatagacgtgggcttgacaaaggagatgaaatcccaacatgttaatgttcaacaaaagtgggctgataggactacaaactcaattaatagaggagctaagggaaacaaatgtattaagcagggaattgcaaatgagaagattgatcaaacacgtagatatgaaagtatagggggtggacatggttatggagacaaatctataatgactcaaaagatccaaggggtggaggacacaaatatggtggtaacaggcgggaagaacaatgaagtagaagaaaaggttaaacaaagggttcaatgggcaattatacaagaattcaagagactcaacctaatggataaatggtgtttggtggaagactccaattcagtgagaagattgggagacagtagaagacattatcatattgctataggtggcattgagatgaaggaattcaataattttattgaagacatggaagtggatgatctacctttagtaggtttgaaatacacatggtttagatctaatggtgtagcaaaag

SEQ ID NO: 21020 - DNA, 1832 bp, Glycine max
  Peptide Sequence Number=SeqID_112705
tgtgtgatgcggtgatcgcgatcacgatgaaaaatgcaaacggcttgatttcgacgacgtcgtctaatacggcacagtcacaatccactggcctcaagacgtatttcaagactcacgaaggccggtacaagctttattacgataagacttacccttccactcttcttcactacgctcatggcaaaaccgtttctcaggttactctggcacatctcaaggacaagccggtgccttcgacgccgactgggcagtcttcaactttcagtgccaccagtggggtaaggtcagcggcggtgagattgtggggaggaagcaatggaggccggtctcttagttttgttggaggcaatggtaccagcaagaaccttggggggaactctaggattggttcgattggtgcttctagttcaagtaatgcaacgtctaattcaaattttgatgggaaaggaacttacttgatcttcaatgtcggggatgcaatttttataagtgatttgaattcacaagacaaggatcctgtaaagtctatccacttcagtaattcaaatcctatgtgccatgcatttgatcaggattctaaggatgggcatgatttgatcattggcttgaataccggcgatgtgtcactgagacaacaattacaggatgttggtaaaaagcttgttggggcccagcattacaacaaagatggttctgtcaataacaggcaacatttgatcccttctccaccactggttattgattcatgttgcaatggccgtaaagtatacactaataccgaggctcattcagtccaaaatcctaattcagaatgggtgcagatatggttatctgtgacagataagaatagaccatcatatggagttgttcaaattgaacataagattcattgtacttgtattgcttgggttcctggaggtgatggtgcctttgttgtaggtcatgctgatgggaatttgtataacagagatggtgctggtgattcttcattcacggttgtcaaagatcaaacacaattttctgtttcccatgcacgttacagtaagagtaatccaatagccagatggcatatatgccagggttcaattgacagtatttctttctcaactgatgggacttacatagctactgttggacgagatggtgaggcatatttggttttggtcaatcaattaatggatctttggattaatctcctatttcctcagttcctttcttactctagctcaagagcttctaaaataacagtgcttgactttgctgttactgtggatgatttagttcaagtttggagtatggaagatcgcaaggttgtggcatggggtgaggggcacaactcatgggtcagcggtgtggcttttgattcatattggtcatcacctaattcaaatgacaatgaagagactgttagatatcgatttggttccgttggtcaggacacacaattgcttctatgggacctggaaatggatgagattgtggtacccttgcgacgtccttctggtggatccccaacttacagtgctggaagccagtcttcccaatgggacagtgttgtcccgttgggtaccttgcagcctgctcctagtatgctggatgttctgaaaatctctccactcgttacccaccgtgttcatactgaaccactctcaggcttgatatttacccaggaatctgtacttactgcctgtcgggaggggcacataaaaatctggattagacctgcagctgctgagagccaatcaagcaacgctgaaactctcttatctaccagccttaaggagaagccttcaattttgagtaaggttggcaattctagccacagacaatga

SEQ ID NO: 21021 - DNA, 249 bp, Glycine max
  Peptide Sequence Number=SeqID_112706
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttgggatacacgtgtacggcactgcccccaatccttctcctccccacattttgatagcaagcaaacaaaaagtaatgtaa

SEQ ID NO: 21022 - DNA, 342 bp, Glycine max
  Peptide Sequence Number=SeqID_112707
atggaggcttacaacaaacgtctctctatttggaaagctaagtctatgcctatagggagttgtcttatgatgattaattctgtgttaagtagcctccctctatattatttctccttcttcaaagccccaaagaaggttattcagactctcactgctattcagagaagattgtataagatagctgaaaataaaaactccaaagtagctaagttggagttggagaaggctattatttgcttgggaagaggagacgctgcaggaattgatcatgcttctgcacctggcacgcatggatacttcctcaccagatctttggttctggaaaccgatagggggggctag

SEQ ID NO: 21023 - DNA, 387 bp, Glycine max
  Peptide Sequence Number=SeqID_112708
atggatgaagaccaatggatgtataatagtatcatgtctgaagaagttgaaatgaatgtcgaaaatgaggaagatggtggcgttaaagttcattgctctgatgcctttaatacttctgagttgtttggtagccgtgatgaagttttacaatgggctcgatcgttggctgaagacattggatttgttgctgttataatgaggtctgataccaataccggtgttcgaggaagaacctcatttctattgatagtttgtgaaaggagtgggcagtataggcctaagaaacataatttggtaaaagcatgcactgacagtagaaaatgtggatgcccatttaatttgctctatatcctaagaaggaaatggatgctgtcaatctcatgttaa

SEQ ID NO: 21024 - DNA, 237 bp, Glycine max
  Peptide Sequence Number=SeqID_112709
atggcgatttggccatacattgggaactgtcagtcaaactggcgagtttcaacagctagcgttagggtgcagggacgcaacgaagcaggaaggcggaatctcgcctgcaaaagctgcacctcgcctgcaaagcctgttagaactcgtcagtttgactggcgatttcctatgcagtatcaaatcgccatttccggtggcgattttttcaaggcacagcaaactcgccagttccactga

SEQ ID NO: 21025 - DNA, 678 bp, Glycine max
  Peptide Sequence Number=SeqID_112710
atggcggaaacctctgctgcactatgcttctccacattcagattttctttcgctccgtcccgttctccttccaagaccttcttcaacaacagctccttccatttccctcctccttctagttctcacacgtgtcttctccatttcgctcccaaagcctccccctccggcaaacttctccggcgacgattctttcggttttttcccttggtccgattccgacaacaacggaaaatgttcgcgtgtttgcttccagaaattcaatggattcctgaggagagaattacgttgttcactgctgatggattgatccagattggaggctccatggttcctcgccgtgtcagctcttcagataagaagcacgggaaatccaaaactgctaaaaaatttcaacggtttcaggagagtaattacatgaatcccaatcaaggcctttgtctgggtgcactctttgatattgctgctactaatggacttgatatgggcaggagactttgtatttttggtttctgccgttcaattgagatgcttagtgatgtggtggaagacactgttttagagcacggtggggaggtaggctatactttttctttcaataaagctattgtgctctggttcttactatatgttgaagaaagtttagtcaaaattgcaaaagccaatgttaaaatttcatga

SEQ ID NO: 21026 - DNA, 1956 bp, Glycine max
  Peptide Sequence Number=SeqID_112711
atgggaaccggttcgaccttggccagtaaggaagttccaatagtcggaagcgacgctgttcgctggatcgatctctccgttccgtcttcctccaacattgccgccgttgacgacggcggcgccgcccctctcaccaccgacgaccgcgcctcctgcttcgtcatcggagatcctcctacttatcttatctggagaattcacaaggctcagcctcactctctcgagttgctcgaactcgccgcttccaaagagtttccgcgcgtaggactcagattcactttccctgatgcgctttgccccttcgctttcatctgcaaaaacgagatttctggtgcttctagagttccttacttgctttacgtgttgactgtgtctggcgtggcttacctattgaaaattcgaaatgtttctgtgtatgcgtccgtttctgttttccccgtggatgagcttttggaggttaatgtgcgtggttacattcccaatcatgctgccacgataactgccgtgacagcaaccgtcgggggtcttgttgttggcacaagtgatggttctgttttctgtttccagcttggtgtactcgactctagtgctcctggtttcatgcatgagctgagagatgatgctggaatcagtcgcttgtggggtttaatatcacgggggaaaatggtgggtactgtacaagagttggcgattttggagttacatgagaaaaagtttgtgtttgtgcttcatttggatgggacgttacgaatttgggatcttgcatctcatagcagggtttttagtaataacatggggactatggcaatggcagaagcattttctcatgctttacaggaagaatttgttgctgatcaactatttcaaagttcagagcatcttgctgatgaaattttgcagatcacacattcaatattttcatcttcgaaggatgatattttgccttttgtatcttctattttcttaagaaggctgcttcttcctggggttcatcataatgctactttgtatgctactctagttgagtatagcaggcatttgggtgaatctgagttgcaaacattaaccactgatgggctaaaaaaggagatactttcactcatagaacatgaggttggatctgaaaaagtgtctttattgcactgctggaaatgttttttcacccggtatttccataattggtgcaagaacaatgcgttatatggtttgcttgttgattcctcttctgatgccgttggtttaatcagaaaaaaatccatttcactttttcggtctttggaagatattgaacggattgtggagggctcttcagacgaagttagtgagctcacaggccttgtggatatatttgacgatgatctggagtgtgaaattctaatcgaattgctcagatgtgttataagtttcagccaacagttgggcaaaactgcttcttctatattttatgaatctcttttaactacatcattgatctcttctgaagatattgtttgctatattgttaagattctggaaactggatattgtatgtctggtccagtgcttcaaacttctacttctgggaatcatatagttgttctggagaaggagctagctgatcataaaagtttgaggaaactttctgttgatatgtttttatcgcttcaaggcttgcacaaaaaggcttctgaatggggcaggattttaaaagtaattgaggataacaacatggggaaacaattatggaatgagaagcttggcagatgtgactttacattggcttttatattcttgctcaacgttggaagttcatccatagatcatagccacgctggaggatcttctactttcttgagccgttctattgatcttgcatttatacttttcaagcatggccagtatggtgctgctgagagaagacatcccaaagtattcaagatgatgatggtggatggtgcatacgccatcatcttctag

SEQ ID NO: 21027 - DNA, 2829 bp, Glycine max
  Peptide Sequence Number=SeqID_112712
atggacaaatcccgccacagcaagtccaacgcagcaccctcctccacccaccaacctcaaccacctcttcctcaagggaacaaagaggttcatagacagcgacaacctctgaatctatctcctgatcctggttcatccagtggtggggttgcatacaaggattcattctcatctaaatttgggtggagatcttccaaacagctgtttggaactccgattaagaagttattagctgaagagatgtcaccgaaagctgaatccaaaagaagatcacctggtgttattgccagattgatggggcttgatgggctgccgttccagcagcctattaataagcagcataaggctttgtcagaaaaccaacagaagacagcacaattagagagaacacgcggcaaaggagtgccatatgatggtcaatcgtctaggagaagctcaaaggatcaccaagaatttaaggatgtatttgaggtctcagagattccaaaggtagagagccataggtatccatcacaggggtgtgcagacttgatgaccactgatgccgaaatctcattcattgaacagaagttcatggatgccaaacgacttgcaactcatcaagacttacagtcttcaaaggatttctgtgacacacttgaggttttggactctaacaaggatcttctgctaaaatactttaagcgtccagattctttgtttaaaaagcatctaaatgatcttcaagctgctcctgtccaatcacattatggttatgtaaaacctatggatattgagaagtatgaacatgacttcaatttgaggtcagattgggagaaaacacggtcaaactacaatagatcatctcatgagaagcatcatgatggttatccttgtcattttgacaaaagacatgtgatgcatagttcaccaaaatcatcaaagcttcaatttaaggctaaatatgaacaaaaggcagtcacctcacagattgtccttctgaaacctaatcttggaaaagtgcagaatggtaccagaattgtgtcatcaccttgttcttcacataattttctggcagggtgtgaaaatgacactgaactgtgccaagcgacaaatttgcctgaaagtgccaggtcttggaggcaagattcttttgaatctagagaaattgcaaaggaagtcactaggcaaatgaaaattagtcttaacaatggaagcatgaagctttccacctctagaattagaggttatgctggggatgatagttcgtgtagtgtttctgggaatgaatctcctgaggagtctgaggaaacaactgcaactttggggaattcgattgacttaaacaaccgcagcaggcgatcatcccgttctagtgaatcttctgtcagtagagaggcaaagaagagactatcagagaggtggaaaatgacacacaagtctcaagagctgcaaggcatcagcaggagcagtacgctggctgaaatgcttgccatccctgacatgaaattgaaggcttctaattcggacagcatggctagtggggaaggtttccatgataaatgtactcccaatagtcaacctgctaagtgggttgaaccattgggtatcagcagcagggatggttggaaggacggatgcattggtagtttgtcgcggtcaaaatcccttccgtcttcatctactgcctttggaagtcctagaagattcttgcgcactgaagcacttcttgatgagcgatttatggtgccaaaggatgctcacagacgtgagaggagaagatctggtcacaagaagtctaggtctttgcattcatcaattcagaataagatgaaaatcagtctcaaagattcacccaagcttgaggttctagctagtgaatcttcatctgagattgtaagacatgcagttgctgatgttgataacgatgtgacaaatggaagtaaagtttggtctgaaccttctactaaggtgcttcctgaatcatcttctcaccttttgataaaagacaacagtagtgcagacctagacaattcaaaacagcaggatctatcagcttgttcatcttgtggaagttcagtcctccctgaacctcccgttcctgttcctggacttgaagcttcttgctgtaaagatgctgatcagcccagtcctgtctcagtcctggagccttcgtttacagatgatgcgtcatcttgttctgataattttgaaagtctgaataatgacctacaagggctgcgaatgcaactccagttgctgaagttggaatctgatgaatatgtggaggggcccatgatagtaagtgatgaagatggtggggaaggatctactggaatgttagaggacaaaggattgcgtaggactgaagatagctgggagtgttcctacattattgatgtcttgtctgaatctggcattgatggagctcagccagatacaatttcggaactttggcattccctagaatgccctgtgagtctatctgtttttgatgagcttgaaaagaggtatggtgattggactacttgctcaaggtctcaaaggagattgctttttgaccgtattaatttgggaattgtcaagatcaatgagcaatgcactcatgcactaccatgggtgggtccagtgaccaaaaatgttattggttctaatttgatcgagaatgggttccgagatggccttctgaggatgttagtgagcgacggaaaagtgaaggatgatgctctggggaaggtgctagttatggaatcagagtggttggacttgagagatgacattgatgtcataggcagggaagttgagagattgttgttagatgatttagtggcagagataatcggtgcttag

SEQ ID NO: 21028 - DNA, 477 bp, Glycine max
  Peptide Sequence Number=SeqID_112713
atgagaaggggagagacgggtctcccactctggacccggaaaatcgctcatccaagtgatgttgaagaggaaaacgaaacagcaatagtggtacacgatggtctcgcagtagtctttgcaccaataaagagatcatttacactgaccagcaacgacgattcagcaacaacagaggtgccgggtgacgttttggaagggcactttgtggttcttgcaaacaagggtgaagaaaccaaaaggtttattgtggagttgcactatttggatgaccctgcatttttgggactgctggagcgggcaagagaagagtatggtttcagacagaagggggttttggtaattccctgccaccctcaagagctagagaagattctagaacaaccaagggatcatgaaagtgttggaggagatggaggcaaattaacagattcaattcaagatattagtgaatgtagcgtcatttcctgcagtagttga

SEQ ID NO: 21029 - DNA, 291 bp, Glycine max
  Peptide Sequence Number=SeqID_112714
atggtgatgaaaggtataaagaggggtaatctctatatacttcaaggtacaacatgtgttgaggatggtctagtagctgttgcatcaagatccaataagagcatacctgacttaactcaattgtggcacatgaggctaggtcatatgctgatgactcgggtgttgggtcaaaggagctttaggcttcaaccaggagttgtttctttgctggttttgctgttcaaaggaactctgcagaggcttcaaccaggagttgtttctttgctgctcaaaggaattttggagaggtga

SEQ ID NO: 21030 - DNA, 378 bp, Glycine max
  Peptide Sequence Number=SeqID_112715
atgacatgcttctttagcttcagcggccgcaacttacacttcaacaacggcatcatcctcggattcttctacttctgtcccacaatgtcgagggagccacttgatgaggcgaaggattctattgggtccgcacctacgcttcagagaaaaggaaaaattcaggatccgcaccctcgtccattcaagaaccagatccacgcagagaaaaggactcttgggttgacgctctcacccaccgatgtgttcgtcgtcgccacccccacacactatctacaatgggtgaacaatcaaggagatgatagcgtggttgtattgtgcgaggaagtcgatggacgaaggagatgccaacggaaaagtcgaccaccctttggaccttaa

SEQ ID NO: 21031 - DNA, 321 bp, Glycine max
  Peptide Sequence Number=SeqID_112716
atgcttagatctttgcttgggaggataaaaaagggtctctcactgtttgtagctagaaggcctacattcaactacttcagtgaagatcatgccgcaaccgcggcgccagatgatgttatggaaggctattttgctgttcttgcaatcaaaggagaagaaaccaaaaggtttattgttgggttagactacttgaatgatcctgcattcttgagacttctggaccaagctcgtgaagagtatggtttcagacagaaggaagctcttgcactcccttgttgccctcaagagttacaaaagattctagatgctccaaaatcatag

SEQ ID NO: 21032 - DNA, 261 bp, Glycine max
  Peptide Sequence Number=SeqID_112717
atgagaggaaaaatcggtagatattggctccaataccagcaagaatggattgctatgtggaatgatcgtcacaatcgtatagttcaagggccaataatgacggtgatgatactacaagcggagcctagccaactcaacatggtcgtagaccaagacaaggacaagtggaaccaactcaacaacaatagcaaaaaggaagaccacggtgtcacatgcaaaggcctacatgtaggacatcatcccacaaataattttttttaa

SEQ ID NO: 21033 - DNA, 1611 bp, Glycine max
  Peptide Sequence Number=SeqID_112718
atggatcgggaagaatatttgcggaagtgttccaatatgaaatgccaaagagttcaggtggatgaatcatttgtacctgctcttcaagatgaagtaatggaagttgagcatttgcttgcagaacctagaaacgttcatgcttccctggatggtagtttggattctcatacaactttgaatgacaaggatgatttggaactggaggtccttgatggattgctggatgatgttgaaattgatgatcttgaaggaactggtggttttgctggtgcatgtgaagaatattttttggattttggatttgccgacaaatttgaggaggtactaggctcaggtccttttgaaggttcactcttgcaaatttcaagttctgaaagtcattcttccggattaagcggaagtagcattgttggtggggttttagaatcaaccaaagtacctattgcaaaatctgaatgcaaaaatgattctctagatgagacaataacctatgaagcacatggtgccttcaggaacaatccaagtcaaccatcaaaagtaaattgcagatacaacatttcacttgatatacaacatctgcaagagttggaaaacaatagtcatttagctgctggtatattgacttgtaagaagggaaaaggtcctgttgaaaaaggccaacctgctgtacttagagagaagagattccgaaagcctacccagaggtacattgaagaattttcaaattcaaggtcaaaggaaaaggcaccaactgctgttacaaaaactgaacatttaagtgactcatcatgtgatgtacttcatataagaattaaagcattgaaaaagagtccaagcgagaagtctagtaatgaaaatagtgatgtgatgcttcctgagttgcaagttcgcaaaaggcgtctggagaaagagaaacttgagtatgacaaggagttatttccctcggaatccgaggatgaatgttcgacatcaaaaagatctagaaggaaagatcgaagaaagcatcagaagatgtggactctccctgaagtgttgaagttggttgaaggcatatctgaatatggagttggtcgatggactgacataaagaggtttctgttttcttcttcaagctaccgaactcccatagatctcagggacaagtggcggaaccttttgagagccagttctgcacagaaaacctcgagagaggctgagcaaaatgacgagcttgccctgcgtcccttgccatttaatgtggtacatcgtgtgcgagaattggctaaaattcacccatacccaaggcaacgtgggtcaaagaggttgcgtgttagccaagctggctcttctatcattgctaaagattctcctccccttagtcttagcaaaagaaattgtatagagcctggatacaaggctagaaatgttctcaagggcttctctactagacaaaagttctacagtagagaagctttcaaaattactcctttatgcagacaaccccataaagatcgtgtatttcagaggcccaaggttagggagaagtgggaacaaaatgataatgtgacagctcaagatagcacaggaatgcacgtgaaacggaagcaaagcaaagtgtgtctaatcaaataa

SEQ ID NO: 21034 - DNA, 492 bp, Glycine max
  Peptide Sequence Number=SeqID_112719
gctaggagactgtttgatgaacttgtggaacttgatgtggtggcttgcaattctatgatcatggggcttgctaagtgtggggagaataagaggctcatggaggcatttgagcttttccacaagatgcagagacaaagggttcaaccaagtgaatttacaatggtgagtctgttaagtgcttgtgctcacttaggagcacttcaacatggggaatgggttcatgattatgtaaaaatgggtcattttgagttgaatgtcattgttctctcagcattattgacatgtactgcaacaatcgagtacttctcaaagcttgaagcctcagatttaaagctagaccatttaagtttcattggtgttttaactgcttgtaaatatataggagcagtagaaaaagtaagggattattttgcactgatgatggataagtatgagatcgagccattgataaaacactatactttcatggttgaagtgctaggtcaagcttag

SEQ ID NO: 21035 - DNA, 396 bp, Glycine max
  Peptide Sequence Number=SeqID_112720
atgttgaagaactgggtcttgaaaaagcataacaagactttcctagattggtttaaagatacaatctttgttgatgataatgtttctaaaaagttaagaaagctagcagatgggcctaaaagaactgttataacttggcaaggatacgatataaacaagcaaatggctacaccacccagctctcatcttcctcctcctccttctcttactggtgcaacatcacagtcgccatctaccttgaagcggacaagaaaagccacatggctaagatcattggtgactagaccagttggggcagagagaccgcttgtccatgtcaatcttgcgaccaagaaggccgacggtccccacagaaagaagttaagaacatatttggggatcgtcgctcatgattag

SEQ ID NO: 21036 - DNA, 375 bp, Glycine max
  Peptide Sequence Number=SeqID_112721
atggagagaagtatgatagatgctgccagtggtggagcccttggagacatgacccctgctgaagccagaaatttaattgagaagatggattccaagtccctgcaatttagtgccagaaatgatgctattgtcattagaggagtgcatgaagtagccacaaattcatcttcatcgggtgagactaagaagcttccagtttatgctgcaaacatctacaacagacctcctcaacctcagcagcaaaatcagccacaacagaacaattatgacctctccaacaacagaccatatgttcctccaccaatccagcagcaacaacagcaacagcccaataaacaacaaacagttgatgatgcaatcctccctaggaaatga

SEQ ID NO: 21037 - DNA, 257 bp, Glycine max
  Peptide Sequence Number=SeqID_112722
tccggtcgcccttcgcaagctcacctatggtcgcctcggcctccaaaagtcagccttaacgcttgcgatactgagctcaacagatctctggaccagcagactagatctcattcgtttcttcttttcggtagttgatgatttggctgcggttttattctctgctgaaaacctgatgtttggattgagatatgaggggttcggcgtcaataacaaaagaattattcgaactcagggcttaggatctaatggaatcgcag

SEQ ID NO: 21038 - DNA, 366 bp, Glycine max
  Peptide Sequence Number=SeqID_112723
atggaaaaacttaagcaatggctaaaccaagcagccccgcaaacttggcatcagccatcatttgtttctttgcctcaaagaagttcccccatagggactaaaagcatcaccgggaaggtttgcaaaggcaaaacccttcaccacacacccttccgtcatggtccatgttcatacggatttttcagtatgccttgcacacgtgtgggttgtttgtcacggaaatttggcgggcatgcattggatatatcgtgggtggtgtctagtgccccaaaatcacgttccttaaaattcatggtttctcggatgacgcttgccctggcgcttgcttatttttttcggatttacgcgatttcgctactactttaa

SEQ ID NO: 21039 - DNA, 315 bp, Glycine max
  Peptide Sequence Number=SeqID_112724
atgtcaataactctgctcctatactcattgaaagccgacaacctcaaactgatcatgcacatggaagcagtttgtggtatacccctgcaaaacactttggagggatttcagtatcacccacaaccacacccctcgcattccacaacggttaaaaaccctcatgctatggcagaaatggaaaagttggatcatctagaggaaaggctcaaggccattgaaggaggcgaagattatgccttttttaacctagaagagttgttcctagtacccaatatcatcactcctcccaagttcaaggtgccagccagactttga

SEQ ID NO: 21040 - DNA, 1029 bp, Glycine max
  Peptide Sequence Number=SeqID_112725
atggggggcaggtggaggaatagaggacgccgatcgcgacttgccgaatatgtgagccagcatgcagtaatgaccccgcggtggccgcggtcccggctgcgactggagcttgccatcccaccgttctatagtcgtttcgatcatgcaagggaatcgcccatgagcagagcaccggcttgccggcttgcctccttcgccctggtggccgtgctgagcaccaccgcctgcgcgaaggccccatccacggaaaaggacccgaacggaacccccatgtccgaaaccgcaaccagcccacgtacggtgggcggacagacctacacaatgcagccggtggaagctcggcttggcccgcaccgcttcatgttcccggccaacctctactacaaccagacgggccccttggccgatgggggcgtcatgctcactgtgttctggcctgatttcgatgcagcgcctcctggtgatcgcccggtgcgcagcacgcaggacagccggcggcaggtactggtcgagcttaggtacatcgatcgcgttcccatccagaactatctggcacgtcggtccagcagtgaggccaccagcgcgccggggtcgctggagcgaagagacccggtagagaatcttgcgctacgcgttgcacaacccgagcgatggggcctgacgccctattcgatcgacccatcgttgatggaagcctatgcaaaggagtcagaggctgcgctgggcaggccttacgtgcacaacccggggatggagccagactggtatgtggcccgctcggcggaggggcaactgacaacgttcatcagctgcgacccggcagaccgcattcctgacggacttgtagctcagggaaagacacttgaacgcgccggcgaaggccagatcgcaatgtgccgccattccatcgtggacgtgggcgatagcatcgccatcgagatgaactatgcacgcgtcatgctgagcgactggcagcgcctggagaacagcgtgcgtgatcttctgagccgctatcgcgttcagccgtaa

SEQ ID NO: 21041 - DNA, 150 bp, Glycine max
  Peptide Sequence Number=SeqID_112726
ggtctccaccggaagaaatttgctgacatcggctccggaaagggcgcagatgaccacattggcctttgctcatcaatcacacttggggtcactgaatgacgaggtgcggataaccgtaaggtgtctccgcgggctaccagctcttggatg

SEQ ID NO: 21042 - DNA, 339 bp, Glycine max
  Peptide Sequence Number=SeqID_112727
atggatttcgatagacactggttctggagtgcggaacaccagcaacggtttgagaccatcaaaggctggtcgttcctcagagagagacgagtccaactgagggatgaagagttcgttgagttccgagaggagatagcccggaggcattgggctccactcgtttcacccatggctaagttcgatcctgaaatagtcattgagttttatgctaatgcctggcctacggaagagggagtccgagacatgccctcttgggtgaggggccaatggattccttttgatggagatgccatcagcaagtttctggggcatctactgatcttggaggaaggcctgtag

SEQ ID NO: 21043 - DNA, 286 bp, Glycine max
  Peptide Sequence Number=SeqID_112728
tgatccttcccgtcacagtggcttctgtttctatcagctgtccctccctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcccaaacgacggccagtga

SEQ ID NO: 21044 - DNA, 567 bp, Glycine max
  Peptide Sequence Number=SeqID_112729
atggtggctatcttggcagatttgtttgacacctttgaccggaggtacacccgtgtccgcttcaaagctattgctcatgacgccgaaaaaggaagagtcgattgggaccaacatttggctgggatagggggcagcgcgatcaattggtttcctcgttggaaggaaggcaaggaaggagttcttttctcgtgtggggactaccctaatattccattgatagggactaggggcgcacaaagtctcaaggcgatacaaagagtccacaaggcgtggagaagtccgttgaggaaagacaaggagcttaggggcatccgtaatggcatcatcggaggttatcatggatggctaagaattcacacgcgggggctagattggctctccaagttgaaagttatcgatgaggaggactttgaagctccggaggaagatgaagaagtccgagctctaaaattagagttagggaaggcaagactcgccaaggagaagttcaaatcagctgctacacacatccggaaaggagtgcaccgagttacaagaggaaaacgcggccactgcaaaagcccttga

SEQ ID NO: 21045 - DNA, 714 bp, Glycine max
  misc_feature (668)..(668): n is a, c, g, or t
  Peptide Sequence Number=SeqID_112730
atggccaagcagagcatacggaaaacgctgtcagccttgccttgtggctcgcaagtagccctgggcatgtttaccgagcgcaatgtggtcaatgtcgtcaaaccggtcgaagtctgtagccatttcgctgcgctcgaccagacggtggccagtatggactggcgcatggcatgggcagccgattccttcattgcccatggggtgtacaacgcacttgagcaaacgccaaaattaggtaaagacacgcgactgatgttttttactgatggccagcaagcgccacccgcaaatccgaaatatatgccggtctacgcaggcaagcctggtgaggtccaggggtatctggtcgggatgggtaagtctacgcccagcaagatccccaagctggatgaaaagaatgcggtttccggttattgggagcaagaggaggtgcagcgctttgggaattttggcatggcagaaacgctgtcggtgttagccatggagcaaggccagcatgaccggaatgccgggcatgggccaggcaacaccttgttggaaaatgcacacttgtcggcgctggacgcgcagaacctgcgccgcctgggcgatgcgacaggcttgcacgttgtccgcctggatgatgtggcacaagggagcagttgggcgaccgggctgggaatgaccgnctggcgctgggccgatactgatctcaggccctggttggcctggccg

SEQ ID NO: 21046 - DNA, 435 bp, Glycine max
  Peptide Sequence Number=SeqID_112731
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaagcaccgcccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 21047 - DNA, 438 bp, Glycine max
  Peptide Sequence Number=SeqID_112732
ggtggaccttgggtactagttaccctcactgttgagaggactacacgtcctcgccttgagaggactacgcgtcctcaccatcagagggctgcacgccctcaccatcagaggactacacgtcctcgccttgagagggctacacgccctcatcttgggactacatgtcctcgccttgagagggctacacgccctcaccttgcggtactagttaccctcaccgtcagagggctacacgccctcaccttgagaggactacacgtcctcaccatcagagggctgcacgccctcacctctagaggactacatgtcctcgccttgagagggctacacgtcctcaccttgggtactagttaccctcaccgtcagagggctacacgccctcaccttgaaaggactacatgtccttgccagcagagggctgcacgccctcacctctag

SEQ ID NO: 21048 - DNA, 708 bp, Glycine max
  Peptide Sequence Number=SeqID_112733
atggctacctcaccaaaagaaacttcaactcctagttcaccctctgcaccatcaaaccaggaacgatctgaattcaatatccagcccatacagatgattcctggtcaagcccctgttcctgaaaaactggttcccaaacgacaacagggagtgaagatttcggaaaaccctagcattgcaacaagtcctagggaagtagacccggagatggataagaagatccgcagtattgtgagtagcattttgaaagacgcctctgttcctgatgctgagaaagatgttccaacatcttccaccccagatgttgctgttcctgatgctgagaaagatgttccaacatcttccaccccaaatactgaagtcctctcttcacccagcaaagaggaatcaacagaggaagaggatcaagccacaaaggagacccctgcaccaagggcaccagaacctactccaggtgacctcattgacctggaagaagtagaatctgatgaggaacccattgccaacaggttggcacctggcgttgcagaacgattacaaagccgaaaagggaaaacccccattaagaggtcaggacgaatcaagactatggcacagaagaagagtactccaatcactcctaccacatccagaaggagcaaagttgcaatccctttcagagaggaaagaaatttctcatctgattctgatgatgatgtcgaactagat

SEQ ID NO: 21049 - DNA, 69 bp, Glycine max
  Peptide Sequence Number=SeqID_112734
gctaggatcatccctgtcactttgaaccaagtcctagaggaaagcaaaatattgcatacatcaatctga

SEQ ID NO: 21050 - DNA, 480 bp, Glycine max
  Peptide Sequence Number=SeqID_112735
atggtgaaagttggaacctcttacgtgccgatcaacgtctcattttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcgggttttcccagtcacgacgttgtaaaacgacggccagtgaattgtaatacgactcactatagggcgaattggagctccaccgcggtggcggccgctctagaactagtggatcccccgggctgcaggaattcgatgggtttcttcatcttccacctccgtcgcaatgaaaccaggcttcatctccagcttctcctccttaaccttcatcttccacctcgtgtgtgtgatggatga

SEQ ID NO: 21051 - DNA, 316 bp, Glycine max
  Peptide Sequence Number=SeqID_112736
acagcagaaagtttatacggataaccactcgggtattttcgcctgtcagcatgactcaaaagtcaatatgacagatcttgtgagcgcggaagatgacgccgcaaaagacgacgttggtctctacgtgctatcaggctttttgtcttacagacagcaaaaagtttatacggataaccactcgggtattttcgcccgtcagcgtgactcaaaagtcagtatgacagatcttgtgagcgcggaagataacgcttttcgtgcttacagacagcaaaaagtttatacggataaccactcggtatttccgccgtcagcgtga

SEQ ID NO: 21052 - DNA, 275 bp, Glycine max
  Peptide Sequence Number=SeqID_112737
atggctaccatagatattactggctcgaacaacaatgacctcaacaaaccttttagatttgaaggaaaagttgcttgtgttttgaacactgatattccaatgatgtctaaagatgctgagaaggaagtgaaggataaaatgactatgaacttagctctttggaatgaaaatgattacctatgcaagaatttcattctgaatgggttagctgatgatctctatgattatagtccatataagtctgccaaattagtttggttggctctggaagagaa

SEQ ID NO: 21053 - DNA, 210 bp, Glycine max
  Peptide Sequence Number=SeqID_112738
atgatgatccaccaccgaggcacagacttagccaacgggcgcaagccaaagttgcaaatctgcaacaaactgatcacggggggaggaggggccaacaatccgaacttagcacgggccataacccagccccgacctagccaagccaacaacgggcaaaaaccacgaagtgaccgggggcaaaatttcaaccaacggcttgccaagacctag

SEQ ID NO: 21054 - DNA, 551 bp, Glycine max
  Peptide Sequence Number=SeqID_112739
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctttcgctccaagctggactgtatgcacgaaccccccgttcagtccgaccgctgcgccttatccggtaactatcgtcttgagtccaacccggaaagacatgcaaaagcaccactggcagcagccactgccagttacctcggttcaagagttggtagctcagagacttcgaaaaccgccctgcaggcg

SEQ ID NO: 21055 - DNA, 334 bp, Glycine max
  Peptide Sequence Number=SeqID_112740
gacgcgtagccctctaaaggcgaggacgtgcagcactctgaagttgaggacgtgtcgccctttgaaggtgagggtgtgcaatccactgaaggtgagaacgtatagtcctctaaaggtgaggacgtgtagtcctctgaaggtgatgaacaaaaagctcaaaagatcaaagaacaactcaagtgaatcaaagaacatctcaagtgaatcaagaacaggtcaagagttccagaatcaaggagaattcaagactcatgaagaaagcctagaatcaagaatcaagactcaagatctcaagaatcaagatcaagattcaagactcaagattcaagaatga

SEQ ID NO: 21056 - DNA, 373 bp, Glycine max
  Peptide Sequence Number=SeqID_112741
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaattcgctccaagctggactgtatgcacgaacccccgttcagtcgaccgctgcgcttatccg

SEQ ID NO: 21057 - DNA, 195 bp, Glycine max
  Peptide Sequence Number=SeqID_112742
atgacggagaaaaaaatgatgacaatgatagtggacacattaccagtattctactatgaaaagatggtaggctacacaccttcaagctttgatgatatggtcttcaccgacgaaaggatcaaagtgggtctaaaaagagccaataaccacccttctcattacccaccaccagtcatccacaaaggccatccctaa

SEQ ID NO: 21058 - DNA, 276 bp, Glycine max
  Peptide Sequence Number=SeqID_112743
atggacaagtgtcttgtgaagttacaaaccaaatttcgagaagatccaacggttaaagaaggctgggaatcatttttaccgaggcagctccatgtagttttctctagaagcttcattaagaggcttctagcacactccagacatcttctcaaagatcccaacgatccaacggttaatgaaggctgggcagcgtttttaccgaggcagctgcatctagctttctctagaagcttcattaagaggcttcctctagaagcttcctcgtggcttctttga

SEQ ID NO: 21059 - DNA, 486 bp, Glycine max
  Peptide Sequence Number=SeqID_112744
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtgggcgaattggagctccaccgcggtggcggccgctctagaactagtggatcccccgggctgcaggaattcgatgatattgagatcttggacgacgagattcagcgcatccgcaagctcatggagaacatgctcgctactgcgactggtcagagcgatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 21060 - DNA, 256 bp, Glycine max
  Peptide Sequence Number=SeqID_112745
acaccaagtgagatggaagatagcccgcaccccgagaataggggagatattgagtgagggcgcaaaagaaatcgctgagaagatcgatgttctcactgttgctattagacatccagagcaccctagacatgtccgtgctactggagccggtgtctccatcaagcagtccttcagatcagctccacggacgtcccgcaactctttctcgctgcctctcgaagaaaagcagcagctgacccagcaaatcagggactag

SEQ ID NO: 21061 - DNA, 321 bp, Glycine max
  Peptide Sequence Number=SeqID_112746
atggatccgtacctcgggaaaaggattggctctgagggctgggcacgggggtcccagtcccgaccccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgattcccactgtccctgtctactatccagcgaaaccacagccaagggaacgggcttggcggaatcagcggggaaagaagaccctgttgagcttgactctagtccgactttgtgaaatgacttga

SEQ ID NO: 21062 - DNA, 1011 bp, Glycine max
  Peptide Sequence Number=SeqID_112747
atggctacctcaccaaaagaaacttcagctcctggttcaccctctgtaccatcatctccttcatccaccaaagcaccatcaaaccaggaacgacctgaattcaatatccagcccatacaaatgattcctggttcagcccctgttcctgaaaaactggttcccaaacgacaacagggtgtgaagatttctgaaaaccctagccttgcaacaagtcctagggaagtagacacggagatggacaagaagatccgcagtattatgttccaacatcttccaccccaaatgtttctgttcctgatgctgataaagatgttccaacatcttccaccccaaatgctgaaatcctctcttcacccagcaaaggaggaatcaacagaggaagaggatcaagccacagaggagacccctgcaccaagggcaccagaacctgctccaggtgacctcattgacctagaagaagtagaatctgatgaggaacccattgccaacaagttggcacccggcatcgcagaaagattacaaagcagaaagggaaaaacccccattactaggtctggacgaatcaaaactatggcacagaagaagagcacaccaatcactcctaccacatccagatggagcaaagttgcaatcccttccaagaagaggaaagaaatttcctcatctgattctgatgatgatgtcgaactagatgttctcgacatcaagagggccaagaaatcagggaaaaaggtgcctggaaatgtccctgatgcaccattggacaacatttcattccactccattggcaatgttgaaaggtggaaatttgtatatcaacgcagacttgctgttgaaagagaactgggaagagatgccttggattgcaaggagatcatggacctcatcaaggctgctggactgttgaaaactgtcaccaagttgggagattgctatgaaagtctagtcagggaattcattgtcaacattccctctgacataacaaacagaaagactgatgattatcagaaa

SEQ ID NO: 21063 - DNA, 309 bp, Glycine max
  Peptide Sequence Number=SeqID_112748
atgctccacaggccgcaggcgcgccaccaccacctcatcaggctggcctggctggccaaccaccgggcacatgtacagacccatgattgtctgtaccagctgagcctcagcatgcagagccagggcttcgcttctttttcatgccctactccagaccagttcaaggcagaggtcgcatggcccggggattggctcgaggcccaagcaggagaggcgcccccagaagctcccggcgatggagaggaggcccacgaggacgaggagatggccgatttgcttgacttcttgggaaggagtggagctacatga

SEQ ID NO: 21064 - DNA, 545 bp, Glycine max
  Peptide Sequence Number=SeqID_112749
atgggggataagcttcatcgtcgagagggaaacagcccggatcaccagctaaggcccctaaatgaccgctcagtgataaaggagatgaacggggctaagcgatctgccgaagctgtgggatgtaaaaaagaatcggtaggggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactccccaggaaaagctcgaacgaccctcaacaaatggaccatgtatgggggctgacgcctgcccagtgccggaaggtcaaggaagttggtgacctgatgacaggggagccgacgaccgaagccccggtgaacggcggccgtaactataacggtcctaaggtagcgaaattccttgtcgg

SEQ ID NO: 21065 - DNA, 591 bp, Glycine max
  Peptide Sequence Number=SeqID_112750
atgactatgcataacatgcagtttcagcaagagaacagagcctgcattcagagcttaaccaatcagatgggacaattggctacccaattgaatcaacaacagtcccagaattctgacaagctgccttctcaagctgtccaaaatcccaaaaatgtcagtgccatttcattgaggtcgggaaagcaatgtcaaagacctcaacccgtagcaccttcctcatctgcaaatgaacctgccaaacttcactctattccagaaaaaggtgatgacaaaaatttacctaacaatttctgtgcagctgaagcttatgctgcaaatatttacaatagacctcctcaacctcagcagcaaaatcaaccacagcagagcaattatgacctctccaacaacaaatacaaccctggatggaggaatcaccctaacctcagatgttccagcactcagcaacaacaacagcagcctgctccttctttccaaaatgctgctggcccaagcagaccatacattcctccaccaatccaacaacagcaacaaccccagaaacagccaacagttgagcccctccacaaccttccctcgaagaacttgtga

SEQ ID NO: 21066 - DNA, 387 bp, Glycine max
  Peptide Sequence Number=SeqID_112751
gtacggcctcgatcaaatttggcgccgttgccggggagcagtgtccaaagttttaccattaagcgtttcccctggttcagtcttgggtgttttgctgtgaagattgtgcttgaaaacagagtagtagtagaaatcagcttgcggaaaaacagatgtatgactagaggcaatccatctgacttacaaccctttgatcctgacatagataggacatttcatagattagttaggcatcattttatacctttttatcattctgagcattccataactggtgaatctgtgcattctgttattggtgattttgaacatcctgatcttgagcattataattttgagcattctgattctgagcattctgattttgcacattcggggatcctctag

SEQ ID NO: 21067 - DNA, 610 bp, Glycine max
  Peptide Sequence Number=SeqID_112752
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 21068 - DNA, 427 bp, Glycine max
  Peptide Sequence Number=SeqID_112753
atgactccgaaaaagctttccacgaagaggtctaggagagacaccacggcggaagggtccagtgccgcccccgagtttgatagccaccatttccggagcgccgagcaccagcagcgcttcgaggccatcaaaggatggtcattccacagagagaggcgcgtccagctcagggtggataagtatacagattttcaggaggagatagctcgcaggcatcggacgtcgttggtgacttccatggctaagtttgaccctgaggtagtccgggagttttatgctagtgcttggcccacagaggaaggagtgcgagacatgcgttcatgggtaaggggtcagtggattccctttgacgcagatgccctcagccagttcttgggtgacccgctagtgttggaggaaggccagcagtgcgagttcagccagaggg

SEQ ID NO: 21069 - DNA, 730 bp, Glycine max
  Peptide Sequence Number=SeqID_112754
atgccttttgaatgcaagaaatggccccgaggaaacttgcctcaaagagatccaggaaggataaagtggccgaaggaactagttcctgctcccgagtatgatagtcaccgctttaggagcgctgaacaccagcagcgcttcgaggccatcaagggatggtcatttctccgggagcgacgagtccagctcagggacgatgagtataccgatttccaggaggagatagttcgccggcggtgggcatcactggttacccccatggccaagtttgatccagacatagtcctcgaattttatgccaatgcttggcctacggaggaaggcgtgcgagatatgaggtcttgggtaaggggtcagtggatcccgtttgatgcagatgctatcggccagctcctgggatatcctttagtgctggaagagggtcaggagtgcgagtatggccagaggaggaaccggtccgatgggttcgatgaggaggccatcgcccagttgctatgtataccggggcaagattttgcccggactgctgtcgggagacgggtgcggatcatgcgcaccaacatgaccaccctgactcagatctggatgactttgctgctcagcaacatccagcccagcgatcataattccgacctccccctgccgaagtgtccgctggtgtacgccatcctgacgcggatgagcattcacgtggctcagttaatcgctgatgccatctatatatttgcag

SEQ ID NO: 21070 - DNA, 650 bp, Glycine max
  Peptide Sequence Number=SeqID_112755
ttgtcctctttctgaatatggaagggttagtggacctaccagtaattgacgctttcctcgcctttcatcatggcaaggaaagcccggtcgtcgccattttggccatgtatgacacgttcgaccgaggatgtgaaaagagcgacgcaagaattttttgttgtgcactggctctctatgtgtggctggtttcacacccttttctccaagaaggtaggcccgtctatccgctacaaggtcaccgcttgtgcgtcgaaaaagggaaggcgaattgggaccaactcttggctagcatggaggggcgtctgggttgtattaattataatcccgtcctcgccataagacagcttggctaccccgtgagaggagcgccattagacaaaagcatcacgcctttcattacacggggtttcagtgaccccaatgcaaaggacagagagcttaggggaagcagtaatgggatcatcggtggctatcataagtggctgagagtccggacacaaggattggattggctcccaaatctaaagactgtgagagacaatgaggttaaagcttcggaagaaagtgatgaggtgcaagcgctaaaggcaaagcttgaaagaacctgggtagtcaaagagaagttcaagtccatagccatcaaagtctga

SEQ ID NO: 21071 - DNA, 417 bp, Glycine max
  Peptide Sequence Number=SeqID_112756
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgagtggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 21072 - DNA, 532 bp, Glycine max
  Peptide Sequence Number=SeqID_112757
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctttcgctccaagctggactgtatgcacgaaccccccgttcagtccgaccgctgcgccttatccggtaactatcgtcttgagtccaacccgggaaagacatgcaaagcacactggcagcagccactggtaattgatttagaaggagttagtcttgaagtcatgcgcgg

SEQ ID NO: 21073 - DNA, 360 bp, Glycine max
  Peptide Sequence Number=SeqID_112758
atgaatgagtttgacgcacaggtggcctggccaggagcccagccttctccttctagaaggggtggggcctccacaggccaggaacctgagccagaggagccagctgcagtagcagagggggaggatgagctcactcctcctgagcccttttattttgatgcaggtgtacacatagctcaggaggaggagactggcacagaccagattccagagccatctccagcacccatacctgatgatgccataccatctacatcaacatcagagttagagcagcctatctctcaggattcaccaactactcaggtgttggatctcaatgagcatgcacaagagcaaccacaggagcagaacatttaa

SEQ ID NO: 21074 - DNA, 219 bp, Glycine max
  Peptide Sequence Number=SeqID_112759
atgggtgtaagggataaatcaatcatgcacaagagattcatgcaaaaatcattactcaatgttagtcgttctctcacaattaaagatcacactctcaccgggttgcggctaatgcgttccttcacaatcaacctgacaaaccaactaacattttcagtcatgatcctaattccatgttctttctcttctaatgattgcatgctcattcaaggcatatga

SEQ ID NO: 21075 - DNA, 378 bp, Glycine max
  Peptide Sequence Number=SeqID_112760
atgaattgccgagtagatagatcagatccggacgcggctgttgctccgcggcgatacggactcgacccgctcctacccaccccggggcaccatagcatgtcgggaataaggggggacatactggacgtaaccactcccttgggggcggctgtgccgccctgcctttcgatcgatacacagttgagtaggccgatcacgaacgctacaggggaagggaagaaggggcctaagcacggcagatgccgtacacttgagtggcaaaggaaagggagatcgtacctgtttttccaggcctgttcggacatatggttcccgcggaagatcaagttggtgagccgtgtgatgggaaaccttcccgcacggttcggagagcactga

SEQ ID NO: 21076 - DNA, 249 bp, Glycine max
  Peptide Sequence Number=SeqID_112761
atggggatcgcacccacaaagacacccagtggacctgaagaagtccaacagggccctggggtttccagctctgggatcgtgcccgcaaaacactctgtggacccgaagaaggccaataggttccacggagtgcccgttgcccccaacaaggtcattaggtcccgcattaaccaggctttcatcaagaagtactacgcccccagacgggcgcagggcgaaacagcacagcagcattgggatggccggtag

SEQ ID NO: 21077 - DNA, 249 bp, Glycine max
  Peptide Sequence Number=SeqID_112762
atgtgggacattctagctggaatgtataaaggaatgccatgggtaaagaagatgacatccaggaagaggaagagcactgcttctagacccacagctcagtatgataccaggcgattccaatctttggaagcttggaatagatacactgacaacattctcggctggaatatccttctggagagaaatgtgaagctttatcatactgagtttgatgagttcaaggtggagttggaaaggcgtaatttttag

SEQ ID NO: 21078 - DNA, 342 bp, Glycine max
  Peptide Sequence Number=SeqID_112763
atggtgaaggtacaagatgcatcttctgaggccaccatccctaagccattcatttttgaagcaggtgagacacagataaggcaagaggctgctactccagagagatcaccacagatttcaccagatccaccctctccagtggtggatcaatcttctcttcaacagccagcagaccctcctacaccagtgcatgagatgccaacagacccatctacaccattacttgatcttccagaggacccttctacaccagtcctgggattgactaccactcctgtgctacatcttacagatgaggaggacactcaggatgaggatactcagtcactggacctgtcatag

SEQ ID NO: 21079 - DNA, 228 bp, Glycine max
  Peptide Sequence Number=SeqID_112764
atgatgaccaaggtgatgaacaaaaagctcaaaagatcaaagaacaactcaagtgaatcaagaacaagtcaagagttcaagaatcaagaagaattcaagactcaagaagaaagcctacaatcaagaatcaagattcaagattcaagattcaagattcaagattcaagattcaagattcaagatctcaagaatcaagatcaagattcaagactcaagattcaagaatga

SEQ ID NO: 21080 - DNA, 450 bp, Glycine max
  Peptide Sequence Number=SeqID_112765
atggaacttcaacgtctcaaccaaaatgaagagactgacaaaaggaaaagaagcatagcactcaaagcctcatcctcaatgcaagaagaagaagaagaagaagaatctgatgatgaagagaacttctcactctttgtgaagaagtttcataaattcgtcaaaaatagaagaatggagagatgccataacttcgacagtaggaagagatctcaagaaggtttcccaacacttaaatgctataagtgtaatcgacccggtcacataaaggcacactgccccacaaatgaatcatggccagaaaagaatgagaagaaaagccatgaagaaagaagatccaagaaggcgtatattgcttgggatgacaatgactcatccgatggtttggagaaggagatcaaccttctatccaaggactatgagagcgatgagaacatctctcaagaacattaa

SEQ ID NO: 21081 - DNA, 300 bp, Glycine max
  Peptide Sequence Number=SeqID_112766
atgcaccgcctccacctcctcaggctgacccatttgtgtcatttgacacggaacggtatttacggcatttggttcgccagcaggcggccaatcacagggcgcacgtgcagacccatgactctctatatcagcttagcctcagcctatcagttcagggcagaggtcgcatggcccggagattggcctgaggcccaggctgcaaaggcacccacagagactcccggtgagccagatgaggctcgcgaggatgaggagatgtcagatttgctcggcttcttgggagggagtggagccacatga

SEQ ID NO: 21082 - DNA, 336 bp, Glycine max
  Peptide Sequence Number=SeqID_112767
atgaatgagattttggatgttagcatttcgtttctaaatgaccatttggaggaaacactgggttcaacaaaaatagaagaaaatcactcaaagtgtatcaatctcacacagtgtgaggcgaacaagtcaccgatgcacaggattttggttggcaatcaaagggagaggaccactttaggtcatgatttcctttcttttcttgtttacttggtgacaattctatattgttcagatattgtctgggcaaggtttatggtgagttgggaccttggctcaaggcttgtagaatcggatggacatgatatacgtcagagcgttggtttggccagcggttga

SEQ ID NO: 21083 - DNA, 420 bp, Glycine max
  Peptide Sequence Number=SeqID_112768
atggagagacttggcaactcaagtagcacccccaataacagagaaagagattatcacaatgatagtagacacgtgaccggtgttctactatggaaaatggtaggttacacaccttcaagttttatagatttggtcttcgccaacaaaaggatcgaagtgggtctgaaaagaggcaaatttaatcatccttcttggacgaatgagaaaactggggcaaatgaagagggtgagaaagagggagaaacccatgctgtgactgccattcctgtacggccaaatttcccaccaacccaacaatatctttactcagccaataacaaactttctccttacccaccacccagttatccacaaaggccatccctaaatctaccacaaagtctgtctaccgcacttcccaatgacgaagaccacctttag

SEQ ID NO: 21084 - DNA, 309 bp, Glycine max
  Peptide Sequence Number=SeqID_112769
atgtcgccacacgggggcgacatggatgggggtgacaaaggaaagagagggatggggaggatagatggggcgattcaggtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctggggtga

SEQ ID NO: 21085 - DNA, 267 bp, Glycine max
  Peptide Sequence Number=SeqID_112770
atggcggcgcagctaatccgtgatcgagtagagatggagtgcctagagggagcttgggagaccctcgaaggcaacacgaggtgccgatttcggggcaccattcgattcatggctacttctttggtgcatccagatgaacctgcacggacgcttcagcgcacggaatttgatgattgtacacttgtggctgaagccaccactatggacacctttgctctggatgacactatgtattttgtaaaactcccatattttggacagctttaa

SEQ ID NO: 21086 - DNA, 609 bp, Glycine max
  Peptide Sequence Number=SeqID_112771
atgacattgaccaccctagagcttttcttgaggccttatcaggttagatgggatgccaccgtgttcggggtcgttaatccagattttcccctgtacataaagcacgaagacctctccgaaatcgcacacggtggtcaatgtctcagcatatcagtgcatctcactgaaacatgtatgcgagcggggaattctgatatctatggattcctcgagcctcagtccattcaaaggttccactgcagcggacattggcagatggtggtcatcctgcccaaggaacacatagttgtctggttttgttcattgcataacaggcaagacaactaccttaaggggattattaatagtgctatcaagggtcttgatgatgctccacaacctaaatcaaaggcttctgctaggtggattgtcatcaagtgtaatagacaaaaaggaagtactgagtgcggctactatgtgatgcactggatgtccaccatcattttaggaacttttaggaataattgggaagcgtattttaacgatcctagaccattggagccagagagattaaaagcattgcggatccagtgggcacagttttatctccgagttagagatcaggcctag

SEQ ID NO: 21087 - DNA, 704 bp, Glycine max
  Peptide Sequence Number=SeqID_112772
ggcttcccggtatcaacagggacaccaaggatttattttattctgcgaagtgatcttccgtcacagtggcttctgtttctatcagctgtccctccctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtcaggtcgtaagctcctgtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggggagaaaaaaggctgcaccgggtgcgtcagcagaatatgtgatacaggatatattccgcttcctcgctcactgactcgctacgctcggtcgttcgactgcggcgagcggaaatggcttacgaacggggcggagatttcctggaagatgccagggagatacttaacagggaa

SEQ ID NO: 21088 - DNA, 273 bp, Glycine max
  Peptide Sequence Number=SeqID_112773
atgaacaagattagaaatggtcaagataaaggaaagtggataacagctaatgttcgagcaaccttggacgaacattggggttctacagatttcctaaacaatagctccactgccaaggcgaatcgatctattgatagaggagcctcagcatactatggtggttccatatctactgcaactcactttgaaaagctggtaattttacttcatatatatgcattcaaaggagttttaaagaccaccaactgcttgggaggtgatggagaaaactaa

SEQ ID NO: 21089 - DNA, 291 bp, Glycine max
  Peptide Sequence Number=SeqID_112774
atgtccagacgagaaaaatcctttgtagaggctgaagctcaagagaaaagccctgtaaaagagcatgagtcaagagaaaaagatgaggagaaagatgaggaacaagcacaacaacaatgggaaaagtactcaaaagtagaaaaccaacaagaaaatattctccaaagcaataaccttcctcatcaactaattgataagaaaggaaggcaaggagagcatgaggaaaccttaagtgccattctttctttaataactaacacctttcttgaaatgtccttccagattatatga

SEQ ID NO: 21090 - DNA, 615 bp, Glycine max
  Peptide Sequence Number=SeqID_112775
atgccccatttttacgctgaatgtaccgacaacatccgccgcgaggcggatttgcccacctgttcgccaaggtcaacgaggcgctggcggcgaccggcatctttccgctggccggcgtacgcagccgcgccatctggctcgacactggcagatggccgacggcaagcaggactacgccttcgtgcacatgacgctgaagatcggccacggccgcagtctggaaagccggcagcaggtgggcgagatgctgtttgcgctgatcaaggaacactttgccgcgctgatggcgcagcgttacctggcgctctctttcactatggaagagctggatccgagcaggttaaccgcgccgtacagcgcctgcatcaggcggaaaagagtcgtgaacagatccgcgcgctgtcgctcgatcatcccgagatcaccatcgaggacgcctacgccattcagcggcagtgggtggagctgaagatcgccgaggggcgcacgctcaagggccacaagatcggcctgacctcgcgcgccatgcagcgacattccgatcgatcgctttatcgtgccgcgggtggaggtggagctggcgttcgtgctggccaagccgctgcgcgggtttaa

SEQ ID NO: 21091 - DNA, 345 bp, Glycine max
  Peptide Sequence Number=SeqID_112776
atgaaggctgacatagaggccatgaaagagaaaatgaccacaatgatggaagccatgatgagtatgaggaaaatgatggaggttaacatggctacagtcgttaccacaggtatcgccactaagatggacccgactcacccatctggcctcaatcaagtaaatcgtccagtctcagttatggtaggtcagggaggcgaaacattgggaagtatgggcggcccccattttgtgcaggtccagaacaagcattccttcccaccatatgacttacctcccaactacacaccactcaagttgtacatgctcccgatgagaacatcaataaatctactctcataccattga

SEQ ID NO: 21092 - DNA, 1137 bp, Glycine max
  Peptide Sequence Number=SeqID_112777
atgacagaacaacaaaaattcaccttcccgatgctcctgcaacagctcgattctctgacgctgcgcgataaacagcgctttgcccgccgtctgcacggcgtgaagaaggttaaaaatcctgatgctcaacaggccatttaccaggagatggcgaaagagattgaacaggcggcagggaaagttgtgctgcgcgaagccgcgcgtccggcgattacttacccggaaaacctgcccgtcagccagaagaagcaggacattcttgaggccgtgcgcgaccaccaggtggtgattgtcgcaggcgaaaccggttcggggaaaaccacccagctgccgaaaatttgtatggagctggggcgcgggataaaaggcctgattggccacacccagccgcgtcgtctggcggcgcgtaccgtcgcgaaccgtattgccgaagagctgcagacggagccgggcggctgcatcggttataaggtgcgcttcagcgatcatgtcagcgatagcaccatggtcaagctgatgaccgacggtattctgctggcggaaattcagcaggatcgcctgctgatgcagtacgacaccatcattatcgatgaagcgcacgagcgcagcctgaacatcgacttcctgctcggttacctgaaagagctgctgccgcgtcgtccggatctgaaagtcatcatcacctccgcaaccatcgacccggaacgcttctcgaagcacttcaacaatgcgccgattatcgaggtgtcaggacgcacttatcccgtggaagtgcgctatcgcccgatcgtcgaagaggcggatgataccgagcgcgaccagctgcaggctatttttgatgccgttgacgagctgggtaacgaaagcgcgggggatatcctgatcttcatgagcggtgagcgtgaaatccgcgataccgccgacgccctcagcaaacgcgacctgcgccacacggagatcctgccgctatacgcgcgtctgtcgaacagcgagcagaatcgcgtcttccagccgcacagcggacgccgcatcgtcctggcaaccaacgtggcggaaacctcgctcaccgtgccggggattaaatacgttatcgatccgggtacggcgcgcatcagccgctacagctaccgcaccaaa

SEQ ID NO: 21093 - DNA, 854 bp, Glycine max
  Peptide Sequence Number=SeqID_112778
ggctaaaagcgcaactgttagcgccggtgcggatcttcaacgcctggcggcaggcgcgggcgatcatgaaacgtttccagccggatgtggtgctgggcatgggcggttatgtttccgggcctggcggcctggcggcatggtcgctcgggatccctgtggtgctgcatgaacaaaacggcattgccggcctgactaataaatggctggcaaagattgcgaagaaagtgatgcaggcgtttcccggcgccttcccgcatgcagatgtcgtcgggaatccggtgcgtactgacgttctcgcgctaccgctgccgggacagcgtctggtgggccggcaggggccgattcgcgtgctggtggttggcggctctcagggcgcgcgcgtgctgaaccagactatgccgcaggtggccgcgaagcttggcgatgcggtgactatctggcatcagagcgggaaaggcggcatggataccgtgcgccaggcgtacgccgccgccggtcagccgcagcataaagtgactgagtttattgatgatatggcggcagcctatgcctgggccgatgtggttgtttgtcgttccggcgcgctgacggtcagcgaaatcgccgccgcaggtttaccggcattgttcgtcccgttccagcacaaagatcgtcagcagtactggaatgcgctgccgctggaaaaagccggcgcggcgaaaattctcgaacaacccgagttcacggcggatgctgtggcggccaccctggccggttgggatcgggaaaccctgatggatatggcgggaacgagcgcgtggcgcttcgattccggatgctaccgagcgggtagcggaaagaggtcagcgccgtag

SEQ ID NO: 21094 - DNA, 309 bp, Glycine max
  Peptide Sequence Number=SeqID_112779
atgcaggttagctcgcctgggcaagctgagctcgcctgggcgagcaacctctacacaaaatgggttaaaaagggggagggggaaggtttctgcaccaaaatctctctccaccccccccccccccattcaaaaaaacaagagctcacgggactcatggattttgcagcccttaggtcaccatttttcgcgtttttgattccattttgctctattattcatctccaacaagggaaggccctaagcctatgggggattctgggaaaaagggggatgccccattggccccatttccttggttttcatggttaa

SEQ ID NO: 21095 - DNA, 55 bp, Glycine max
  Peptide Sequence Number=SeqID_112780
atgacaaaaatcattcagcttatagaaggagcaaaagatacggttatcattcaag

SEQ ID NO: 21096 - DNA, 993 bp, Glycine max
  Peptide Sequence Number=SeqID_112781
atggtgcaagcgacccgcacggtcatcttctcccgcggccagcagctacagcaggagatcgccgagcgcgggcagttcttcggctggcaggcgctggttctgtttctgctgagcctgacgctggttttgctgtttacccgcatgatcatcggcccggtgaagggcatcgagaagatgattaaccgcctgggagagggaaagtcgctggatgatgcggcactgttcaccggcccgcgcgaactgcgatcggtcggtaaacggattatctggttgagtgaacgtctggcgtggctggagtcccaacgccaccagtttcttcgtcatctgtcacatgaactgaaaacaccgctcgccagcatgcgtgaaggtacggaactgctggcggaccgggtagcggggccgctgacgacggaacagcaagaaatcgttgagatccttgataacagcagccgcaatctgcaaaagctgatcgaacagctgctcgactataaccgcaaactggccgatggcccggtcgagcggcagaaagtggatattgccgaactggcgcagaccgtcgtttccgcgcatagtttaccggcaagagccaagatgatgtctaccgagctggcgctgggtgaacgcttctgcctggcggagccgacgttgctgaccagcgtgcttgataatctgtactccaatgcggtgcactatggcgctgaatccggtaacattcggattcatagttaccgccacggcgagcaggttcgtatcgatgtcgccaatagcggcgagccgatccccgtcgccgaaagaaatatgattttcgagcctttttatcagggaagccacctgcgtaaaggggcagtaaaaggcagcggtctggggttgagtatcgcccgcgactgcgtacggcaaatgcagggagagctgagcctggtcgatgataatcccgggttcatctgttttcgcatctcgctccccgccgctgagccgggaaaaaccaacacatga

SEQ ID NO: 21097 - DNA, 1758 bp, Glycine max
  Peptide Sequence Number=SeqID_112782
atgttgctcttgttacaagactctttacaagaacagatgatgcatggcagctttgttctcgatggtcgtgatgatatattgaatactgctattggccgaccggagcatctaggccgtgttcgtgtagcggggactggtgtcataatcagccagtactttgaacatgcctcacgttgctccaacacttcccttacatcaattagcccacaacaattagttaacatcatcggaaacctaaaggaagagtggaggagagaagtagaagaggaaaacaaaaacctgaatgaagcatggaggagagaagtagaagaggaaaacaaactcagtttggagataatgaaacaagggttgaagaaggcaataaaaattaagttatcccaaatggaatcacaacacccaccccacgttgaggcgtcggatatacaagtattagttgcacgtgaagagtcttctggagttgatgtggctagtgtgggcttgtacatagtaggtgatcaatgtacacacctagtggccttgggaaaagtgtatgatagtgtgaccaccatacacaatgtcccttattcaaataatgtgcttaggaagcttgttgagttgtcgtgggatgagacaaaatttggtattcctaatgtacaagcatccttcttcattatacatgcagatgtaactgaaataatatcaggtgacaaatgtttgaacatatctatactacagttgcggatgatggcacaatggaagcttgttgttgtgtgtccatgggacaatactattgtttggttttgttctttgcgtaagaagcctgatgttaacatcaaagctacaattaacagtgcaatgaagacattaaccactagtttggaaggtaaatcggatcaacccgtacctcgttggattgaaacaaagaacatgttaaatatatttcatattgaatttagagtcatgttcaaactagaggctgagtgtggatattatgtcatgcattggatgtggaacataatcagcgggggcttgaagaatgaatggaacaagtggttttctgatggaacagagttagacattgaggccatgacaacactttgcaaaaaatgggcaacatattttttacaagataagtgttttttgtactggcacacttggcattttgcagcttattgtcaacctaagaattttggtagtcctgttgacagccttaatcacaagaacaaaaatcaagttggagaaagtattggtgttcaggattttgaagtgttgaaggttgttgggcaaggtgcttttggtaaggtgtatcgggtaaggagggctggatttatcttgtgcttgattttgtcaatggtgtccaccttttctttcagctctatcaccaaggcctatttagctagcagtcttatacattcaacttttgtcagggcagatttggcttgcttctatgctgcagagattatttgtgttgtttcttatcttcatgcaaatgatataacccacagggatcttaagcctaaaaatattcttcttgacgaagatgacatgcctgtcgcaacctacccttcggcaggagggcgacgcgagactcgcgggaggcgtgttccacgaaaggaatacgcgcggagtcgtcaccaacgtttatttgaggaaaacgtcggaaaaaccggaaaagacgcgatcaacgaacttttaagtgaaaaggttcgggagttgtatttacgcacggggaaggtattagcaccccacacgtccgtcccaagggacggcagcctttaa

SEQ ID NO: 21098 - DNA, 240 bp, Glycine max
  Peptide Sequence Number=SeqID_112783
atggaggagcaagcagaatatgataatgatgaattggagaaagtgaatggtctactcaaagaaaaggaaaaagagatacaagatttggaagctgaggaaaaggattacatttctcaatttttgaaaaacttggaagagaaggttcatcaaatttatttgcatgcacctaatgatagatctgagaaacttgaagtcagtaaatcgaatcaacaaggagcttctaatggtgaatggccttaa

SEQ ID NO: 21099 - DNA, 441 bp, Glycine max
  Peptide Sequence Number=SeqID_112784
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccggtaactatcgtcttgagtccaacccggaaagacatgcaaagcacactggcagcagccactg

SEQ ID NO: 21100 - DNA, 250 bp, Glycine max
  Peptide Sequence Number=SeqID_112785
cggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggccgcggcgggtgtggtggtacgcgcagcgtgaccgctacacttgccagcgctgatgtccggcggtgcttttgccgttacgccaccacccccgtcagtagctga

SEQ ID NO: 21101 - DNA, 1582 bp, Glycine max
  Peptide Sequence Number=SeqID_112786
gacttgatcttgttgtggatggctgaagatcttttgaagcttccaaacagaggaaaggcgttagaagttgcattataccttggtggagaattctatttcagatcagaagaacttggaaaagaaaccaagattggtataaagactcgtcatttgtcagttacaaagttcagtgatccaatctcagatattgaagtttttgacagactacaatttttgagaactttattggcaattgattttaaagattcttcattcaacaaggaaaaggcaccaggtaaattgatccatttgcgttatttaaatctctctcatacaagtataaaaacactgccggagtcattgtgtaatttgtacaatctacaaactctggcgttgtctcgctgcgaaatgttgaccaggttgcctactgacatgcaaaatcttgtaaacttgtgtcatcttcatattgatcatactcccataggagagatgcctagaggaatgggaatgttaagtcatttgcagcatttggatttctttattgtgggcaagcataaagagaacggaatcaaagaactggggacactttcaaatcttcatggttcgctttctattaggaatttggagaatgtaaccagaagcaatgaagcattggaggctaggatgatggataagaagaacattaatcatttatcgttgaaatggtctaatggcaccgacttccaaactgaattagatgtactgtgcaaattaaaacctcaccaaggcctggaatctctaacaatatggggttataatggaaccatatttccagattgggtgggaaatttttcctaccacaacatgacatatctaagtttacgtgattgtaataactgttgtgtgcttccttcacttgggcaactaccgtgtcttaagtacctcgttatttcaaaattgaattcactgaagacggttgatgcagggttttacaaaaatgaagattgttcttctgtgacacccttttcttcccttgaaactctagaaattgataacatgttttgctgggagttgtggagtacccctgagtcagacgcctttcctctactcaagtctcttagaatagaggattgccccaaactaaggggagatttgccaaatcaccttcctgctctggaaacacttaaaattaaaaattgcgagcttcttgtctcttctctcccaagggctcccatccttaagggcttagagatatgtaacagcaataatgtatcgttgagtccaatggtggagtccatgatcgaggccatcaccagcatcgagccaacttgcctccaacatttaacattgagggattgttcgtcagccatatcttttccggggggtatgccacctaacctgagaacagtttggattttcaattgtgagaaactactgagcggcctagcatggccatccatgggcatgcttacccatctcactgttgggggtccatgtgatggcatcaagtcattccctaaggaggatgttggactgcacggggcttctccatctcacatccctccaacaattattcatcagcggatgtcctttgctggagagtatggctggagaaaggcttcct

SEQ ID NO: 21102 - DNA, 256 bp, Glycine max
  Peptide Sequence Number=SeqID_112787
atggaacttcaacgtctcaatcaaaatgaagagaccgacaaaaggaaaaggagcatagcactcaaagcctcctcctcaatgcaagaagaagaagaagaagaagaatctgatgatgaagaggacttctcactctttgtgaagaagtttcataaattcgtcaaaagtagaagaatgaagagaagccataacttcaacaatggaaagagatcccaagaagtttctcctacacttaaatgctataagtgtaatcaacccg

SEQ ID NO: 21103 - DNA, 664 bp, Glycine max
  Peptide Sequence Number=SeqID_112788
atgaatccgaacgagcgtcgcgtgcagcgtctgctgttaggacatgccagcgagtgccagatggataacgcaggccgtttactgctggcgaacacgttgcgccagcatgcgagcctgaccaaagaagtgatgctggttggacagttcaacaagtttgagctgtgggatgaacagacctggtatcaacaagttaaggacgatattgacgcagaacagtcagctcaggagcctttatctgggggggttgcaggacttgtcgctatagctatgcaggaaaattttaaacacaccacggtgctgctggatgaggcggttaacggccttaatatcagggaagacggcatttacattgacggcacctttggtcgcggcggtcactcacgcctgatcctgtcgcagcttggcgcgcacggacagttactggcgatcgatcgcgatccgcaagccatagccgcagccgctgagataaaagatccacgtttctcgattgtgcacgggccgttttcagcgctggctgagtatgtcgaagagcgcgggctgaccggcaaaatcgacggcgtactgctggatttgggcgtctcttcgcctcagctggatgacgccgagcgcggtttctcctttatgcgcgacgggccgctggatatgcgtatggatccgacgcgcg

SEQ ID NO: 21104 - DNA, 246 bp, Glycine max
  Peptide Sequence Number=SeqID_112789
atgaggcacccaatccccatgataggtggtatgatgaatgtgttgggtggtgcaaccctcttttgtaaaatcactcatgcacccaacatcttcatgatttgtgtacatagggactcattaggtagtgatcaagggcttcccatggaccctaagagaataaaggtcattcctgaatggcctactccaccatgtataagggaaatttggggcttcaatgacttaacaaacttttgcaaaaggtgttga

SEQ ID NO: 21105 - DNA, 546 bp, Glycine max
  Peptide Sequence Number=SeqID_112790
atgttgattagcatcatgaagaagttcacaaatggaagagacttgattaggcctggtatgactagatttgccacaacttatttaactttagcttgccttcatgaattgaaagcatcattaatgaacatgtttatctttgaagagtggaaaacaagcaagtttggaacttcacaagaggggagaaaagtacagaatgtggctttggatagtcaattttggaagaacataaccatctatgagcctgtttggaaaattatttatgagaggtgggatcatcagcttcacaggcctttgcatgcagctgcatattatcttaatcctcacctgcattatgaacctactttcagacatgatgaccctcagctgaaagaaggagggcttttctctatggaaaaggcaaaggacagtagaaaaatcatgcaacctggagaatggtgggagatgtttagtgatggaactccagagttgaggagatttgctattcgtgttttgagcttcacttgtagctcttctgggtgtgagcgtaattggagctcatttgaaatg

SEQ ID NO: 21106 - DNA, 373 bp, Glycine max
  Peptide Sequence Number=SeqID_112791
gattggagctgcaaactgggttcccaccaatcatacttccactgttgccacagggacacatgtccgagacattgtctcgacatctgtctcgacatcagggaaagctgctgcttcaggtgctgtgtccaaggatgctctgattgctgaactcaaggacacatgcaaggtgctggaagcaaccatcaaagccaccacagagaagaagatggagctagaactgctgatcaaaaggctctcagagagtggcattgatgatgaagaagcagctgaggaagaaggagaagcagctgaagaagaagaagaagctgctgaggaagaggaagatgcagcagaagagacagaatccgatgatgattctgaagccaccccatga

SEQ ID NO: 21107 - DNA, 411 bp, Glycine max
  Peptide Sequence Number=SeqID_112792
atgtatacaatagaatttcaaaaacgagggctgccgcatgtccatttattgctttttttacatcctgataacaaatacccatcctcggatgaaattgatcaaattatatcaacagagataccttcacaacaagatgatccagaactgcattcattagtaaaaaaccatatggttcatggcccatgtggaacttcgaaccctggatctccatgcatgaaagaaggcaatccaagattgctcagaaaataccaagcacatatcaatattgaatggtgtaaccaaagcacttctatcaaatatttatttaagtacatcaacaagggatatgatagagtaactgctattttgattcatgatgataatgatcgaactcacaatggtagcactcataatgatgagatcaaagaatag

SEQ ID NO: 21108 - DNA, 260 bp, Glycine max
  Peptide Sequence Number=SeqID_112793
atgggaatcgctgctttgccgcttgaaagcttgtcgtctcaatctttcttaagaagccagagcaagagtgaagttcaagttccccttgatcagaggctttatgaagagtcaggaacgactttgaagaagattatagttgttctttttgaacacttgctactagttataagcttgcagctcaactcacgtaggcaacaaatcaagctcacgcgggcaggcaggaatgcgccttctggagctcttcctttgactctcaactc

SEQ ID NO: 21109 - DNA, 549 bp, Glycine max
  Peptide Sequence Number=SeqID_112794
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcgggaaatggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgttccccctggcggctccctcgtgcgctctctgttcctgcctttcggtttaccgggtgtcattccgctggtatggccgcgtttgtctcattccacgctgacactcagttcggtagca

SEQ ID NO: 21110 - DNA, 348 bp, Glycine max
  Peptide Sequence Number=SeqID_112795
aaggaaggaagaatcaggattctatcttcatgcgaaggatttccaaatgttcccttaatgggaacaaggggttgtataaatcataatcctgccctcaccataagacagcttggctaccccatgagaggagtgccatcagacgaaagcatcacgcctttcatcgcacggggtttcagtgaccccaacgcgagggtactccaaggagttcgcaaggcatgggatgcgactgtgagagacaatgaggttaaagcttcggaagaaagtgatgaggtacaagccctaaaggcaaagcttgaaagagcccggatagtcaaagagaagttcaagtccatagccatcaaagtctga

SEQ ID NO: 21111 - DNA, 537 bp, Glycine max
  Peptide Sequence Number=SeqID_112796
atgggattaccaaggggtgtaatcgagtgggggggcttgaaaacgaggtcagggagccatgagggcttctgggatgggtcactggtaatcgattaccagatcgtgatggcggcgcagctaatccgtgatcgagtagagatggagtgcctagagggagcttgggagaccctcgaaggcaacacgaggtgccgatttcggggcaccattcgattcacggctacttctttggtgcatccagatgaacctgcacggacgcttcagcgcacagtggagtggatactacccacgcctacaccatatcgtctagtggagcccgttccagtgatcgaggtaacgtcatccgaggaagaccctgagaaggatctggaggagctacctcctgagcctactgtggatgcccttgactttctagagggtgatgaggatccacttcttgaggtggattctcccgaggaagtcatgtcggcatctgaggcagattctacggaggatagtggcccggaggagatggcgatcagcggaggctcttcatcatag

SEQ ID NO: 21112 - DNA, 339 bp, Glycine max
  Peptide Sequence Number=SeqID_112797
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggtaactatcgtcttgagtccaacccggaaagacatgcaaaagcaccactgggcagcagccactggtaattga

SEQ ID NO: 21113 - DNA, 606 bp, Glycine max
  Peptide Sequence Number=SeqID_112798
atgaaggttacagcccttaagcaaaccagccatgacatgattgctcatgtgggtaaggctcgggctgccgtggaagagctgagaaagtttcttgtggctgattcattagaagaagtgaacaggaaactggacaagttttacatggtccttatcctgagaagcttacactcagactttgatcatgttcgtgatcaagtactcgctggggatcaggttccatccatggattctctcatcactaggcttctccgtgtgcctcacttatcgaaggatgaaaatcctactgatagtgtggagacgtcagcaatggttgcatcacgtggtagaggaggcggtcgcaacagcagaggaggccgcaatggaaggggtggacgtcctcattgcacctactgcaagaggatgggtcacacccaagagaattgttattcgttgcatgggtttcctgacaaggttgcacaggtttctagatcagagaaagcagagtctaagttctctgatgaggagtatcaggagtatttgaagctcaaatctgagagacccagcaaccaagctcaatcctcatctgtaccatgtttttcacagcttgtatctctcaatcaattgaag

SEQ ID NO: 21114 - DNA, 59 bp, Glycine max
  Peptide Sequence Number=SeqID_112799
gtttgaaccgttcttcgacgttcttcattcgttcttcatcgttcttcgatcttcaacgg

SEQ ID NO: 21115 - DNA, 243 bp, Glycine max
  Peptide Sequence Number=SeqID_112800
atggctatggacttgaacttctcttcgactacccaggctctttcaagctctgcctttagggcttccacttatgatagcccgccgatgatcccattacggcttcccctaagctctctgtcctttcttcacgccgcatcccatgccttgcgaactccttggagtaccctcgcgttgtggtcaccgaaacctcgtgcgatgaaaggcatgatgctttcgtctaatggcgctcctctcatggggtag

SEQ ID NO: 21116 - DNA, 669 bp, Glycine max
  Peptide Sequence Number=SeqID_112801
gaaggaaaggagggagttctcttctcatgtggggactacccaaacatcccgttgatagggacgaggggttgtattaactacaatcccgcacttgctataagacagttagggtaccccatgaggggagcatcgacagaagagagcctctctcctttccctgtgagagatttcggcgcggaaagtttcaaggttatacaaagagtccaaaaggcgtgggaaagcccattaaggaaagataaagaacttaggggcatccgtaatggcatcgtcggtggttatcatgaatggcggaaagttcgtacacgagggttagattggctctccaaattgaaagttatcaacgaggagaacttcgaagctccggaagaggatgaagaagtccgagctttaaaaacagaactaagaaaagcaagacttggcaaagaaaaattcaagttagtcgctacagacaaggcttgcaaggaagagtcatggctcgagaccaaacttggccttggagctttgtggggcagttccaatagtgatctcaagcttcgaagggaattgagagagaccagtctacgagcacatagcatggtcttgggggaaaaaggaacgtatcttttcttcgggtttcttccaagagatacattgtgctcagcgtttatggcgagaggatggaccgcataa

SEQ ID NO: 21117 - DNA, 258 bp, Glycine max
  Peptide Sequence Number=SeqID_112802
atgaagaattgtcttgaatatcacaattcaagagagcttaagacttattttgatttacaaatccagctacaactcagcaccacaactcaatttcttcagaggcatctgtcataccctaatttcgtccagggactattgcttgatggcatgcaacctttgattgaccgctttgaagtacttaacaccctttgtttcacaatgtgtgaagtcccgagacgcgccggaaatcaaaagaaagcatggttacgcgatccgtga

SEQ ID NO: 21118 - DNA, 105 bp, Glycine max
  Peptide Sequence Number=SeqID_112803
atggccgaccagcaggcgaccaagtgcaaagccaaagctcaagacgttaaagaagcgctactaggaggcaacttagtaccttttaaatctgtgcttgttatttga

SEQ ID NO: 21119 - DNA, 477 bp, Glycine max
  Peptide Sequence Number=SeqID_112804
atggttattagtgagcagtggtcttcttataaggcagatgatattaacaaggcaaaatctgtgaaaaagacattgttggatgacatttggtgggacaagaaatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 21120 - DNA, 785 bp, Glycine max
  Peptide Sequence Number=SeqID_112805
atgggtatgggagatttcatcagcagactctccttcccggtagacgcattgtttgaaaacaccgagactatttcaagtctcacaagttatccagaactacgtaggtctgagttcatcattggaggatacgtaggagcaagagcctcgcttttgttgaccacaccgcttttcgttaccatgacccaagagctggtagcccgcggagacaccttacggttatccgcacctcgtcgttcagtgaccccaagtgtgattgatgagcagaggccaatgtggtctgagttcctcattggaggatacgtaggagcaagagcctcgcttttgtcgaccacaccgcttttcgttaccatgacccaagagctggtagcccgcggagacaccttacggttatccgcacctcgttgttcagtgaccccaagtgtgattgatgagcagaggccaatgtggtcatctgcgccctttccggagatgagcaagagccttgcttttgtcggccgccccacaagatctgtcatactgaccctgaggtcatgtgacatgcggagacaaaatttggtcattccgcacccctttgccattcagacacagtcgtgtccgatggcacgcagagacaaaatttggtcattctgcacccttttgtcatccagaggcggcgggcccgatgacatgcggagacaaaatttggtcattccgcacccctttgccattcagacacagtcgtgtccgatggcacgcagagacaaaatttggtcattctgcacccttttgtcatccagaggcggcgg

SEQ ID NO: 21121 - DNA, 246 bp, Glycine max
  Peptide Sequence Number=SeqID_112806
atggagctagaccagcaagacagccacagagaagactcaaccccggtgattcttgatgtagtgaagaaggagataaccaagcttttgcaagctggaatcatttatccgacagccaatgggaggctgaaccaagttaccaaaaaggaccattttcccctaccattcattgaccaaatgcttgaacgcctggcaggaggatgcctttcggcctgtgcaatgccccttgtaccttccaacggtgcatga

SEQ ID NO: 21122 - DNA, 603 bp, Glycine max
  Peptide Sequence Number=SeqID_112807
ggcggaattggagctccaccgcggtggcggccgctctagaactagtggatcccccgggctgcaggaattcgatcccccatgccgacgccccgccgccagatgccccgcgccccgcgtggatgccgcgcaaagcctgtgccagtcatcaccagcgtgcatgcgtggctctccgaaagcctgcggcccgcgcgggcgtgggcctcgttctcgcggctggcgatggcgcaatggccaccctcgaccgagcacccgactggccgcgcgctcgatgcctggctcgaactgctggaatgcagcgcgatcacgcaccgccgcccgtcattcggcatcgacagcgtggaggtcgacggccaggcggtgccggtggtggaagacgccgtgatgcaaacgccattcgccatgccgttgtaggcgttgtcgtgcggctgtccggtgaactcagcccaggggcgttcgccgggctggaagggcaggggcttcgccctgctggcatcaagcttatcgataccgtcgacctcgagggggggcccgggtaccagcttttgttccctttagtgagggttaatttcgagcttggcgtaatcatggtcatagctgtttcct

SEQ ID NO: 21123 - DNA, 611 bp, Glycine max
  Peptide Sequence Number=SeqID_112808
atggagcaaagttgcaatcccttccaagaagaggaaagaaatttcctcatctgattctgatgatgatgtcgaactagatgttcccgacatcaagagagtgaagaaatcagggaaaaaggtgcctggaaatgtccctgatgccccattggacaacatttcattccactccattggcaatgttgaaagaactggaagagatgccttggattgcaaggagatcatggacctcatcaaggctgctggactgctgaaaacagtcaccaagttgggagattgttatgaaagtctagtcagggaattcattgtcaacattccctctgacataacaaacagaaagagtgatgagtatcagacagtgtttgtcagaggaaaaggtattagattctcccctgctgtaatcaacaaatacctgggcagaccaactgaaggagtggtggatattgctgtttctgagcatcaaattgccaaggaaatcactgccaaacaagtccagcattggccaaagaaagggaagctttctgcagggaagctaagtgtgaagtatgcaatcctgcataggattggcactgcaaactgggtacccaccaatcatacttccactgttgccacag

SEQ ID NO: 21124 - DNA, 838 bp, Glycine max
  Peptide Sequence Number=SeqID_112809
atgttctcgacatcagaggccaagaaatcagggaaaaaggtgcctggaaatgtcctgatgcaccattggacaacatttcattccactccattggcaatgttgaaaggtggaaatttgtatatcaacgcagacttgctgttgaaagagaactgggaagagatgccttggattgcaaggagatcatggacctcatcaaggctgctggactgctgaaaacagtcaccaagttgggagattgttatgaaagcctagtcagggaattcattgtcaacattccctctgacataacaaacagaaagagtgatgagtatcagaaagtgtttgtcagaggaaaatgtattagattctcccctgctgtaatcaacaagtatctggctagaccaaacgaaggagtggtggatattgctcctgcccctgttcctgaaaactggttacccacaatcgatacttcacggtgccacaggggagatcggctctccaaactagaggaagatgatcaagccacagaggagacccctgcaccacgggcaccagaacctgctccaggtgacctcattgacctagaagaagtagaatctgatgaggaacccattgccaacaagttggcacctggcattgcagaaagattacaaagccgaaagggaaaaacccccattaagaggtctggacgaatcaaaactatggcacagaagaagagcactccaatcactcctaccacatccagacggagcaaagttgcaatcccttccaagagaggaaagaaatttcctcatctgattctgatgatgatgttgactagatgttcccgacatcagagggccagacatcagggaaaaag

SEQ ID NO: 21125 - DNA, 312 bp, Glycine max
  Peptide Sequence Number=SeqID_112810
atgaatagccaatatatttgcttttatctcatgcctttcttcgttcatggttcgatattctggtgtcctaggcgtagaggaaccacaccaatccatcccgaacttggtggatactccggggaacagatatccagtggagatgacggggtggggcctgtagctcagaggattagagcacgtggctacgaaccacggtgtcgggggttcgaatccctcctcgcccacaaccggccaaaaaagggaaagatttttccctctgggggtaggaaaatcatgatcgggctagcggacccaaagctatggaacttgtga

SEQ ID NO: 21126 - DNA, 474 bp, Glycine max
  Peptide Sequence Number=SeqID_112811
aaggaaggaagaatcaggattctatcttcatgcgaaggatgtcccatgagaggagtgccatcagacgaaagcatcacgcctttcatcgcacgaggtttcagtgaccacaatgcgagggacagagagcttaggggaagcagtaatgggatcatcggcggctatcataagtggctgagagtccgaacacaaggattggattggctcccaaatctaaagactgtgagagacgatgagagaagtctcaagtcacatagagttggaccgtgtaaagaaaaacgagtatggggtacgtcggagatatgccaaggaagcctgtttggagcgaagagggcaaaggacccttggcaaaggcatgatctgaaggcgaatgggctttcttttattgacggtcttggcgcttttgaggtctttggaaaagaaatttgtcctctttcaagcgagactatggaagggaatatgtgggccatccgatga

SEQ ID NO: 21127 - DNA, 393 bp, Glycine max
  Peptide Sequence Number=SeqID_112812
atgtcagtctccgcatgctatcaggcttttcgtcttacagatagcaaaaagaatgtttatacggataaccactcgggtatttccgcccgtcagcgtgactcaaatgtcagtatgacagatattgtgagcgcggaagatgacacaacaaaaaagaatgtttataaggataaccactcgggtatttccgcccgtcagcgtgactcaaatgtcattatgacagatcttgtgagcgcggaagacgacacagcaaaaaagaatgtttatacggataaccactcgggtatttccgcccgtcagcgtgactcaaatgtcagtacgacagatcttgtgagcacggaagatgatgtaaatctccacgtgtcaacgggcttgttggccgcgattgacggaggg

SEQ ID NO: 21128 - DNA, 171 bp, Glycine max
  Peptide Sequence Number=SeqID_112813
atgttgaaaataagaaaagtgttgctgggtgattcctacaccactactgttgctgaaactggagatgttgaactgaagtttacctctggaaaagactttgattctcaaagatgtgatgcatactctagagatgagaaagaatctggtttcagggaaagggtacgccactaa

SEQ ID NO: 21129 - DNA, 192 bp, Glycine max
  Peptide Sequence Number=SeqID_112814
atgttttttgaagctgggttgcttctgggcgagctgggcggcaacctctccctcctttttcctataaataggttgaagggggttgttctaatgatctgggatgcccctggtgaggttttcgtaagcaaattcgtgaaggttttcctccgttattcatcgttcttcattcgttcttcgttcttcaatgggtaa

SEQ ID NO: 21130 - DNA, 253 bp, Glycine max
  Peptide Sequence Number=SeqID_112815
tggcgtctacccagacttatcttcctttaccggaagtggcgtctaccccgacttatcttccttcaccggaagtggcgtctaccctgacttatcttccttaaccggaagtggcgtctaccctgacttatcttccttcaccggaagtggcgtcatccaaatcttcgtagcctgtatcaaacgatccgctcctactcaggttcacatcagtcggcctgcaagcgtttttaaaaaaaaattgcgcaatgtcggctga

SEQ ID NO: 21131 - DNA, 123 bp, Glycine max
  Peptide Sequence Number=SeqID_112816
ggtaaattagggcaagctttgcgagcgtttgctaagcacaaccctcctgggctaagtgcgaggaagactctggaagaagatgagttgtacaggtttactaagcgcactgcttcatctcactaa

SEQ ID NO: 21132 - DNA, 276 bp, Glycine max
  Peptide Sequence Number=SeqID_112817
atggcattagcgcgtgattttcgtagggaaacaacccatggggcaatttggtttagaataggtagcaaaatacctttggcaatttacactttgggtgtggtagcaaaatacttggatggaatggccccgaggaaccttgcctcaaagaggtccaggaaggataaggcggccgaaggaactagttccgctcctgagtatgacaatcaccgctttaggagcgctgtacaccagcagcgcttcgaggccatcaagggaaggtcgtttctctgggagtga

SEQ ID NO: 21133 - DNA, 234 bp, Glycine max
  Peptide Sequence Number=SeqID_112818
atgcatagtcctctaaaggcgagggcgtgtcgccctctgaaggtgaggacctatagccctctgaaggcgaggatgtgtagccctctgaaggcgagggcgtgtagccctctgaagaaaacacagattgactatccttttgaaagaggtgataattcatgcaacctcatcctatcttttacaaatctctccacgaactcccttagagtgtatgttctgtttgatttaaacacttga

SEQ ID NO: 21134 - DNA, 471 bp, Glycine max
  Peptide Sequence Number=SeqID_112819
atgtgggtgtcaagcgagtggtttccagcagatttcaggtcggaggagaaagagacgaacaagtgtaggggtttcgagcgtgcgggttgtgaaatttcttcaacgattgttgtagaagcaaagcttcatgatgaatcaagattgattcaaagatgttttgatgataacaaagatgatgacaaaggaaagttgaagaacacttcaagattcaagaggaaagttgatttcaagaatcaagaatcaagattcaaggataaagcttccaagaatcaagatcaagattcaagaatcaagagaagacttaatcaagataagtatgaaaagggtacatcctttgtggtacaagtagagggtacatctacttgggttattgactgggaacaagagagggtacatctcttgtggatcagttctagtggagggttgaaaagaaatctcaaggaccgcaagtcgcttggggactggatgtag

SEQ ID NO: 21135 - DNA, 397 bp, Glycine max
  Peptide Sequence Number=SeqID_112820
atggccacgaccgaagccttggaacaagaaaccaagaaggctcgaaaggaagaacacggtcggaacaagttccgaggaactttatggggtagcaatagtgagcttaagctccgaagagccaaaagggatcagtcgtggatcgaaggcatgatcttgaaagacgagttaaaggcttgccataggtcgaaaagaagcttgtccgagaagttgagcaagactgaaggaaatattcctgcaagcggaaagggaggcaagggaaaaggtgatcatttcattgcacagagaagcaatgatgtggatggacatgttctcctttactttgaatgggagtcaagagcttccctaactgctagccaaggccaaggcaatggcggatgtgtactcggctcccgaggag

SEQ ID NO: 21136 - DNA, 606 bp, Glycine max
  Peptide Sequence Number=SeqID_112821
atgatacgcggagataccttacggttatccgcacccttttgtcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgatacgcggagataccttacggttatccgcacccttttgtcatccagaggcggcgggcccgatgacaagcagagaccaaaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcgacgggcccgatgacaagcagagaccaagtttggtcattctgcacccttgtatcatccagaggcggcgggcccgatga

SEQ ID NO: 21137 - DNA, 228 bp, Glycine max
  Peptide Sequence Number=SeqID_112822
atgactagggatcagagactgtactccggtcctgagttctgtcattatttcgcaccaggaggtcatctgggtgttcaaaggacagctcgcaaagtgctgactgtagcttttattggcccaccatctttaaagatgtgtggaacatttgtagcacttatgaatagtgttagagagcaggaattgattatgtttcaaatggggtggaagccaagcccactagaactatga

SEQ ID NO: 21138 - DNA, 225 bp, Glycine max
  Peptide Sequence Number=SeqID_112823
atggacttgggaaggttccaagttagtgtaccaggtaacagctaccccagtaagactttcttgggaagaaatatggttcttggggcaaatagtccctttgtacttgtcaagtccagcaccttgaacttaggaggggtgatgatattgggtactaggaacaactcttctaggttagcaaagggcataatcttcacctccttcaatggccctggagctttcctctag

SEQ ID NO: 21139 - DNA, 552 bp, Glycine max
  Peptide Sequence Number=SeqID_112824
ggatggattgaagatgtgaacggaaataagcttgaggccggtggcccattgacgctgctgccaccggcacttgcacttgtggctactgaacagcagtcggctccgtttcaggaaaaaataacgcttagcagaaagggggagagctatacagtcaacaaccctactccctattacattaccctcattggtgcaagttcaaaagttaagggggatccggtaaagggctttgaagccatgatggttcccccaaaaggttcagcaaagcttggtggaaaggcttcagagctggggacagagcctgtacttgtgtatgtgaatgattatggcgcaatgccttccctgacttttcgttgcgacggcactgagtgccgggtgaatgcaggccagacggatggactggtcgagggggataatggagtgcttcatgtgtcaggagtgctgacggaaagtgcctgtcgtctcgaaatgccttccgcggaccagacagtcgagatgggaaatatttcaacgggagagttatcggtagtcggcagccgcggcactcccgttgcc

SEQ ID NO: 21140 - DNA, 810 bp, Glycine max
  Peptide Sequence Number=SeqID_112825
atggaagaaagcatgtctcctttccttgtgagggatttcggcgcacaaaattccaagactatacaaagaatccataaggcatgggaaaccccgttaaggaaagatcaagaacttagaggcattcgtaatggcatcattggtggctaccatgaatggctgaaagttcacatacgaggtttatattggctcgccaagttaaaagtcatcagcgaagagagttttgaagcaccggaagaggacgaagaagtccaagctctcaaaagcgagttaggaaaggcgaaacttgccaaggagaagttcaagttggccgcaacacacattcggaaggagtgtgccgggttacgggaagagaatgcaattaccgcaaaagcccttgaacaagagaccaagagggctcgcaaggaagagtatggccggaataaatttcgcggagctctatggggtccaaaagaagctttgtctcagcgtttatgcgagacggagaccaacatgctagctatcatcgccaagtaccaagaagagttaggtctagccacggcccacgagcatagggtcgcggacgagtatgctcaagtatacacggcaaaaaaagaggctagaggaagggtgatcgactctttacaccaagaggcaaccatgtggatggatcggtttgctcttaccttgaacgggagtcaagaacttccccacttgttagccaaggccaaggtgatggcggacacctactccgcccccgaagagattcacgggcttctcggctattgtcagcatatgatagacttaatggcccacataattagaaatcgttag

SEQ ID NO: 21141 - DNA, 382 bp, Glycine max
  Peptide Sequence Number=SeqID_112826
gctcagcgggatgctccacaggccgcgggcgcaccaccaccacctcatcaggctggcccggctgtgtcatttgacatggaacagtatttacggcatttggttcgtcagcaggcggccaaccaccgggcacatgtacaaacccatgattgtctgtaccagctgagcctcagcatgcaaagccagggctttgcttctttttcatgccctactcaagaccagttcagggcagaggtcgcatggcccggggattggcccgaggcccaagcaggagaggcgcccccagaagctcccggcgatggagaggaggcccacgaagacgaggagatggccgatttgcttgggagggagtggagctacatgactgggagatccccatattcat

SEQ ID NO: 21142 - DNA, 186 bp, Glycine max
  Peptide Sequence Number=SeqID_112827
atgggtagtaccaatacactatcaaattgcagaactgaagtatgcaaggcacttgaaatgcccgaggaggaatgtgaactgtcaatgggcatgtctggtgattttgagttagcgttctggatgctttttagctcatcagggaatgaattgacgattatcataggaatggggttctttgatacttga

SEQ ID NO: 21143 - DNA, 522 bp, Glycine max
  Peptide Sequence Number=SeqID_112828
atggggacaaatcaaaatgacaaaaggttttatcaagtcaaggttaaaagtctagatgtcaccagcctcaaggaattgggacaattgatgggacccctccaaaggcaagccttctgcaaagtctacgggaagattctagatttaaccgcagcggaggtatttacggaagctgtcgtatccctcgcccaatactatgaccagccgttgaggtgtttcacgtttggggacttccaaatggtaccaactattgaagagtttgaggaaatattaggatgccctcttgaggggagaaaaccgtatcttttcttcggctttcttccttccttgagcaagattgcagctgtggttggagattcagcaaaagagttggatcgcatgaagcaaactcggaacggcatagtgggcctgcctcggaagtacttggaaggtaaggcaagggatatggcaagccaagagaagtggggcccgtttgtggatatattagctttgttgatttttggggttgtcctcttccgaacgtga

SEQ ID NO: 21144 - DNA, 210 bp, Glycine max
  Peptide Sequence Number=SeqID_112829
atggcttggaatttccttttcaaatgcaagtatgtgcatgatgaaatggctccgagaaagcttcctgcaaagagatccaggaaggacaaagcggctgaagggaccagtgccgctcctgagtatgacagccatcgcttctggagcgctgaacatcagcagcgtttcgaggccatcaaggatggtcattccatcgggaggagacgtgtctag

SEQ ID NO: 21145 - DNA, 432 bp, Glycine max
  Peptide Sequence Number=SeqID_112830
atgcataaggcattgcgattaaatgctccactaccatatccacagcttgttactctatttcttcgtcattttgaaattcctcttgattttgaatcttatattccaatcaagatatcccttttaattggtgctgctgcaattgtttcttttggttaccgcaaagagcgtgatggctcttgggtcaaaaagggcactcaacccgctgatgaagaaggcaacctcccagatgaagataattccactcttcttcgcaggcttatggacaagtttgatggacttcagacttttgttggtgacaagtttgatgccatggaattacaagttgacatgaggttcgatgctatggaatcaaggatcaccagagttgaagaagatgtctctttcatccgaacttgttttgatccaccacctccgcctccttcatcctcttag

SEQ ID NO: 21146 - DNA, 62 bp, Glycine max
  Peptide Sequence Number=SeqID_112831
caccaaaccacaagataatggaggagatacatggagaagaagatgaagcacaaggaattaaa

SEQ ID NO: 21147 - DNA, 357 bp, Glycine max
  Peptide Sequence Number=SeqID_112832
atggcagcacagttgatccatgatcgcgtggtgatggagtgcctagaggtacatccggaggaacccgcacacacacttcagcagcctgtggagtggatactacctacacctactccatatcgactagttgagccggttcaagtaatagaggtgtcatcctctgaagaagatcgtgaagaggatccagaggaattacctcctgaacctgctatggacgcccttgacttacctgaggatgatgaagacccactccctgatgttgattctccagaggatattatgtcagcatttgaggcagactctacagaggagaatggccctagagggacagcgaatagtgacaactcttcatcatag

SEQ ID NO: 21148 - DNA, 261 bp, Glycine max
  Peptide Sequence Number=SeqID_112833
atggatgccttaaaaatttatttgaatgaagtaaaaagacaattagacagaaaggtgaaacttgtcaagtctaatagaggtggtgagtactacgaaagatttcataataaggtagttccaaacacatcttttgaaccgtggactaataggatacctagcataaggcacctgcatgtttggggttgccagacaaaaataaggatttataatccacaagataaaaaaactggatgcaagaataatcagtggatatttcattag

SEQ ID NO: 21149 - DNA, 402 bp, Glycine max
  Peptide Sequence Number=SeqID_112834
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggggagttagtcttgaagtcatgcgcccggttaaggctaaactgaaaggacaagttttgggggacttgcgctcctccaagccagttacctcgggtttcaagaggtggtag

SEQ ID NO: 21150 - DNA, 510 bp, Glycine max
  Peptide Sequence Number=SeqID_112835
atgtcccatactaatggattcgggtccacaacgatgggttcaaatgtaagatcggttcaggatcatgggatccttttctatcagataggaagggctgtttcacaaaatgtacttctaagtaattgctccatagatcctatatctatctatatgaagaagaaatcatgtgacgggggggattcttatttgtacaaatggtacttcgaacttggaacgagtatgaagaaattaacgatacttctttaccttttgagttgttctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagtcagtttgataaggatcgaagatttctctatgaaaaatatgaatcggagtttgaagaaggggggggagtcctcgacccacacagatag

SEQ ID NO: 21151 - DNA, 415 bp, Glycine max
  Peptide Sequence Number=SeqID_112836
gggagcgttccgccttagagggaaggacccgcgcgagcagtgctggacgaagcggaagcgagaatgtcggcttgagtaacgcaaacgttggtgagaatccaatgcctcgaaaacccaagggttcctccgcaaggttcgtccacggaggggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacagtgccggaaggtcaagggaagttggtgacctgatgacagggggagccgacgaccgaagcccccg

SEQ ID NO: 21152 - DNA, 549 bp, Glycine max
  Peptide Sequence Number=SeqID_112837
atggagaaaactaagaaattgaagttcgaagaatgggtcaatgacaagtcccgtgaatttgctgattcgcttaatactactacttctgttaatgataatgaaatatatttgaatgttgttggaggtccaaattacaaggggaaagtgtacgggttaggtactttgagcaaaaggtttagttgctcaaaatcagttccatctacttctattgctcttgtggaagaccaaatagaggaaatgcgtgagacaattaataaattgaatgctaagcttttggcaaagacaaataaggagaagatacttgaggataagatgttgcagccgatggagaatcatgaccaccaaagtcaggagatgcaacaacaaatgcaagaacaaaatgagcaaattcaccaacacaatgagcaaatgcagtgtatactacaacacttgcatattgagtctatcatgccagctcctaatctattgcctaccatagcagatggaactaagcgtcatgttaatgatactcaggttgatcgtcctcataacatgaaaaatgatcattga

SEQ ID NO: 21153 - DNA, 243 bp, Glycine max
  Peptide Sequence Number=SeqID_112838
atgggtgcaagggataaatcaatcatgttcaaggatcttcttcatcaatggattcctttcttcttggaagatgaatggcagcggaatggagaaaggaagagagagaggagacgccacttcaaggagaagatgagtctagaagaagctcgcctccataggaggccatggataagagcttggaagaagaaggagatgaatgaagggagagggagagaagagcccgaaattttgtgctctaaatga

SEQ ID NO: 21154 - DNA, 489 bp, Glycine max
  Peptide Sequence Number=SeqID_112839
atgtgggcttttcatatcggtcgacaaattgattgggcacacttagtccgatatcacatgcataaggcattgcaattaaatgattctttgccatatccacatctagtcactcttttccttcaacactttaacattcctcttgattctgaaccttatgttccaatcaagagatccttcttgatcggtgctgctgtggttgcatcttttggttactgcaaagagcgtgatggctcttgggtaaaaaagggtgctcaacccattgatgatgaaggacacttaccagttggagaggattcctctctccttcagagaattttggacaggtttgatggtcttcaaacctatgttggtgaaaggtttgatgccttggaactacaagtggacatgcgattcgacgagatggactcaaggatcaccaaggttgaaggagatgtcacttatatccgcacatgctttgatctaccaccaccaccgccaccatcatcttag

SEQ ID NO: 21155 - DNA, 363 bp, Glycine max
  Peptide Sequence Number=SeqID_112840
atgatggacgagctgctacatcatagctcagctgctttatgtattggagcagaggtggcagttagcagcagaacaggaccagcaactagggttgttcacagagcagccgtctttccgtctcaagcggagaagacatcaaaagaatctttatctatggctctaccagggaatcctaatgtatctagccgatgtgcccctctcggataccctgcgaataggcaggaaagaagttgtttcctagttgactcaagtgacgatgctgacaccacaggttgcttgcggggaaagcatcggccatatgcgaaagaggcgagaagctacattcggatatataggctagtaggcttgagaaagagctgctag

SEQ ID NO: 21156 - DNA, 860 bp, Glycine max
  Peptide Sequence Number=SeqID_112841
cctgactatccggaagacgttcgcctgaagtaccgcttcctcgacctgcgccgcgaaacgctgcacaagaacattgtcaagcgcacgcagatcatctccgccatgcgcaccggcatggccgatgccggctttgccgaatatacgacgccgatcctcacggcctcctcgccggaaggtgcacgcgacttcctagtgccgtcgcgtattcatgagggcaagttcttcgcgctgccgcaggcgccgcagcagtacaagcagcttctgatggtggcggggtttcgaccgttacttccagatcgcgccgaagatgtctggaccacgatggagccgatgatgactgctgtcttcgaaaagtttgccgaaggcaagcctgtcaccaaagagtggccgcgcattccctatgatgaagcgatccgcaaatacggctccgacaagccggacctgcgcaacccgatcgtcatgcaggccgtgaccgagcatttcgatggttcgggcttcaaggtcttcgcgaacatgatcgcctccaacccgaaggttcaggtctgggcaattccggccaagaccggcggttcgcgcgcattctgcgaccgcatgaacgcctgggcgcagtctcagggtcagcccggcctcggttacatcttctggaaggaagaagacggcaaggtcggcggctctggcccgctcgccaagaacattggcgaggaacgcaccgaggcgttgcgtcagcagctcggcctcgaggcaggtgatgcctgcttcttcgtcgccggtgatcccgccaagttctacaagtttgccggtgaagcgcgcactcgcgccgccgatgaactgaacctgatcgatcgcgaccgcttcgaaat

SEQ ID NO: 21157 - DNA, 288 bp, Glycine max
  Peptide Sequence Number=SeqID_112842
atggccaagtttgaccttgaggtagtcctggagttttatgctaatgcttggcccacagaggagggagtgcgagacatgcgttcatgggtgaggggtatgccacccaccaggcaccctctagacctggataagtctaacagggccctggggtttctggcgttgattacgagcctctgccagtcatttggggttcccgtcacccctagtaaggtgatccgaccgctgatcacccgggccttcatcgagaagtactgcacgcctaggcaggcacagggtgatgcacattag

SEQ ID NO: 21158 - DNA, 198 bp, Glycine max
  Peptide Sequence Number=SeqID_112843
atgacattaggtgctgaattcaatgtggaaagcttaacatgtagagattggaacacatcatcgaaagtatcccaaaaggtatgtgttcggttctgtgcaagaaagaaaatgactacctatataagcatgaagtttagccgcttcaagaagctgggacttggctttgatatgcttatgaaggatagggacacaggctag

SEQ ID NO: 21159 - DNA, 540 bp, Glycine max
  Peptide Sequence Number=SeqID_112844
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccgggacaagttttggtgactgcgctcctccaagccagttacctcggttcaaagagttggtagctcagagaaccttcgaaaaaccgccctgcaaggcggttttttcgttttcagagcaagagattacgcgcagaccaaaacgatctcaagaagatcatcttattaatcagataaaatatttactaggcaccaataactgccttaaaaaaatttacgcccccgccctgccactcatcgcagtactgttgtaa

SEQ ID NO: 21160 - DNA, 195 bp, Glycine max
  Peptide Sequence Number=SeqID_112845
gtaaaaggtccaagtgggaaagaagctgaagtccctgaggaaagcgaagaagtgcaagccttgaaagcagagcttgaaaaaatgagagtggtcaaggaaaagctaaagacgacagtcactagggtcaggaaagagtgtgacaagctaagagatgtcaacatgactgatgtgtcattattttctcttatttcttaa

SEQ ID NO: 21161 - DNA, 153 bp, Glycine max
  Peptide Sequence Number=SeqID_112846
atgcttgtttttatgcgtaacaacgctgtaagaaaaagaagggaacaagaagcacaaggaagaagtcaaacctcacctcctccctctccacaaagctacattcaaatggaaagaggaacatgcacgacgaatgacgctagaggactactctag

SEQ ID NO: 21162 - DNA, 273 bp, Glycine max
  Peptide Sequence Number=SeqID_112847
atggctacaccacctagctctccttcttctcctcctcctactggtgtaggatcacattcgtcgtctaccttgaagcggacaagaaaagccacacgcctaagatcattggtgactagaccagttggggcagagagacccttggtccatgtggattttgtgactgagaaagccgacagtccccacagaaagaagttaagaacatatttggggatcattgctcgtgataaggtggatgtgacatacaagaattggaaacgagtccctactgcttag

SEQ ID NO: 21163 - DNA, 236 bp, Glycine max
  Peptide Sequence Number=SeqID_112848
atggcttgcttggaccaacaacattctagaaatgagggacatgctgctgttgttgtggaggacttgtccatctcagatttggatgattcctccaacctggattgtatctattgctcgaaaggtcataattattctattgttgttggttttgctactgaggagattgtttctgcaaagaaggacaaagatttgtatggtgatctgcagaagaacatagaccacagactctacaacag

SEQ ID NO: 21164 - DNA, 498 bp, Glycine max
  Peptide Sequence Number=SeqID_112849
atgtgttcttcacagtattcattggaggagcaggtctcacagggttcctttgttgcccatggacatcatgatgtactggctgctgccattgggcaaccagaacaccctggtcgtgtgcattttgcaggagctggtgtaaccatcaagcaatactttggatcgattccaaggacctcctgcatcacaaaggagagttgtgttgatctctcagggaatgatctagacacggatgacttagacaaatacgggttgtacatcaaaggaaatcctcctcgcctggttgccctaggaagagtttatgagggatccacaatcgttcacaacattcctttgctgcatgatcaagttaaggttggtgttgaggaggttagagatgcagatgctcctattcctatacccattgaagaggttaaggtcgtagggcagacacttaacaccttcctttcttggttggcacatcttgtcaagcgtttatcagaacagctatgggacccatga

SEQ ID NO: 21165 - DNA, 337 bp, Glycine max
  Peptide Sequence Number=SeqID_112850
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgataaaggaaatgaatggattgtgatggaagcttgcttgagaagtttctatgaaggctggatctttgagcttcaatga

SEQ ID NO: 21166 - DNA, 297 bp, Glycine max
  Peptide Sequence Number=SeqID_112851
atgacgcttgctcctggcgcttgctttgttcaacgcgatgctactactctagtagctagcgctggcaatgctcgtggcaggtgcttggtcattaacggatgctacctggttgatcctgccagtagtcatatgcttgtctcaaagattaagccatgcatgtttaaaaagctcgtagttggaccttgggttgggtcgatcggtccgcctccggtgtgcaccggtcggctcgtcccttctgccggcgatgcgctcctgtccttaactggccgggtcgtgcctccggtgctgttactttga

SEQ ID NO: 21167 - DNA, 699 bp, Glycine max
  Peptide Sequence Number=SeqID_112852
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgatttccggcagtttctacacatatattcgcaagatgtggcgtgttacggtgaaaacctggcctatttccctaaagggtttattgagaatatgtttttcgtctcagccaatccctgggtgagtttcaccagttttgatttaaacgtggccaatatggacaacttcttcgcccccgttttcaccatgggcaaatattatacgcaaggcgacaaggtgctgatgccgctggcgattcaggttcatcatgccgtttgtgatggcttccatgtcggcagaatgcttaatgattacaacagtactgcgatgagtggcagggcggggcgtaatttttttaaggcagttatgtgcctagaatattttatctga

SEQ ID NO: 21168 - DNA, 426 bp, Glycine max
  Peptide Sequence Number=SeqID_112853
atgactgagacaagtatgcgagtagggaatgctgatgtgtatggattccttgagccacagtccatacagagatctggacaattgcaatttgaatcagaaagttatattaagaactggatgcaaaattcaaatagggatgtgtacctaggagcctacttgaatggtgcacatttccaaatggtcgtcattttgcctaaggaaaatgttgtcatctggttttgttcgttgcataataggttagacaactacctgaaaggaattattaacaggaatatcaatattttaattgtacaatacgcatccatgtttgtattgaacaatgctttgaaaagatttgacgatactccacaaagtaaatctaaggctgctgttaggtggattgttgttaaatgtaatagacaaaaaggaagcactgagtgtgagtag

SEQ ID NO: 21169 - DNA, 129 bp, Glycine max
  Peptide Sequence Number=SeqID_112854
atgggtgccaagtacctcgaagtggtcaaacgagggttgcatcccaacaacggatgctccccggacgaaattaagggcgcagaatctgtctctgcgcgtttacccactcaacttgttgttcctgaatga

SEQ ID NO: 21170 - DNA, 180 bp, Glycine max
  Peptide Sequence Number=SeqID_112855
atgtcgtggaactttacaaattacctaacgatgggtgttaagtaccttgaggcgatcaagcgaaggttgcatgccaccaaacaatggtacctggacgaaattaggaatcggatgaccaacatcatcctgataccgtcgaactcgttcgcctcggtggatgaaaggtgcggacgaccataa

SEQ ID NO: 21171 - DNA, 1008 bp, Glycine max
  Peptide Sequence Number=SeqID_112856
atggtggaagaatttgaagagatcctaggatgccctctaggggggaggaaaccatacctcttcacagggttctatccctcattagctagaatttccaagatagtccaaatctcggcacaggaattagaccacaggaagcaagtcgaaaatggggtggtcggaataccgagaaaatatttggaggtaaaagcaagaatcttggcagataaaggcgagtgggtcccgttcatagatattctcgcactgttgattttcgggggagtcctctttccgaacgtggatgggttggtggacctggcagcgatcgacgcttttctcgcctatcataaccacaaggaaagcccggttgtcgctatgctagccgatctatacgacacctttgaccgaagattttcgcacctttttcgccaagaagtgaggcatgcttgcccattagaaagcctccgttcatgcacagagaaaggaagggcggattgggatcaactcttagcaagcatagaaggagcatatgtcaactggttccttcgatggaaggaaggaagaaccggagttcttatttcatgcggaggatttccaaatgttcccttgatggggacaaggggttgcatcagctacaatctcattcttgctataagacaacttggctatcctatgagaggagcaccactagaggaagagatcgtgcctgtcatttcacgaggtttcaataagaccaatgtggagacacttcaaaaggtccgcatggcatgggaggtgttgcaaaagaaagacaaggaactcagaggcagtaacaatgggcccatcggtggctaccgtgagtggttgaaagcccacgtgcaaggtttggattggctcccaagtctgagaaccactaaaagggaggaagatgaggcaccggaggaagacgaagaggtgcaagcccttaggacagaactcaagcaagctcaaacagtcaagaaaggttcaaatctgcagctcttaaaatccgaaaggagaatgccgaactga

SEQ ID NO: 21172 - DNA, 348 bp, Glycine max
  Peptide Sequence Number=SeqID_112857
atgcgtctcataaacactacatgcaataaaaaggggtattctaaggctttccatctctggctggtaatcgattaccagaggctccctaagtttcctgacttcgttttcaagcctggtaatcgattacaccccttggagctcgcctgtttaggtacatcacaggttctcactgaccgactatgcccgggttgggtcgggattggtcaagcttggttttgggcaatagcaccccacctgacgtccccaaggtctcctgacccccgcgacatatctccaggtaccactctgtggtcaacaataaaagcaggaagtttcacccttcaacacttcctcatctcaagcttgtag

SEQ ID NO: 21173 - DNA, 637 bp, Glycine max
  Peptide Sequence Number=SeqID_112858
gggaaaagccttccatttccgtcaaatgacccggccccccctggctcttccaccgtcctggctccctttcctacctatgctatgctcccccggcaccggcctaccacgcttcgcgcctgcggcgttttcgccggacggtctttgccagtagtgccatcctccccgctggctgtgcgggttacacgttccgctgtgccgagatgtgaggtgcaggtggtgatgatcaccccggggtatgcgctagcgcccttgacaggcactccaggacccgccaacgctcatgaaaacccgggtcgtaagggcatagctagcggcataggagccgactcggcgtcagcggcttcgtgccgcactggagtgatccaatatgtggttccgcacgttccaccacttctccgttcatttccaatactgatcgtgaaacaccatgagcagcaggatgttgagatcgcgagacataatgttctctgcgacactggaatagatttcttcaatttccggaaagtgaacggaaagccgccctttccccttctcacaatattaccgaacttgctcaagaatgaatggcacttcgaagtgcctcacgttgggggatcggcgtggggaacttccaccggttctggactggagccagcgg

SEQ ID NO: 21174 - DNA, 984 bp, Glycine max
  Peptide Sequence Number=SeqID_112859
atggccaagtttgatccagaaatagtccttgagttttatgccaatgcttggccaacagaggagggcgtgcgtgacatgaggtcctgggtaaggggtcagtggatcccgtttgatgtcgatgctatcggccagctcctgggatatccgttggtgttggaagaaggccaggattgcgagtatggccagaggaggaaccgatctgatgggttcgatgaggaggccatcgcccagttgctatgtataccggggcaggattttgcccggactgttgccggaagacgggtgcagatcatgcgcaccaacatgaccactctgactcagatatggatgactttgctcctcagcaacatcctgcccaccgatcataattccgacctccccctgccgaagtgtcagctggtgtacgccatcctgacgcggatgagcatccatgtggctcagttaatcgctgatgccatctatatttttgcaggtatggcgcctaccaggcaccctttggacccagataagtccaacagggccctgggatttcccgcactgatcacaggactctgccagtcgttcggagtccccgttgcacctaccaaggtaattcggccgcccatcacccgggcttttattgagaagtactgtacccagagacaggctcagggtgatgctccacaggccgcaggcgcgcccccaccactcatcaggctggccaggctgggtcatttgacatggagcagtatttacagcatttggttcgccaacaggcggccaaccaccgggcacatgtacagacccatgattagccagggcttcgcttctttttcatgccctactccagaccatttcagggcagaggtcgcatggcccggagattggcccgaggcccaagcaggagaggcacccccagaagctcccggcgatggagaagaggcccacgaggacgaggagatggccgatttgcttgacttcttgggagggagtggagctacatga

SEQ ID NO: 21175 - DNA, 216 bp, Glycine max
  Peptide Sequence Number=SeqID_112860
atgggtgaagtagaggaggtgcaagagctgatagaggccgacatggaggccatgaaagagcaaatggtcacaatgatggaggccatgatgagcatgaagaagataatggaagccaatgcggttgcagttgccactaccagcgttgttgctaaggtgggacccgatgtccccatccggcatcaaccaaatgaatcatccaacctcagattatggtag

SEQ ID NO: 21176 - DNA, 570 bp, Glycine max
  Peptide Sequence Number=SeqID_112861
atgccccaccaagaaaaccatgattatgagggggccaagacatttttagtagccaaagatgaggctactacttcaccttcctctagtaaaagtgaagaagcaaaaggggaagaatctagtgaagagatctacccccaagaagaaggacaacctttaatggttaaggaggagtgtaaggaggaaacccttaatcaagaacagaaccacatacttagaaccaaagaaaaactagaaagaaaagaaaaaggaaaagagaggataaaaatcaatcaagatgagagggaacaaataagggaagaagaaagaaggaaaatactaaaagagttaagaaaagaaaaatatgcctcctatagtagtcttaactcatgcaagagcctaagtgaagaacttcgtgactattatgaagtaaggcataggtcacatcttagacctcactcccataggagagaaatagaaagaaagcctcaagaggctaacattaacctcccatacttccatgggaaggacaatgtagaggctaacttagattgggaaataagggtaaagcaacaacttaaagcaaccccttaa

SEQ ID NO: 21177 - DNA, 669 bp, Glycine max
  Peptide Sequence Number=SeqID_112862
atgatgataacaaaagatgatgacaaaggtgatgacaaaaagctcaaagatcaatcaaagaacaactcaagtgaatcaaagatcaatcaaagcacaactcaagtaaatcaagaagaattcaagactcaagaagaaagtttagagtcaagaatcaagattcaaggttcaagatctcaagaatcaagattcaaggttcaagatctcaagaatcaagatcaagattcaagactcaagattcaagaatcaagagatggctcaatcaagataaggtacatcctttgtggtacaagtagagggtacatctacttgggtttgactgagaacaagagagggtacatctcttatggatcagttctagtggagggtacatccactaggttcaaagagaacaagggagggccactcgatccaacaccaacgacaaaccatcccaccaccccctcatcctgtcaacaactccttcaaaccccgccactactgggacaagcctcctctgacgaagctgtgatgttcaagctcaagacctttgtcaagaagatgttgagggaattggggaactatccttcggggagcatagtggacgagtttggtgctacaattcttgcacgaatttgtgtgtttcatagtcttgatttggtatttctagaagagggtgaaaaaaacatttga

SEQ ID NO: 21178 - DNA, 450 bp, Glycine max
  Peptide Sequence Number=SeqID_112863
atgaagaactggatgcagaattcaaaacgggatgtctacctaggagtctacctgaatggtgcacattggcaaatggtcgtcattttgcctaaggaaaatcttatcgtctggttttgttccttgcataataggccagacaactacctgaaaggaataattaacagtgctttgaaaggacttgacgatactccacaacctaaatccaaggttggtgctaggtggattattgttaaatgtaatagacaaaaaggaagcactgagtgtggctattacgtgatgcactggatgtcaactataatcttaggaagtttcaagaataattgggaaatgtattttaatgatgttagaccattggaatcagagatattaaggcgctttgcatcctgtgggcaaattattcaagccaaccaacttaagatcattgagggatacaaggatcttgatatttga

SEQ ID NO: 21179 - DNA, 302 bp, Glycine max
  Peptide Sequence Number=SeqID_112864
gcatcaaaacatcacgatcatatggcatcaccaaaacatcaaaggcaaagtctttgcttctacagacgctaaagatttcaagtggggaagaagctgatgtccctgaggagagcgaagaagtgcaagccttgaaagcagaatttgaaagaacgcgagtggttaaggaaaagttcaagataaaagccaccaaggttaggaaagagtatgatgagctgagggatgtcaacatggccactgccgaagctttggagcgagaaactaagagagcccgaaaagaagagtggggctggaacaagttctga

SEQ ID NO: 21180 - DNA, 266 bp, Glycine max
  Peptide Sequence Number=SeqID_112865
atgtcgctgcatgttctttatctttatgcgttttctggatttcccccagggatttcccgtctgctgtatctctcgttacaatctttcaaagaaatgaacgggcaggatcatcttgagctaccttctggggtgaggaccaaatgtggacagcagaaaccaatcaaggtacttaggaacggatgcaagtggggatggggtcacgaccgaccgatcgttgccccttctctgcgcgaaacaagcagagaacgtcgctgcaaggcagcccc

SEQ ID NO: 21181 - DNA, 691 bp, Glycine max
  Peptide Sequence Number=SeqID_112866
gtgctccagtggcttctgtttctatcagctgtccctcctgttcagctactgacggggtggtgcgttacggcaaaaagcaccgccggacatcagcgctggcaagtgtagcggttcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattttagtgataacccccaaggggcacggagcgaacacgctgcgtgccatttttcacactgtcatgcatgagtatcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 21182 - DNA, 465 bp, Glycine max
  Peptide Sequence Number=SeqID_112867
atgtcaggatttacatgcgattctcctcaaatttcagccagcccgcatcaattagaccttgcaccttacgcttcaggcccctacaatgctcaatggaatgccccagggcttctccatgacaagcacacgttgcgttcgagtcgtattctcggagaaatggaggttgatgaaccttggttagggttatggctaccattgaattatcaagtagatatgggagcaagtggtgtttgtcatcggaagtgcggtaggttggctttgtggttgattttagggatggcctttgtgaataactgggcggtgggtaaggagaagaatggcagtcacagcacgggcttctacttcatcctcaccttcttcatttgccccagttttctcattcgtccaagcaggatgactaaattttcctttttcagacccacatcgatcctttcactggcaaagaccaaatccgcaaagctttga

SEQ ID NO: 21183 - DNA, 432 bp, Glycine max
  Peptide Sequence Number=SeqID_112868
atgacgaagaaagagattatcacaataatagtagacatgttaccagtgttcaactatgagaaaatggtgggttacatgccttcaaactttgcctatttggttttcaccggtgaaaggatcgaagtgggtctgagaagaggcaaatttgattatcctgctttgatgggtgagaaagttggggcaaatagagaggatgagaaggaggaaggaacccatgttgtgactgtcgttcctacatggccaaatttcccaccaactcaacaatgtcattactcagccaatatcagcccttctcattacccaccacccaatcaaccacaaaggtcatccccaaatcagccacaatgtcggcctgccgcacatccaatgccaaacaccgcccttaacacaaaccaaaacaccaaccagggagggaattttctagtaaaatag

SEQ ID NO: 21184 - DNA, 426 bp, Glycine max
  Peptide Sequence Number=SeqID_112869
atgcactatgttctttgtcgcattttgcttcctaggtccactaatcttgcccaggcctctgaggaggatttaatcttgttgtgggcccttcaaactggtcgccagattggttgggcccatcttgttcggtaccgaatgcataaggcattatgggccaaagcagctcttccatatccccatcttgttaccttatttcttcagcatttcaatactcccttggatgatgagccttttgtcaaagttaaacgctcttttgctattggtgttggtgttgttacatcttttggttatcggaaagacatggatggtcagtgggtacacaagcaagacctaccacctcccattcccgatgagcgtagacggtctccaccaccgcaaagggatacctcttattctctcttaactgacgtcctcactaaagtctga

SEQ ID NO: 21185 - DNA, 363 bp, Glycine max
  Peptide Sequence Number=SeqID_112870
atgacattgctacttagcaacattctgctcagcgaccgcaatgccaatctctccctgcaaaagtatcagttggtctgtgtcgtcctgacatggggatcgcacccacaaagacacccagtggacctgaagaagtccaacagggccctggggtttccagctctggttacgggcctttgtcggccctacagggcgcccgtttcccccagcaagttcatgtcgccgtggcatagggagtgcctgtcacccccagcaaggtcatcaggcccccctaccaatcgagctttcatcaagaagtactgcgcccccaggcaggcgcagggcgaaacaccacatcagcattgggatggccgtagcgggcaatag

SEQ ID NO: 21186 - DNA, 318 bp, Glycine max
  Peptide Sequence Number=SeqID_112871
atgccatacgtggaagccgtggaggagtcattggaaatgactttccaatcttttgaggtagtaagcattgcctccgtagattccctctctaggcagccccgcctgtccgatgcggcaatgatggtggcccgggtgatgctggggcacggttatgagcccagaatgggtttgggcaagaacaacgacggcaggactagcttggtaagcaccagaggaaaccgcgggaagtttgggttaggctataaacctatgcaggctgacataaggaaaaatatctcgaaaaggaagaacaaaggccaaggctcgcggttgggatag

SEQ ID NO: 21187 - DNA, 331 bp, Glycine max
  Peptide Sequence Number=SeqID_112872
atggctccaaagaaactctccacgaagaggtctagaagagacgccacagcagaagggtccagtgtcgcccccgagtttgatagtcatcgtttccaaagcgccgagcaccagcagcgcttcgaggccatcagaggatggtcgttccacagagagaggcgtgtccagctcaggaaggatgagtatacgtactttcaggaggagatagctcgcagacgttggatgccgctggtgactcccatggccaagtttgaccctgagatagtcctagagttctatgctaatgcttggcccatagaggagggaatgcgagacatgtgttcgtggatgaggg

SEQ ID NO: 21188 - DNA, 763 bp, Glycine max
  Peptide Sequence Number=SeqID_112873
atggcggtacacacggtcactgaagccgctaaattagctggtgtcactaggcgtacaatataccgatatattaagcagggtaagctttcagcggtagtgacaggtagtgacacaacccagattgaaaccagcgaattactgcgagtttttggtgccctgtcacaatcagaaggctctcaagtatccactggatcacaggttgaagagcctgagtatgtcacgcgtttaatggcggaaatgtcacagattagggatttagtccaagggcagcagcagttattgcttgaggataagcttgaggctgaaaggctgcgagaacagatgaccgggttgcaaaatgagcgtgacgcagcggctcaggagttggaaaaagtgaaggcagagcttgaggcggagaggaaaaagggtttttggaaaattgtgatgaaagtggtgattctattaggcgcattcgttttatctatgctcagtattaatgctctatccgctgaaaatccaaaagacccttggtacgaggtaagcagtaatgctgctggggacgcaaaaattttagcaaaagtagacactgttaagaaggatgaagtaggtgtttctgtattgattcagtaccttgtcaaagatctgcctggtggggctttttctgtaaaatactatcagatgtccatatcaaaaaaggcgtgtgatgatggttatggtgaggtcttgttttcaccagtatctaaaaagaaacaagatgagttttcctctgagtatgttgaaggtg

SEQ ID NO: 21189 - DNA, 549 bp, Glycine max
  Peptide Sequence Number=SeqID_112874
atgcaattcaaggataccgtagattcaatgcaacaagcatttaaaagagctgagactcagattggtaagttggtggacgacatgactaaagttattgtcaaaagagaagaagagtatgcagagattgaaacacatcaagaaagcattcttcaagttaacacaatccatcatcaattgatcaccgaagaagaaaaggatgaagtctccattattccagaatatccctgcatggcaactactggatatgttgtacgcaaagataaaggtcaattggaactcaatgtagaggatcagaaaatcccctttgacctctttaaagcaatgaaacacccaaatatgggtgatgcctgttttgaagaagaagaggtggagcaggagatagcattatcagcttcaaccatggtactgcagttcccttttgaaaaagaacctaattatgtggcagactacctagtttgtgctgaagagcttgatgatccaaaagacaactctattggtcatgtggttcttgaagaattagaccaacagaaaagctcaaagcagaattga

SEQ ID NO: 21190 - DNA, 348 bp, Glycine max
  Peptide Sequence Number=SeqID_112875
atgaggatgtggggacttccttcggaactagaaagaatggtcgcccatgaggaccaagaaatggggcctcatcaagaagaaacagagctagtagacttaggatttggcagtggaaagagggaagtaaagatagcaccgattacctctaaaacccgagtgttccccggtaaagcagaaactgagaaggatgaagcccgaaacgtccttgaagataaagaagaagtaaagaagcaatttgacgctggttttctggctgtcggcgcggtggggcggaatgggttgccaacattgtaccagtccctaagaaagatgggaaagtgcgaatgtgtgtggattatcgtgacttga

SEQ ID NO: 21191 - DNA, 150 bp, Glycine max
  Peptide Sequence Number=SeqID_112876
atgggcttaaaaatccatcctaaggttcatgagaaccctaaggccttctttatcagctctagcccaatcctcttggagcctgttgctcatgactctggaacatgggggaaagagacctcatcgaataactcaaccaatttcttgatgtga

SEQ ID NO: 21192 - DNA, 309 bp, Glycine max
  Peptide Sequence Number=SeqID_112877
atgaaagataagtgggatgtgtatgaattgcacaatatattagttcaggaagaaacaaagcttaagaatcaaggaagtcacttagtccattatgtaggccaccaagggaatcaaggagttggaaagaaatttgtgaataagcatgataaaggcaaagggtcattacagatcaatgatggtcctatgcaaatccagaagaaggcatcaaagagtaataattttcatttctatgggaaatctggacacttccagaaggattgcccaaagtgtaattcttggatcaataagaaaggtgagcttaatgctctt

SEQ ID NO: 21193 - DNA, 387 bp, Glycine max
  Peptide Sequence Number=SeqID_112878
atggggatcgcacccacaaagacacccagtgaacttgaagaagtcccaacagggccctgggggtttccagctctggttacgggcctctatcagtcctacggggtgcccgtacccccccggcaaggtcacgtcatcataggtaagtatgcacatcgctcactgatttctgatttcatctattgtttgcagggatcgcgactgcaagacactagtggaccccgaagaagtccaacagggtcttggaattgtcaagctctaattacgggtctttgtcagttctacggagtacctgtcacctccagcaagggcatcaggccccctactaatcgagctttcatcaagaagtactgcgcccccaaacgggcgcagggcgagacaccacagtag

SEQ ID NO: 21194 - DNA, 264 bp, Glycine max
  Peptide Sequence Number=SeqID_112879
atggaaaccatatccaagcggttcaaagagtttgatgtttgtggcaaagttactctaaagagcaaacttcgggaaatttcttgccctgatgtaaaattaattcttcaatcaagcatagtgtgtcattatctgaacaaccaaaaccaagaaggaccataccgatgttggatcaatttcatccatgcattcatgattccattgaaaacattattgatgtcaaacctgatggtaactgtggatatcgtgcaattgttgccttattag

SEQ ID NO: 21195 - DNA, 399 bp, Glycine max
  Peptide Sequence Number=SeqID_112880
atgaagaatgcttatctgtatctcttttgtaagagaattgagaaaccaagatgctatcattttgctgccataaagcatgactggagtgctccaatggagataaaggatgagtcacaagactcaatccaggatttcattggtttgtatgagaaaaggattggaatcatccatggcacccatgggggaacttcgaagaatcgaagaataggagaagaagtgctagaaagggatcagagaaagcgtcacaagcttttcatgaagtcaaactctgattttgaaggtaaaataagtcttgacaaagctgggagcagtgaagatgagtttgggtttctttatcttttctcatgcttgttactgatgtatcatggcgctgcttatatgaagacaatcagctggtga

SEQ ID NO: 21196 - DNA, 453 bp, Glycine max
  Peptide Sequence Number=SeqID_112881
atgcctcacagtccaggcacaacgacgcaattatcaggggcgcgctctaccactgagctaatagcccgtcgtgcgggcctcccgccggggcccgctatgccaaaagcaagagaaaccccatccctctctttccttttttcacccccatccatgtcgcccccgtgtggcgacatggatgggggtgaaaaaacattagctctccctgaaaaggaggtgatccagccgcaccttccagtacggctaccttgttacgacttcactccagtcactagccctgccttcggcatccccctccttgcggttaaggtaacgacttcgggcatggccagctcccatagtgtgacgggcggtgtgtacaaggcccgggaacgaattcaccgccgtatggctgaccggcgattactagcgattccggcttcatgcaggcgagttgcagcctacaatccgaactga

SEQ ID NO: 21197 - DNA, 784 bp, Glycine max
  Peptide Sequence Number=SeqID_112882
atggtacacactagtacgcgcaacatcattcgagcttctcagctcgcgctgggaactcctccaattcatcacccgtacagcctagagcgcccacccccatctccggctccaaccacaactcacccggccggcaatgcccactttggtgtcggttccaacgcgatgaggaactttcccccgatgccgattccagaattcaccccgatcccaatgacgtacgaagacctctgcgtccctcatagccaaccaaatggtcgtaataactcctgggaagatctaccaacatcctttcccaaagtggatcggcccaacgtgaaaacaaacccgctcgccaatcatggagggggagcagttaatgccgttgagtcggataggccgcgcaggtctaagcctttaaaggacgtggcgactcccaggagcgagctacataacatggaaatatgtttagcagtggaggacttgttgcaacagatgatagatcaaggccgactggaagtcgacgatgaggggagggaagagcagcatatatgtatgcagtccgcagatgagggaagttttggaaggcctaaacctttggtagtatatttcaccaaggacgcagctccacaaaagccccgatacccctcgatagttaaacttgttcctttcccataccgaaacagccacgcagtcccgtggaggtatgcacctccaagtgaaaggaaagaagaggccaccaacatcagctcgttgtcagctaaggtgaccaatatcatggggctgagcggtgtgacccacagcggtc

SEQ ID NO: 21198 - DNA, 291 bp, Glycine max
  Peptide Sequence Number=SeqID_112883
atggtgttttttgaggtgctccagtgggttctgtttctatcagctgtccctcctgttcagccactgacgggggtggtgcgtaacggcaaaaagcaccgccggacatcagcgctggcaaagtgtagcggtcacgctgcgcgtaaccaccacacccgccgcgctttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 21199 - DNA, 144 bp, Glycine max
  Peptide Sequence Number=SeqID_112884
atggatatggatatgggtccaacaccaggtggcagaccggatatatcctcaggaaacacttatggaaactctctgacaacagggaggtcacacatagaaacctttgtctctacttccaggctagacaagatcatgtacacttga

SEQ ID NO: 21200 - DNA, 1231 bp, Glycine max
  Peptide Sequence Number=SeqID_112885
atatctaggtcaacacaacaaaaggcattctcatgctccatctgtgtctgcatctgcttcaattacagctttacttgaaaagctccgcagaaacagaaacaccaaggcagaaaatcatgtgaatattgttcatgatcaagaaagggatattgtggcagaagactggaagcagggctgtggcttaaagaattctcctaacttttacaaactcacttctatcattgataaggctacaggatcaccaagtttgactgacacagagccatatgttatgaaactaactgaagatcaaatggcccagctgctttctgccttttggattcaagccaatcttcctgataatttaccttcaaatattgaagctgtagctcattcattcatattgacactaattgtcttacacataaagaacctgaaagacagagatagcctggtgatccgcttcttccagtttcctctgtctctctggactatgttgttggaccaaagcaatggaatattgtccccagcttgtcagaggtctgtctatgtattgtctgctggcatgttggcctttgcctgcaaaatatatcagattcatgatctaaatgatgtgtttgcatcattgccaatgtctgatgttgatccattcttgagtatcagtgatgattatcgagtatatgctaagatccatgtggatgtgagagaatatggtactgctgctgataatcagttagcatgttcagtattatcagagttacagaacaaaagacgtgaactggctatgctattgtcagagaaatttaagcccgatgaagagtttgtgttcggtccacagtcaatgcttgatcagaatcaaataatttttcattcccaggagtcactgtcatttgatggggattttccctcaaattcagcaggtgaagatgacacaatcagtgaagcatctgtctctgacctttctcgatttattccaaagatgcctctatccccttcggcacctcatgttatcagcattggacaacttatggaatcggcattagaggtagttggtcaagtggcaggaacagctatctccacttcgcccctttcgtacaacaccatggctagccagtgtgaatcactcggtacatgtgcaaggaaaaagctttcaaattggctggcctttgagaatcattacagccaagcacctgatgataaatcgtttttggcaattgctgatattaggaactcagcacctgtgaaggtttga

SEQ ID NO: 21201 - DNA, 144 bp, Glycine max
  Peptide Sequence Number=SeqID_112886
atgaaaggttcctttacggtggtgctatttaaagctaatgacatacgcaagatctgggatgaagtgttcagcggtgaggcaacaccaatagagtatgcagagattctggacaaccttcaatcaaagttcggccttggacagtga

SEQ ID NO: 21202 - DNA, 117 bp, Glycine max
  Peptide Sequence Number=SeqID_112887
atgagaacaagtaagtgtgaaaacagatatctaaaggcgttgggtcctcctattgagcttaaaaagggcttcctaatctcgatgtcgcgcttagtgccattctcgcgcttagcgcaa

SEQ ID NO: 21203 - DNA, 288 bp, Glycine max
  Peptide Sequence Number=SeqID_112888
atggttcattcctgggaagaggaagaagcagatagagcaaaggcctcctctttccgtccactcttcccgaaccctactaagcctaccacccccttctcttcacccgatacaagaaggcagtcgaagtcccctccactcttcattttatgggaagacatcgcgttcctagtcgatttccctcattgcactgtccccttaatgctacgaagtgaagcaggcatagagaccaaccaaaccatagggtatctatcctgtgatctttcatcaaccccggctcggtatcggtag

SEQ ID NO: 21204 - DNA, 375 bp, Glycine max
  Peptide Sequence Number=SeqID_112889
atggtacgcagagacaaaatttggtcattctacaccctttgtcatccagaggcggcgggcccgatgacacgcggagacaaaatttggtcattccgcaccccctttgccattcagacacagtcgtgtccgatggcacgcagagacaaaatttggtcattctgcaccctttgtcatccagaggcggcaggcccgatgacacgcggagacaaaatttggtcattccgcactcctttgccattcagacacagtcgtgtccgatggcacgcagagacaaaatttggtcattctgcacccttttgtcatccagaggcggcgggcccgatgacacgcggagatttacatcatcttccgcactcacaagatctgtcatactga

SEQ ID NO: 21205 - DNA, 818 bp, Glycine max
  Peptide Sequence Number=SeqID_112890
atggtgaaagttggaacctcttacgtgccgatcaacgtctcattttcgccaaaagttggcccagggcttcccggtatcaacagggacaccaggatttatttattctgcgaagtgatcttccgtcacaggtgctcccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatccaagactacaatgtcttctatcttttacatttcagagacatcaatgtcttcagtcatttacgctttacaagacatcaatgtcataggtcatttacatttcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 21206 - DNA, 612 bp, Glycine max
  Peptide Sequence Number=SeqID_112891
atgtcggctttgaaagagcaaatggcttccatgatggaggccatgttaggaatgagacaattcatggagaaaaacgtggccaccgctgccgctgttagttcggttgccgaagcagacccaactctcctagctaccgcgcaccatcctcccccaaacacgttaggacgagaaaggaacacactggggcacagcaacaacccccatttgggatacaaccgggtggtttacccttatggattaccgcctaattacacgccgccagtcatgcatgatgacgcgggtcatgtctcttcccccatccttgagggggagcctcctcgacagcctgacgaggtccatgaagatcatcaagagtatgcccaagaggatgtcgattcctaccccctaatccctgtcgaggggccagcacccaacacattgcctcagcacaacctcactgcacaaccaatattcttgtccacagaaggaccacccccgacggcggaagaaagaaggaaactcgatctcatcaaggagagattgagagctgttaaaggctttgatgactatccattcacggacatgacggatctttgtttggtaccagatgtcatcatccccccaaatttcaag

SEQ ID NO: 21207 - DNA, 186 bp, Glycine max
  Peptide Sequence Number=SeqID_112892
atgaaagaactgagcttagagggtagcgaaccttcgttgatgcattggtatcgtgtgaggagaggtcacggtgataatctcgtaatttctgctgttggttcgcaagggttattggagaagggttctggtaagattgtgctaggttccatgcatgaaggttgtgtgttaatgatctgtggaaagtga

SEQ ID NO: 21208 - DNA, 403 bp, Glycine max
  Peptide Sequence Number=SeqID_112893
gttatgttggatgctaccatgttgggggtgtttaatcaagacttcccattgtacatcaagcacgaagacctctctgaaattgcacacagtggtcaatgtctcagcatatctgttatacaattgtggattctgcatctgactgagacaagtatacgagcggggaattccgatgtgtatggattccttgagccacagtccattcagagatctgggcaaccagttcaaaacgcgatgtctaccttggagcctagcggacactggcaaatggtcgtcattctgcctaaggaaaaccttgttgtctggttttgttccttgcataacaggccagacaactaccttaagggaataattagcagtgccttgaaaggacttgatgatactccacagcctaaatccaaggctg

SEQ ID NO: 21209 - DNA, 276 bp, Glycine max
  Peptide Sequence Number=SeqID_112894
atgagtttagagaaggagtgtttgagtttgtacagtttgttactagtaggacatgtttcaaatgcaaggagaacaaacaaggtgtccctggatctttataaggaagggttcatgccaaattattattggtggacaaaccacggtgaagagttaccacaatttcctccaatagtgttgcaaggttcatactacgaaagtggtgggcaaagggaagaattgaatccttgtgagaaaatgatcatggatcatgctgaccatcaattgaccaatacatag

SEQ ID NO: 21210 - DNA, 366 bp, Glycine max
  Peptide Sequence Number=SeqID_112895
atggttatgggagatttcatcaacagactctccttccccgcatgtttgcattttagtggagaaaacaccgagactttttcaagtctcacaagttatccagaactacgtaggtctgagttcctcttcgatggaggatacgtaggagcaagagcctcgcttttgtcgaccacaccgctttctgttaccatgacccaagagctggtagcctgcggagacaccttacggttatccacgcctcgtcattcagtgaccccaagtgtgattgatgagcagaggccaatgtggtcatctgcgccctttccggagatgtcagcatcttccggtggagactttttcaagtctcacaagttatcaagaactacgtag

SEQ ID NO: 21211 - DNA, 417 bp, Glycine max
  Peptide Sequence Number=SeqID_112896
atggagctcattgagaatatggtagctagtgatcacgctgttttgcatgataggacacacatccctaccaaaagaagtctgttagagctttcttcacaagatgcattgttggcccagaacaagttgttggctaagcagcttgagacactcatagagacacttagcaaattgccaagactgctgcaagtagctcaaccatctcactcagcagttatgcaggctaccaacaaggaggaaacttcaatcaaaatcaaggacaagggtggagatcacatccaggtcacaatgtctaatcataagagtaccgagtcagccattaagaacctagaaatccaagtggggcacttggccaagcaaatagcagaaaattcctcaggaggatttggagcaaatactaaaaagaatcccaaagaatag

SEQ ID NO: 21212 - DNA, 679 bp, Glycine max
  Peptide Sequence Number=SeqID_112897
atggggacaaatcaaaacggcaaaaggttttatcaagtcaaggttaagggtctagatgtcaccagcctcaaggaattgggacgattgatgggacctctccaaaggaaagccttctgcaaagtgtacggaaagatcctagatttgatcacagcggaggtatttacggaagctgtcgtatccctcgcccaatactatgatcagccgttgaggtgcttcacatttggggatttccaaatggtaccgactattgaagagtttgaggaaatattaggatgccctcttggggggagaaaaccgtatcttttctccgggtttcttccctccttgagtaagattgcagctatggtcagagattcggcaaaagaattggatcgcatgaagcaaactcggaacggcgtagtgggcctgcctcggaagtacttggaaggcaaggcaagggatatggcgagccaagagaagtggggcccgtttgcggatatactagctttgttgatttatggggttgtcctctttccaaacgtggacggtttggtggacttagccgcaattgatgcttttcttgcatatcaccatagcaaggagagtccagtggtggctatcttggcggacttgtttgatacctttgaccgaaggtgcgagaaaaacagcgcacgggttgtctgttgcttacccgctctca

SEQ ID NO: 21213 - DNA, 249 bp, Glycine max
  Peptide Sequence Number=SeqID_112898
atgcgtgttccacgaaaggaatacgcgtggagtcgccaccaacgtttatttgaggaaaacgtcgaaaaaaccggaaaagacgcgatctacgaacttttaagtgaaaggctcgggagttgtatttacgcacggggaagggtgtttcccttttgtcgcaacctacccttcggcgggagggcgacgcgagactcgcgggatgcgtgttccacgaaaggaatacgcgcggagtcgccaccaacgtttatttga

SEQ ID NO: 21214 - DNA, 794 bp, Glycine max
  Peptide Sequence Number=SeqID_112899
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 21215 - DNA, 297 bp, Glycine max
  Peptide Sequence Number=SeqID_112900
atggaggtcaatgtggctgcaatagtcgctatcagcaccattgctgagggtgaacctaacctccccatatggcctcaaccaaataaatcatccaacctcagatatggtgatgaggacaaggcaaggaataagggcaaggaacctttagaaggacttggaggacctatggcaagggctagaacaaagaaggccaaggaagctcttcaaaaagtgttaaccatgctatttgaatttaggcccaagttacaagtggagaagcttcggattgttaattgcaccatgttccaagaagagtag

SEQ ID NO: 21216 - DNA, 420 bp, Glycine max
  Peptide Sequence Number=SeqID_112901
atggagcgtggtcatggaatgtatacacgccagcaacattttccgaatatccttcacagatgtatcagtatccttttgcaggtcatcatacgtgatagttctgagacctcacattcgttcggtggtgttgcggaaacacaacctcatttttcatggcccactatgactccttcacagcagcacgatgcccccatggcaacacctaacgccccatttgctccgcaatggaatgtacccggagcaatacctgatatgggcgacttattaggtgttgatttgcgtcagcagttttctgcagaggctgagcaagcagaagcggggagacaacgcggcggcagaagaaatcctgatcgtcaagcgcgaagatgggatcgaccatgtggcacatcctcacgacatcacggacaccataatgactaa

SEQ ID NO: 21217 - DNA, 575 bp, Glycine max
  Peptide Sequence Number=SeqID_112902
atggcgacctcattcgaactggcccaattcattgtcgcccgcctggtgctgggcgtaggcaccggtggctatgtggcgactgtacctgtgtggcaggccgagatttcccaggctaagaagcgtggcgcccacgtcgtaacggacggcattttcatcggtgcaggcatcgcgatctccttatggatagacttcggcttttacttcgtcaagggcaactcggtctcatggcgattcccacttgctttccaggttgttctgtcggtaattgtcatgctattcatcacagtgttccccgaatccccccgatggcttgtcaagagaggccgagtggaggaagcacgcgaaattctggctgcgttagccgaccaggacccccattcggaggatatcaacatggctctcgccgatattgaacgatccctggccctctctggctccggatcttggaaggacatgttgacgatgggcgagcagcggttgttccatcggacggttcttgcggctactggacagatgttccagcagatgtgcggaatcaacctcatcaccttctacgccaccaccatcttcgaaca

SEQ ID NO: 21218 - DNA, 345 bp, Glycine max
  Peptide Sequence Number=SeqID_112903
agaaagaagagcaagaacatcgctattctgcagcaacttccttatgcctctgtcgtcgccgggctaaggcctgctgagacaatagatagtcaggcagagaaagctatcgatggtcgcattgggacgggaacaagagcaattcttggtcccaccaaaccatgccatgaacagtcgactcaacaagagcaggggatatttaaactaagactcattccgtctattgctctaccttcctccaacagattgaattgcatcgtttattccccggcaaaactagctgctgactcaacctcccctcgggtctacgccctctttgttttagcatcggcgattgaaagagagtag

SEQ ID NO: 21219 - DNA, 343 bp, Glycine max
  Peptide Sequence Number=SeqID_112904
atgctggaaagttttaaacaacaagaccaaatgtcagttctggaattgtacataaaaaaggatgtggctggtggttcaatgtttcattatgcaaattcgcttacatcatgtggaaattatttatctaatgatgagacacaaccgacaacaaatttgagcaatttacatattgacgaagacgatgatgatgatgacgatgatgatgatgacgatgattatcttgtgtctaactcatacgttgaaaagtctttagacgaagatgacagtcttgacggtatatctgatacagacgatgaagtcatcgacattcctcaaccagtaagaattgttcacccagcagaag

SEQ ID NO: 21220 - DNA, 609 bp, Glycine max
  Peptide Sequence Number=SeqID_112905
atgaccagtcctctcaatgagtcaatctcatgctttctcataaatgtggacccttgggtactagaacctattgcctttagaggactacacgtcctcgcctttaaagggctacatgccctcaccttcagagggctgcacgcccttgcctttagaggactacacgtcctcgccttcagaggtttacatgtcctcgcctttagaggactacacgtcctcaccttcagagggctgcacgccctcaccatcagaggactacacgtcctcgcctttgtagggctacaagccctcaccttcagaggactacacgtcctcacctttaaagggctacatgccctcaacttcagagggctgcacgcccttgcctttagaggactacatgtcctcgccttcagaaggctacacgtcctcaccttcaggggacaacacgtccttgccttcagagggctacgcgtcctcgccttcagaaggttacacaccctcaccttcagagggctacacgccctcaccttcaaaggattacacgtcctcaccatcagagggctgcatgccctcgccttcagaaggttgcatgtcctcgccgttagagaactgcatgtgctcgcctcaaag

SEQ ID NO: 21221 - DNA, 604 bp, Glycine max
  Peptide Sequence Number=SeqID_112906
aacggtcgagaatcttcgcgtaattactgacggaaacgttacggaagcgcctcagcttggattttcttcacggaaacaattttcctcagcaaatttaagagaatacgaagggccaagaaggctgaccccttctctcttcactcctccccttatttatagcaaaataggggaggagcttgcagcccagctcgccaaggcgagctcagctcgcccaggcgagcaaggttgcttcctccagaagcaacagccttctggaggaagaatctggaaggcccaactttcgaagaagttacgaaaactcacggattgcgaaaaacacctcattttgatttccgtcacattacggaattttcacggatcgcgtcgttgtcacgctctggttgtgtctgctgtgacgctcaccgccgtgtcttggaaagttgtagttcgacagtttgaagcttcagataccctgagactaggctcaggccctttgatttgcgctatatcagagctgggttacttaaggaggaagcaacccagcccacctgggcgagctgggcggcaacctcctcccccttttcctataaataggcgaagggaggctgttccaaagggtccctaa

SEQ ID NO: 21222 - DNA, 144 bp, Glycine max
  Peptide Sequence Number=SeqID_112907
atggatgaggtggaggcgttagggctaacattggtgatgaaggttcaagagattgaggtgcaccaaaaaatccaagcatggatatctgagcctattgaatgttttgaagaagaacaacaccaagggatgaaaattgagttatga

SEQ ID NO: 21223 - DNA, 165 bp, Glycine max
  Peptide Sequence Number=SeqID_112908
atggagaggaacactttaatcagagcggaatcatctaaaaccaacttgaggattcagtcagagagcagagctctcgaccctctgttcacggtttctttgagacgaatggacatgaacgtaagagatctcaaaacaacatcacgaggaactaacaagagaatatag

SEQ ID NO: 21224 - DNA, 723 bp, Glycine max
  Peptide Sequence Number=SeqID_112909
atgaaggaagacatagggcacatcttagacctcactctcattggagagaaaaggaaagaaagcctcaagcggagcaacaacttaaaaggaagtctacttcaaaatttatggtctcactcttatccaaagaaagaccaaggtcaaggcatcttaggggtgacaccttctaagcccaaaggtgataagggaaagacaatagaaaaccaagcccctaaggctagtatgcaagagaagactagctctataaagtgctttaaatgtcttggaagaggacacattacttctcaatgccccaccacaaaaaccatgattatgaggagccaatacatttatagtagccaagatgaggctactacgtcaccttcctctagtgaaagtgaagaagcaaaaagggaagaatctagtgaagaaatctacccccaagaagaaggacaacctttaatggttatggaggagtgtaaggaggtaagtgtctcctccaagaggttagttaagaaggaaagtcattttgaaataaagacaaatattaaagaaacttcccctcttagacaacctccacatcttctccgttgtaaaaagacatttgttagcactgccacacctcttgggcttgaggttattcctcaagtaaaggagttgttggatgagggtttggttcgtaagagcttaaatccttgtgctttgttggtgcccaaaatagtcatgcacccaacgtcttcatga

SEQ ID NO: 21225 - DNA, 489 bp, Glycine max
  Peptide Sequence Number=SeqID_112910
atggtagaccgtttgaaggctgctgttgatgctcggacggatgaaaattttgtgatcggggcacgtactgatgcttttgccaataaagggcttgaaaaaacattggaaagggctgttgcctataaagaagccggagcagatttcatctttgcggaggctgttcctgatttaagctattatcaaaagtttgtagacgctacaggtattcctgtactggccaatattacagaattcggaatgattaaaatgtatactgctgatgaactgaaagatgcgggagtcggtttgattttatatcccctttctgctttccgggcggcaaataaggcagcactgaatgtttacgagcatatccggaaagatggaacccaggctcatgtaattgataccatgcagacccgggaagagctttacaaaagcattggataccatgattacgaacaaaaattagataacctatttaaacagaacaagaatgtcaatgaataa

SEQ ID NO: 21226 - DNA, 330 bp, Glycine max
  Peptide Sequence Number=SeqID_112911
atgaagaatttccacagaatcgcttacggaaaagttacggaagcacttcgactcgatttttcttcacgaaaacgtgtttttttgcccaaaatagccgaaatgcataccttaggggtcatgaatattttgaaacagcccccctcccctatttatagggaaaaagggaggtgcttgccgcccagaggcttcttgaagaagatttctaagcgcaccccaattactaagttcaccccctttttcgtactttacggaaaaaagcattacggaagccacgaaagcccatttttcaaaaacgtggaggagcttgccgcccagttgcttcctccttaa

SEQ ID NO: 21227 - DNA, 270 bp, Glycine max
  Peptide Sequence Number=SeqID_112912
atgcatgaaggaatgcatatgacacagatgcaatctaggaatgcgggggtccgaggaattgtctccttcttagatacaacgtctaggggtagcaaaaggggatcaagacagaacccatatgcgatgcatatgcaaaagacgcaatacgggaatgtacatagtatgacatattcactgaacataagcaaagggtatatgatagttatgcatggcagtgtgaaaaatggcacgcagcgtgtttgctcgtgcccctatttaagggacctataa

SEQ ID NO: 21228 - DNA, 485 bp, Glycine max
  Peptide Sequence Number=SeqID_112913
tttggtcattctgcaccctgtatcatccagaggcggcgggccgatgacaagcagagacaagtttggtcattctgcacccttgtatcatccagaggcggcgggcccgatgatacgcggagataccttacgaggcggcgggcccgatgatacgcggagataccttacggttattcgcacccttttgtcatccagaggcggcgggcccgatgacaagcagagaccaaagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaa

SEQ ID NO: 21229 - DNA, 180 bp, Glycine max
  Peptide Sequence Number=SeqID_112914
atgtgtgcttgtcacggagaagccccggggcgttccattgagcattgtagggctttgaagcgtaaggtgcgaggattttcaactttcaccagaagtgggtgcaagccattggtcagtttgctcaagcgacctatgctcctgagtttgggacttccaacaccgttggtgggggtgccgtaa

SEQ ID NO: 21230 - DNA, 72 bp, Glycine max
  Peptide Sequence Number=SeqID_112915
atgctcaaatttcacaaagatccaacggtgaatgagtccaagatcgtcatttttctgagacaggggtattag

SEQ ID NO: 21231 - DNA, 288 bp, Glycine max
  Peptide Sequence Number=SeqID_112916
atgggtgaagtagacgaggtgcaagagcggataaaggccgactttgaagccatgaaagagaaaatggccacaatgatggaggccatgatgagcatgaagaagataatgaaggtcaatgcggctgcagttgccgctactagtgtcgtcgctgaggtggacctgactcccccatttggcctcaaccaaataaatcatctcatctcggatatggtagggcagagaggcaaagaattaggaaatacgggtgttggatcgagtggcctcagaataattaagaaggggggttga

SEQ ID NO: 21232 - DNA, 459 bp, Glycine max
  Peptide Sequence Number=SeqID_112917
atgatgcgagaagagcggcgcaaggatttctgttgcacacccgctcttacatatggctggtctctcacctcttttgtcatgaaagtagacccgtctgtcccctgcaaggtcaccgagaaagaaaaggcaaattgggaacaactattggctagtatggtaggggcatccgttaattggagagctgtcggaagaaagtatcacgcccttcatcgcacagggtttagtgatcccaatgcaaggatatttcaaagggttcgaaaggcatggagcatggtgcaaagaaaggataatgagcttaggggaagcagcaatgagatcgtcggtggctatcacaagtggctgaaggctcggatgcaagagttagattggctcccaaagctaaaggtttcaagtgaggaagaggctgaaacccctaaggagagtgaagaggtgcaagccttgaatgccaaacttgaatag

SEQ ID NO: 21233 - DNA, 267 bp, Glycine max
  Peptide Sequence Number=SeqID_112918
atggtgaaagttggaacctcttacgtgccgatcaacgtctcattttcgccaaaagttggcccagggcttcccgggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 21234 - DNA, 228 bp, Glycine max
  Peptide Sequence Number=SeqID_112919
atgactcgaggcttaaaccttaagtttgaacaagtttacagaagtgagaagtggagggagaggtcctcacagactcttcggagtgtaggccttaggggtaaatacacctggtttgagtgctcctttaagtctatattgataccatatggttggaacattctcgcaaaacagagtgacctgactggtctccctatgattttacctagtgagagtgacttgacttgctag

SEQ ID NO: 21235 - DNA, 509 bp, Glycine max
  Peptide Sequence Number=SeqID_112920
atgaaggctgacatagaggccatgaaagaccaaataaccaccatgatggaggccatgatgagtatgagaaaaatgatgaaggtcaacgcggttacaatcgctaccacaagtaccgccactgatgtggacccgactcacccatctggtattaaccaagtaaatcatccagtcctggatatggtaggtcatggaggtgaagcattgggaagtacgggcggcccctattttgtacagatccagagcaagcatcctttcccaccatatggtttgcctcccaactacgcaccacccaatgttgcacacgcgcccgatgagaatgtcgacaactccgctctcatacccattgagagccaacaatcccaatctggtcatgcacatgcctctcaacccatgggggagacacatgaagtaccccgagaccacactctggccgacttcgagcctcacctcggatatgccactgaggggcaaacatttggtggcgtaccatgcaaacaccttggggggcc

SEQ ID NO: 21236 - DNA, 234 bp, Glycine max
  Peptide Sequence Number=SeqID_112921
gtcggctcagttttttcgtgcgagctcaaccgaagttgtgatgaggacatgaccaagagcaagggcaaggatccacttgaaggacttggaggacctatgacaagggctagagcaaggaaagccaaggaagctgatgagaatcatgaaacaagccaaatacagtctaaaggcccaagtggagaaggacgaaggcccaagtggagaaggacaaagcccccgagtggagaaggatga

SEQ ID NO: 21237 - DNA, 210 bp, Glycine max
  Peptide Sequence Number=SeqID_112922
atgtgctcgccttcagaggactacacgtcctcgccttcagagggcaacacgccctcgccttcagaggacttcacatcctcaccttccgaggactacacgtcctcgccttcagaggactacacgtccttgccttcaaaggactacacgtccttgccttcagagggcttcacgcctttacctttagagggctgcacgccctcgccttcatag

SEQ ID NO: 21238 - DNA, 216 bp, Glycine max
  Peptide Sequence Number=SeqID_112923
atgggtgccaagcacctcacaaggaccaaacaaaagttgcatgtcatcaagcaaaggtctccggacgaaattaggttctacggagtgtccgtcgcccccagcaaggtcattagacccctattaacagggctttcatcgacaagtattgtgcctctaggcaggcgtagggcgaggcatcacattagtgggcaacagatgcaccgccgccacctctag

SEQ ID NO: 21239 - DNA, 438 bp, Glycine max
  Peptide Sequence Number=SeqID_112924
atgtttatacgggataaccactcgggtatttccgcccgtcagcgtgactcaaaagtcagtatgacagatctggtgagcgcggaagatgacgtaaatctccgcgtgtcaacgggcttgtcggccgcgattgacgaagggcgcagaagacgacatagcaaaaagaatgtttatacggataaccactcgggtatttccgcccgtcagcatgactcaaaagtcagtatgacagatctgatagcaaaaaagaatgtttatacggataaccactcgggtatttccgcccgtcagcgtgactcaaaagtcagtatgacagatcttgtgagcgcggaagatgacgtaaatctccgtgtgtcaacgggtttgtcggccgcgattgatgaaggcgcagaagacgacgttagtctctgcgtgctatcaggcttttcgtcttacatatag

SEQ ID NO: 21240 - DNA, 1434 bp, Glycine max
  Peptide Sequence Number=SeqID_112925
atggagatcgttcgtcctcagaatcgcagaaactcgttttcctcttccaatgacgccgtttctgctcccaccattcccctctatcgctctgctcccccactcgaagtcaggctcgaggatttcgagtccttcgccatcgatcgcctccgagttctcaaggggatttctgatggtatgtcgcgtggaaaaaaatcggaagaaatggagaatttggacctgtggaaaatgaatatgagacatcaagacgcatctcaggttctgaacaaggatattatatcacattttgttctacgtctggtgtattgcagaacggaggacttgaggaaatggtttctttccacggaatctgcactctttcgctaccgttttcgccttctgaatgctgaagctcagagagcagtcatggaagaatttgaccttccttacaaggccgttagcaatgtggaatttgagagcataaaagagaaattgggacaagttgcacgttctatgggtcagccttcgcctactgcagatgctatcttctacaaggtaccatttgaagaagttccagagcttgttgctggacggaaggtgtttataaatcaaggatatgcatatgttgcaatgaatcagtcaactgtcaaaggcactaatccttacaaacagattcttagagtttcatctaattgttgcagaaaatggacatcttcagttagagagcaagagaaacataggttgactcctattgtggaagccctgtcctcaagttatctgggtcctgattattctcagtcaaaagaatatgctgatatatcattaaaggacattgatcaagttgccaagagctcatttcctttgtgcatgcgtcacctatttgataagctgaaagaggatcatcatttaaagcatggagggaggatgcaactaggcctctttctgaagggtgttggcataaatctggatgatgcacttgcgttttggaggtcagagttctctaaaaaggttggtttggagaagtttgagaaacaatatgcatacaacatacgccataattatggaaaggaagggaagagaactgactacactccctattcttgtcaaaagattatttcatcaactcctggagctggagatcatcatggttgcccttatcgaaatttcagtgaagagaatctaagagctgctctcagcagaatgggggtaaacagttgggcaatggaagatgtgatggacaaagtgaaaaatagacattatcagttggcttgcaccttgacatttgaagctcttcatggcatgacgtgtgatgcagggattaaccatccaaatcaatacttcagtgacagtcaaaagatattaaagccaaaggtggaccctcatgatacagtagataatatcactaaggtgatattattctttgctgatgctggctttgctgacctgaataccttgtaa

SEQ ID NO: 21241 - DNA, 1542 bp, Glycine max
  Peptide Sequence Number=SeqID_112926
atgatcgcagagctaagaaagcaactcgaaacagaagctgcagaagaagaagataacgtacaagcatcaatcaagctctcactgctattccccaaaatatttcaaaaaacaaaacaagaagaagaaaaaactgcaatgtatggaaaagtggttctctcgttcatcttcgtgctcttgctcgtcttctcttactcaattttcattggcaccctcgacattcgatcttatttcttccctcgcctaaagttacccgcggctgcacctgctccctgtgcacccgagcctcctcttcgggttttcatgtacgatctccctcgccgattcaacgtcggcatgattgaccgccggagcgcgtcggagacgcccgtcaccgttgaggactggccggcgtggccggtgaactgggggctgaagaagcagcacagcgtggagtactggatgatggggtcgctcctcaacgccggcgagggcagagaagcggtcagggtttcggatccggaactcgcccaagcgttcttcgtgccgttcttctcgtcgctcagcttcaacacgcacggccacaccatgaaggatcccgccacgcagattgatcgccaattgcagatgctgaaaatcataagaaatttgatgaatgctaatgttcacaccagtctagaaggctatggtagtgcctcttacttgatgaggcgtgagaaatacctccaaggggcttgtttctggtgtcaggttgatttaatggaattattaaagaaatctaaatactggcagaggtctggaggtagagaccatgtatttcccatgacgcaccccaatgcctttaggttcctacgaggtcagttgaatgaatcgattcaggttgttgtggattttggtcgctatcccaggggcatgtctaatttgaacaaagatgtggtgtccccatatgtgcatgttgtggactcttttacagatgatgagcctcaagatccatacgagtctcgctccacattgcttttcttccgagggagaacttacaggaaggatgaagggattgtccgtgttaaactagcaaagatattggctggttatgatgatgttcactatgagagaagtgttgctacagaagaaaacataaaagcgtcatctaaagggatgcgttcatcaaagttctgtttgcatccagcaggagacacaccatcatcttgtcggctttttgatgccattgtgagtcactgcgttccggtcattgtgagtgatcaaattgaactcccatttgaggatgatattgactactcccagttctcggttttcttctctttcaaagaggcattacagcctggctacatgattgatcaacttcgtaaatttccaaaggagaaatggactgaaatgtggaggcaactcaaaagcatctcccatcattatgaattcgagtatcctccaaaaagagaagatgctgttgatatgctgtggagacaggccaagcacaagcttccaggggtcaaactttctgttcatagaaaccggaggttaaaaatcccagattggtggcagaggagatga

SEQ ID NO: 21242 - DNA, 381 bp, Glycine max
  Peptide Sequence Number=SeqID_112927
tcccggagaaggagaaacaggtccaggggaagccattttgagccacaaggtgaaaccctaagggagcaaaaaggtggagagaatagggctgtagcgttccaggagaagccgaccaagagaacggcggaggcgcggcgcgattccggcgccgggacggcggcgcgtggactgcacgcgccggaggacgcgcgggacggtggcggcgcgtggctgctccgttgccgacgcgagttggccggctggctcgcgcttcccaaggcgagcctaaccctggcttcgccggagaaatggccgctggaaagtggcggcggcggcggaagacggcggcggcggcggcgggcgacgacggatgacacctgctctgatgccaacttgaaatga

SEQ ID NO: 21243 - DNA, 135 bp, Glycine max
  Peptide Sequence Number=SeqID_112928
atgagaagtaagttagagggagacgaagaagaagaagaagaagaagaagaagaagaagaagaagaagaagaagaagaagaagaagaagaagaagaagaagaagaagatatggagagacaattttattttggttaa

SEQ ID NO: 21244 - DNA, 1083 bp, Glycine max
  Peptide Sequence Number=SeqID_112929
atggaaactgaaactgaaaatgctaatgatgctgatataaaggccattaatgattggcttcctgtcactgcctcccgaaatgccaaatggtggtactctgccttccacaacatcactgccatggttggtgctggtgtcctcacccttccttatgccatgtctatgatgggctggggtccggggacagttatactgctcttgtcatggatgatcacgttgtttaccctatggcaaatggttgagatgcacgaaatggtacctggtgtgagattcgataggtatcatgaattggggcagcatgcctttggagagaagttgggtctctacattgtgattcctcaacaactacttgttcaggttggcacatgcattgtatatatggtcacaggaggaacatcgctaaagaagtttcatgacacggtttgcccctcgtgtcaaaacattaggacctcctattggattgctatctttggttttgtaaacttcgtcctctctttgtgccccaacttcaactctatttctgctgtctcttttgccgcagcagtcatgtctatcgcttactcaaccattgcttgggtggcttccattggcaagggaaaactaccagatgtggactatggctacaaagcccacagcactgccgatggtgtattcaacttcatgttggccttgggagaggtggcattctcctatgcaggtcacaatgtggttttggaaatccaagcaacaataccttctactcctgagaaaccttccaagaaagccatgtggaaaggagttatatttgcctatttaggagttgccttttgctatctccctgtggccttcattggatattatatatttggcaactctgtccaggataatatcctcatcacactagaaaaaccaacttggctcattgctgcagccaacatgtttgttattgtccatgttattggaggctatcaggtcgccgacgtttgggctgatgattgtggaggacaggacggtgcaattagtttggattatggtttggtgtttggaggtgagataaatgttgaaggagaagaaggtagaggaaaggtggattcagagtactag

SEQ ID NO: 21245 - DNA, 1011 bp, Glycine max
  Peptide Sequence Number=SeqID_112930
atgagtttggactctgtgtccgtggctctaacactgtggcttgttctattcaaagaggatcagagtgagggaaagcaaaaggtttccgcaattccgtattttatggttttagaagtttacccaactggaacactggggacacgtggacatggacattcgacagatgaagaggagagaaaaatgatatggaacaactgttactccagaaagaggtgtaatcttccatggagaggccttcacaacacaaacatttacacaacaatgaagaaatatgagcatcttcttcagaaattcttcaaaaaggcatttgagtctgggaggggcttattacctcacaacagccagggaattagccagaatggcagggacttgaaaggcaccaatcttgcatcacttctcagaatcaatagtggccttttacaattttggcagcttggaatggttgtctgtccgaatcaatttcctcttcaatatggtcttgtattttgttcttgtgccatcttcgttactttgccaaggtctaccattcaagattgcaggcctgaaccagagtggccaaaggagggaaaagttgaacttcataaccttcatatacagaatgaccctgctgctcctatggtcctcaaagatgttacttgtatcttcccaggacaaaagaaaattggtatagtagacaggacagggaatggaaaatctacgctggtgcaagccctctttcaagtggtggacccttatgaacgatgtatacttattgatggtgttgatatttccaagattggtctgcaagttttgagatgtaagcttggtataaccttgtttctaggtactgtaaggactaacttggatcctctggaacaccatgcagatcaagaactttgggaggttctcagcaagtgtcatcttactgaattagttacgcaagatcaaattgaagaagaaattgattcggacagacaaccattccatggtgccaatattgtgaaaggctacccgagaatgatcgtcaattag

SEQ ID NO: 21246 - DNA, 2457 bp, Glycine max
  Peptide Sequence Number=SeqID_112931
atggccgataacgatcactcccactcccaccctcaccaccaccaccaccaccaccgtcctcatcgcctctcagtgccgccgcgcagcaccacattcggcggcactccgggaacccagcccgccttctggtactcctcaagcacaaccccaaccccaaccccctccaaaacccgccgttcattgtccttcccgaaatcgaaatcgaaatcgagatcctcagtcttcctcctcctcttcttctccctccgctccctctactccctccttcccttcctccgctcctctccttccttctccctcttccccttctccttcctcgtctccctcctctccttctccctcaccctctccttctccctcttctcttcttcctccacctcctccaaagacccctttctccaccacaaacccaaacaccctcttctctcaccttccctcacaccctcccagcagagaatcttggtcaccaaatcaatcctccttgccctcgtcttcctcctccgcttccaggccctccgctactgcggcaccgcctccatgatcctcgccgagttaatgggctccatcgctgcccggcccagaaacccttacaggcacaacctccgcggcttcctctccctctccctcggcctcctcctgctctccttcggctgggaccggatcgaatgcttcccgttctctcccgcttgcctcacccgccggatttggcccttgatcctccctttcgcctccggctttctcgcccactaccggctcgtggactccgggactactctcaaacagctcggccgcaaacgggttcggttaattactctccttttcactactgttattctatttgttcccgcagttgttagtttcttcgtgtttgaggcagaagaagatagtgttgcctttgggaatttggcgtggccattggtgaatactgttgttttcggtgtgcttttgagtgagagttatagtggtgatgataatgatgatgatgatagtttcgcgagttcgagggagtttctggttacttttgtttgcactttggtgttggagcttttttatttccctgaactttccctctggggtttgttgctttgtggtttgttgctatatgttggtgttagagacttggatccttttcattcttccaatgaaggggagttctcgggtgacatgattatgaagcctatcagacatgttttgagcgagaggaagtcgcggaagattgcgctttttcttctaatcaatgctgggtatatggttgtggagtttgctgctgggttcatgagcaatagtcttggcctgatatcggatgcgtgccacatgttgtttgattgtgctgctttggccattgggttgtatgcatcgtatatatctcgtttgccggcaaataatcactataactatggtagaggaagatttgaggttttatcagggtatactaatgctgtgtttctggttcttgtgggagcactcatagtggtggagtcctttgagaggatattggatcctcaggagatatcaactaatagcttgttggttgtctccataggagggcttgtggtcaatgtcattggcttgatattctttcatgaggagcatcatcatgctcatggccatgtattatctggatcatcatgctcccattcgcacacacacacggagtcgcatagtcaccacacccaccatcatcatgatcatgatcatgatcatgatcatctgcatagccatggtcacgaaacaacaatccatggaagcaatcaagaatatatatcagtttcaagtgattgccgagacgattcatgccctggtgatcatggccatcatcataatcataaccactgtagtcatgagaggaagcatcatggtgagtgtcatgatcatgaagacaaacacagcattccgagctttaagcatcatgatgctgccgcccactgccatgaccatggtgaacatcatgatcaaactgggcactcttgtcatgaagatgctccacttgttcgtaaagagcatgaccatcgccatattgatcacaatatggaagggatatttttgcatgttcttgctgacaccatggggagtgttggtgttgttatatctaccctgttgattaagtacaagggatggcttattgctgatcctgcctgctcaatttttatttctattttaattgtatcttctgtgatacctttgctaaaaaattcagcagaagttttgctccaaagagtgccaagggcgcatgagcatgagctgaaggatgccttaattaatgtttcgaagataaggggtgtttatggcattcaaaagtttcattcctggaacttcacaaacacagatgtagttggtacgatgcatcttcacgtgtcaacagatacagacaagacatccgccaagtcgcaggttttgcatctgttacgtaatgctggaatcaaggatgtaaccttgcaggtggaatgtgttggataa

SEQ ID NO: 21247 - DNA, 111 bp, Glycine max
  Peptide Sequence Number=SeqID_112932
atgaaaagcattggcacaccttgctatggaaatagggaggaagccaagggagaatttacaagtgttagtgatgagattgagggtagagtcggtagatggacaactatttga

SEQ ID NO: 21248 - DNA, 498 bp, Glycine max
  Peptide Sequence Number=SeqID_112933
atgttttctctcattgagcaaccacagccatcaaggactcaagctgaggagaacaatgagcactctcagaaaatcacccttgggttggtgttggatggtgactttccattgctgaaaccaccttcttcacatgatggattaatagtccctgatatcaattcaaatggtcgttccttcagcgagaggcataaatctgtgaaggaattctaccgacaacaacacatagggcaaacttatgaatttgctaagaagatgacggaggagtatgggaaattgaatagagtggaaatgagtatacgggaatgttgtgagatccttgataaaattgtggatgccactgaagctgctagaaaggactaccctaatgaagattggttacatttgactgctctcattcatgatcttggaaaggttcttctccttccaagctttggtggacttcctcaatggactgttgttggtgagagttgtccactaattaatcctattcgtgattga

SEQ ID NO: 21249 - DNA, 183 bp, Glycine max
  Peptide Sequence Number=SeqID_112934
atgacggacaccaacgagaagcacacacgaattgatgaagatgaactacggattgatgaagatcaaacatggattgaagagaaaatgagagaatttgagaggagaaaaccagcagaggcggttgttgctcttgagcttgttgagctccaagtatctaactttgagtcatggcatgttgcctga

SEQ ID NO: 21250 - DNA, 123 bp, Glycine max
  Peptide Sequence Number=SeqID_112935
atgttagtgctgaacaacataagaaactaccacgtgagaagaataagaatagagggtaaaagttggcgtgagagatgtgggaactttgtcatgaacaaaggtgcggttagagacataatgtaa

SEQ ID NO: 21251 - DNA, 1965 bp, Glycine max
  Peptide Sequence Number=SeqID_112936
atggcactttccacggtgagacataaccactttctggccacccacgaacccggtttgaaccggttcaacatggttcgagcccaacaccatcatgtgcttcttgatcaccccaaaaccaagacccccaatagagctacacgtttagctgaatccctttcacatgtccttcaccttcacattgaccccacttcacacaaaaacttggacttgctaagtgttcatgaagagaagcactcaactccaaccatgtctccaagagagaacatatcacaaaaatggcgtgaaattcaagggtatcacaattgggaggacattttagaccctcttcagccgtggttacgtagagaaattgtcaagtatggagaatttgcacaagcaacctacgatgcctttgactatgattctttctcggaatattgtggaagttgtcgttacaaccaaaacaagttatttgagaaattgggtctcactagaaacagttacaccgtgactaggtacatatatgccatgtcacacatagagctaccacgttggctcgagaggtcacatgttgctgacacgtggagcaaagactctaattggatcggttttgtggcggttagtgacgatgacgagacacgtaggattgggaggagggacattgtggtggcgtggcgtggcaccgtggcaccgtgtgagtggtacgaggattttcaaaggaagttggacccaattgggcatggggatgccaaagttgaacatggatttcttagcatttataaatccaagagtgagactacaaggtacaacaaatcaagtgcctcagatcaagtcatgaaggaagtgacaaaattggtgaatttttataagggaaaaaaaggtgaggaagttagccttacaatcacagggcatagcctaggaggtgctttggcattgattaatgcttacgaggtagcaactacttttcttgaccttccagtaagtgtgatttcttttggggcaccaagagttggaaacattgccttcaaagatgaattgcatcaaatgggggtgaaattgttgcgtgtggtggtgaaacaagattgggtaccaaaaatgcctgggcttttgttcaatgagaagctaaaaatgtttgatgagattacggggttggaatgggtttacacacacgttggggctgaattggcgcttgatgttcattcatctccttatcttaaaggtggaatgaacttgtcagggtttcatagcttggagacttaccttcatcttattgatgggtacttgagtcatgagacaccgtttaggtcagaagctaggagggatattgcactagttaacaagtcatgtgatatgttagttgatgagcttagaatcccacattgttggtaccaattggccaacaaaggattggtttgtaatgctcatggaagatgggttaagcccaaaagagacaatgatgatattccttcacatgctagcgaagtattcaatgctggtcttggagttgtaattttacttatgatttggtgcgagaagaaggctgattgtggtgaacacattgatcaaatcagaggcttgccagagaatgaagcacaagatttgacttttatccgactctttgccgatggtcctgggaataacattgagagagattggcttaaagctataaaatatctggaattggacgctgtgaatttcaatgaagcaagagaacatttgtttattatttctttacttcaaagttcttctaacctagagaaacttgttataaagattcaagatgtgaacatcacagttcaaacttcctataagcctgcacttggtttgatacggtttgtgcttgcaagatcgccggcattgaagattcttactttcacggttgatcctggtctaaatcaatcagatgcatctgtattgttaagtgttccaatctctttaaacaataggtttttcagaacttgcgacactatggaaaaaattaaataa

SEQ ID NO: 21252 - DNA, 132 bp, Glycine max
  Peptide Sequence Number=SeqID_112937
gtggtggtgatgacaacaacggtcatggcggcaacgacgatggcagttgatgacaatagttgtgattgcaatagtgatcatggtgatgataacgacgatgaaggttatgacaacaaaggtggtgttgattga

SEQ ID NO: 21253 - DNA, 618 bp, Glycine max
  Peptide Sequence Number=SeqID_112938
atggaatcggcattgatatttctgggaacgggaagttcggggtcggttccttgcatgaggtgtctcattgacccttcggatcctccatgtcctgtatgtgcttactctctctccttcccacctcacctcaatcctaactacaggtgcaatagctctctgttaatcgattattactgtcgaagcgatgccactcacaaatatatactgattgatgctggtaagaccttcagggagactgcacttagattcaatgtgaatgtaactttctatgtgttcagtcaggtgccttattggcttattttgttgcagattgttttgactcatgaacatgctgatgctgtccttggattggatgatgtgcttgctgtgcagccgtttagtcccacaaatgatattgatcccatccccgtttacttaactcagcattcaatggatagcgtcgaaaagaggttcccttatttggttcagaaaaaacacaaagaaggtcaagaaatgagaagggtggctctgctttgctggaacataattgctgatgattgtaatcggccattttttgcatcaggcttaaaattgattcctttgccagttaatcactgcaaaccttgtcattggtggtaa

SEQ ID NO: 21254 - DNA, 4722 bp, Glycine max
  Peptide Sequence Number=SeqID_112939
atggcaaattctcgcattgctaggttcttcatggaagtagcaccaccacagtatgttactgtgatgaggcacagaacatcgaagatgttggacactattactgaagatgagagggagattagtaccaatgattctgtcatgttacctcctaaaaccaaatcaacagtggcagttgcagcttcttcagcttcatctgctgcttctgttaccaatgttaaggggaggcattttcttaaggaaaacaaaactctcccagctaaagcaaagatgcaaaatcgtaagcgaaaatacatattcgacgcccaacctcgagaaactcctaaacggcaccgtttggaacgtcacagtccctggaacaaccttaatcttatactctgcatccaagacaaacaccatgatctctccagcaaggtcaatcaagccttcaattttgtgcagtcctataatggtgaggatcgtaaaaccatagaactgccaagactactgtgttatcttaatgattggatattgacattgctattccctccaaatgggaagaaaaactggggcgatggacagacaccgccgcagtttgagggaattgatgcatatatggatcttcgttgttgggagatattcaagttctgtttgcaggagtctttgaagttccacgtctctttgagtattccccggaacctcctacaaacggttcagttcgttgccagaaatgttctgtcactgctagaggattcctctatcagttcaggagaactttttatatctgatgaaaggtataaactgtgtgataccactcttgactgtgtttcattggttttctcgtctcatggtgggttgtcaaataaaaacttggacttgtgggttgaaacagccagggtgttgcttgaacttgtgcttaaaatgtatagcaataaacttgatggcagcgacgtgggtgcttatgcactacgctttctgtggtcggtgcttcagccattctctaagttgagggtccatctagctaagaaaggatttcataactttgtggataaacttcttgagccactgttgcatttatcaggagagttgcatcttcaggttaatgaaagtaatcccatttgggcgtcgagattaatggaggcggtggaagaagttctttctcatggactgtttcatcacatgcatattcctgagtttttaagcttgcatgtttcagaaaacgatgatgcttcatgtgatgataagtcaaatgactcaaaggcaactattaagagttatactagacatttatttgatgtactgaacaaaattatagctaagaagaatgatatggcaatgggtagcttaggcttgttatttcacttgtatgttaattcagcaagaaaattcaaactggatgaagggcaccagacagtggagaatatagatggttcaaggcaaccagtgccaggaaaacactgtagctcaaataatatttctgcagaccttcaaaactcacttttcaatttttttgtactgattatggaaccccttttgctgaagattaatgcctatattcaagttgaagtagatgctaatcccctgttgttggattttcatgctttactcaagtctattggtaaattacttgctagttttatgcaagacaaagtttatgtgagaaccgaggacacatctggaggagcttgtcttaatttcttgaagaaaatatttaatacactgatgactagtttcactagtgtacttcacttctccaactatgatacaaccaacaggacggagatatctagtactttgcctgctaacgagattctagttgctatgggatatcttttgcaaattgaatatgaggttattggagaagacttggtaaatctgtggcttctcatgttgtcatgctctgccatcaattgcaatttggtgaatgttcctgaccaatgcccattaccttccactatacctgccctgggatgccaaacaatttatctctacagtcaacttcgccagaggttttgcatgggttctgccttgttggtggttttattacttcatgtcctagtcacttggtgtaattctaggtatgattgtttggcaaaggagaggggaatgatattttgggtggaaattgctattttagcattgtgcaaagcaataaggcttgttatatctcacgagggtaatactgagggttcttccaggttcttggtatttctgtcgaatgaatttcattctgaagcagttgaaaggctgttatcttcagagaagttcatcaatgccatttataaagctgttgaatctattcccgaagggcaagtatgtggttgtattagacaaataacagaagatatttcagaatctctcaggtggatgaaagatttctgtccattggttgatggcaagaaattgcaaatttttaatctgcaaggggaactgctgggtagagggctgtctagactgtattgtttagttcttggttcggttattatcaccaacagcaaccgcaatcttcttggggttgctgtaaatgaacttatggcattagtgcgtccctacttgagtattctagttgggcaacaaccagatacaatctgcaagttcttttcttctgtcataggagaaactgttgatcaggtggttagaaagggaaaagttttaaagaaatttggtaggtccagtcaatgggtccttgtgttcttctttcagttgtttgtgtcctgtcaaagcttatataggcaagcaagccttaggcctcctgatatgccaaagatgtctgcagaggtggaggattacacaacatattctgcctctgagttgatggagaggattgatgagatagactttggttatttttcttggattgttcaaccctcttcttccctccttgttgttatgcaatttatttctgacatatatcttaaacttggctcagatgatttttcccctttgatctatatatttcagtctatggctcttcgaaggcttgtttacttgaataagcagattaaattgttcaagagtctggcctcgatgttttgccatgctttagagaaatctgtgctcccattatttagtaacattccatgtactgatgtcaatcttcagtcattgcctaattggccagagtttttaagttcccttgacaactcagcaatgcttgttgataaaaataaagaaattctggtcgattcttctgcagtggaaagttcaaccactcattcatgtgacaaacttcctgcagatatcagcagaaaagacaagactttccctgtcactgacaaaatttttagagattgccaccatttgcttgatctcttatgtcggatgcaagataaaaatgcgagatcattttcacatcttctgacttgtattttcaaccttgaacgtaaagaagctgagatgccttgtgaagagatctctaatcataagattagccatgaggagaatcatttgcttccatgttctcaggactcccccaagcttgaggcattgaaatgtttaacctttatggctgagaatttgagagagcagatacagagcttgcttgtttctgttcacaataccccttgcaatgtcaatgtgggatttggtcttacttatgaaagcattaatagattgtcctcttcagcttgttgctttagtagacttttgtggggcctactcacatcttccacgggccaaacagatgctaaagatagtgatgaaaaagaaaaagtgttgatgtggaaaagtgagcatgcctctgaactggacagttgtatatcttctcttgtggaacttaccaatgtttttgtaaacaaattgcttatcgagagtaatcaactttccaaaagttcacacaatacacaacattttgaagatccagccgtgaagttatccttgtcaagtaccaattatttgtcatctaaaagtttagtttctaaggctaatgccttagttggtacacaaaatgaatctacagctgcagctagttgctttacttcatcagctgttgataatgtctccaaaagtgtcagtaatcatgggagaatgttgaatccaaatggtgaaaactctgttgccagggttttggccagggtggaatccactgagctacagggtttgaataagcctttgttgcaaagcttggtaaaagagatggttgtggtcccacaatattctgctttgcttttgttagatggtgcttgcaactatttgagagaattagcgggtcggaaaggcttgaagatgattaaaagacactgtcagagttttgtagcttctgttttcaacattattgtacatttacagagtctgcctattttttatgataacttggcatctggaaaagttgccagtacccctgatcctgggtcagccattctcttgggtgttgaagtactggttacagtttcaagaaaacatactctattcccaatggatgtgtggcatgtgggtcacttgttacatatccctgcagcactctttcagaacttctatcagcttagagttactaaagcttctggtccatcagaaacattgatgatttcagatgagcatatttgtgatcaagatatggtgatcccaagagaagtggcatcagaagaagaagtggatgaatctctaagaccgggtgtcgatgctttaatagatgcttgctcacgtgatgatattcaatatcttcatactgtatttgggggaccttgcagaaatatcctgttaagtcttgtgggtgatcgcaaacttaccgaatttaaaggaaaagtttga

SEQ ID NO: 21255 - DNA, 228 bp, Glycine max
  Peptide Sequence Number=SeqID_112940
atgcgcggttggacatcatctgcagatggtgagttcgagattgttctcgcgagggggaatgattggtgggggttggggctgcggggagggcggagaggggtggtcggtttcggagagagcttcggcggtggagaaggcggagagagggtttggatggagagtgggtgtccatcggagaagcttggaattggaaagcagagccatgggattggaggggttgtggattga

SEQ ID NO: 21256 - DNA, 1092 bp, Glycine max
  Peptide Sequence Number=SeqID_112941
atggtgcttccgcaagatttgataactgaaatcctgttaagattgccggtgaagtctctagttcgtttcaagagcgtgtgcaagtcatggctttttctgatatctgatccccgctttgcaaaatcacattttgaactagctgcagcacttgcagatagaattttgttcattgcatcttctgctcctgaactccggtccatagacttcaacgcatcacttcatgatgactctgcctctgttgcagtaacggtggaccttcctgcccccaaaccctattttcactttgttgaaataataggttcctgcagaggctttatacttttgcactgtttatcccatctttgtgtgtggaatccaaccactggtgtccacaaagttgtacctttgtcacctatttttttcaataaggatgcggtgttttttacgcttctttgtggttttggatatgacccatcaacggatgattacttggtggttcatgcatgctacaacccaaaacatcaagcaaactgcgccgagattttctcactcagagctaatgcgtggaaaggaattgagggcatccattttccttatacccattttcgttataccaacagatataaccaatttgggtcgttcttgaatggtgctattcattggttggcttttcgcattaatgcatcaattaatgttattgttgcctttgatttggtggaaagaagtttttcagagatgcatctgccagttgaatttgattatggcaaacttaatttttgtcatttgggggtacttggagaaccgcctagtctatatgctgttgtggggtacaaccattcaatagaaatgtgggcaatgaaagaatacaaagtgcagtcgtcttggactaagagtattgttatttctgttgatggctttgctattcggtccttctttccggtatgctctacaaaaagtggtgatattgttggaacaaatgtcatacctggattgatgaaatgtaatgacaagggagaactgcaagaacttcgaacctactgtgatagtccatatccatccgaggtggctgtgtatacagagtctctattttcactcccttgtgatagtaagtga

SEQ ID NO: 21257 - DNA, 528 bp, Glycine max
  Peptide Sequence Number=SeqID_112942
atggcaattgcccttactgtggacactccagttcttggtcgtagggaggctgacatcaaaaacagatttacattgccgccaaacatggtatttaagaattttgaaagattggatcttggaaagctggacaagactcgtgactctgttgttaccacttatgttgctggactatttgatcggtcactcaactggaaggatatcaaatggctccttacaataacttcatcgccaattttattaaagggtgtacttactgttgaagataccaattccatatactatgctaataatgtagcaagggtagccatacaagctggagctgctgagatcattgtttccaatcaaggagctcggcaacttgactatgcccctgctactattatggctttggaagagattggtagacctgtgatgttttcattggctgctgatggcgaggcgggtgtaagaaaagtacttcaaatgcttgttgatgagttagaagtaactatggcactaagtggttgtcattcactcaaggagatataa

SEQ ID NO: 21258 - DNA, 2406 bp, Glycine max
  Peptide Sequence Number=SeqID_112943
atgaggccaccaagtccttccatccactttctgctccaaattcttctagtctgtctattgcacagacccagctttgcagtgaaaaagtcatatgtggtgtacttgggagcccactcacacggcccagaattatcctcagttgacttcaatcaagtgacacagtcccaccatgactttctgggatctttcttaggaagttctaatacagccaaagactccatcttttactcgtacacaaggcacatcaatggttttgctgcaactttggacgaagaagtagctgttgagatagctaagcaccccaaagtgttgtcagtgttcgagaaccgtgggagaaagctacacaccactcgatcatgggatttcatggagctagagcataatggggtgatccaatccagctcaatctggaagaaagctagatttggtgagggtgtcatcataggaaacctggatacaggtggggctaagaatggtgccaaggtggggatagtccaaggaagtgatgataaagtcaccaataagaaaattgaaatagctttagtgagcaaggtttgggaccaattccatcaaagtggagaggaatctgtgataacggaattgatcatacttttcactgcaacagaaacgttaagtggagatgttgaatgcaggaagctaataggggcaaggtacttcaacaagggctacgcctcagtggcgggcccactgaactcctcctttgactcgccacgtgacaacgagggccacgggacccacaccctatccacagctggcgggaacatggtcgcacgtgtcagcgtcttcggccagggccagggaacagccaagggtggctcaccaatggcacgtgtggcagcctacaaggtctgctggccccccgtcggaggcgaggagtgcttcgacgctgatatcttggcggccttcgacctcgccatccacgacggcgtcgatgtcctctccgtctcgctcggtggctcttcctccacgtttttcaaggatagtgttgccatcggatccttccatgcggccaagcgtggcgttgtggtggtttgctctgctggcaacagtgggcccgcggaagccactgcggaaaatctcgcaccctggcatgttacggttgctgccagcaccatggatcgacagttccccacttacgttgtccttggtaacgatattaccttcaagggggaaagcttatcagctacaaaattggcacacaagttctatccaattattaaagccacagatgctaaattggcgagtgcaagagctgaagacgcggtgctgtgccagaatgggaccctggatcccaacaaggcgaagggaaagatcgtggtgtgtctccgaggaataaatgcaagagtggacaagggagagcaagcttttctagctggtgctgtgggaatggtccttgctaatgacaagactactgggaatgaaattatagcggatcctcatgtccttcctgcttctcatatcaattttactgatggtagtgctgtctttaattacatcaactcaaccaagttcccagtggcatatattacacatccaaagactcaattggatactaagccagccccatttatggcagcattttcatcaaaaggaccaaatactatggtgccagagatcctaaagcctgatatcactgcaccaggcgtgtcagttatagcagcctatactgaggcccaaggaccaaccaatcaagtgttcgacaagcgcaggattccgtttaactcagtctcaggcacatcaatgtcatgccctcatgtttcaggcattgtgggactgttgagagccttatatcctacgtggagtaccgctgcaattaaatcagcaatcatgaccacagctacaacactagacaatgaggtggagccactactgaatgctactgatggcaaggcgacaccattcagttacggggcagggcatgttcaaccaaacagagcaatggatcccgggctagtttatgacataacaattgatgattacctcaacttcttatgtgctttaggatacaacgagacacagatctcagtgttcacagaaggtccatataaatgccgcaagaaatttagtctcctcaacctgaactatccctcaatcacagtcccaaaactctctgggtcagtgacagttacaaggacattgaaaaatgttggttctccagggacttacattgctcatgttcaaaacccgtatggaatcaccgtttctgtgaagccaagcatcttgaagttcaaaaatgttggtgaagagaagagctttaaattaaccttcaaggccatgcaaggaaaggccacaaataactacgcgtttggaaaactgatatggtcagatggcaagcattacgtcacgagtccaatagttgtgaaggccctcttaactagaaattga

SEQ ID NO: 21259 - DNA, 423 bp, Glycine max
  Peptide Sequence Number=SeqID_112944
atggtgccctgcaacactacaagagtattgtcaggaagaatgaggcctacaatgatgcttagggctctaaccaagcagtttcttggaattgtaggcgatacagcaaacactgttgctaagaagccacccccacctcctcctctggtgtcacgcaaaccggcgttcattgatgcattcttgtataagatgaagaagaatccaaatcttttgttgaacaagaccatttggtcacggagatcgactatcttgccagaatttgttgatagcactgtcaagatttacaatgggaaaaccactattcgttgtaggatcactgagggaaaagtgggtcataagtttggagagtttgctctcaccaggaaacgcaagaccagagaacaagccaattccaaaaatgttaaacaacttaagaaaaagaagtga

SEQ ID NO: 21260 - DNA, 1308 bp, Glycine max
  Peptide Sequence Number=SeqID_112945
atggcggcagaaaagggtgttgagatggtggcattggagtgtttgggaaaagggttcgatttggccagcgattttcggttgaggttcgcaaagggaattcgtgaagagaggttggtggtgcttgatgaacagaacaagagggatattttgattcctggaactggaggagttaccattaaaggggtttctgagaatattcgttgtgataaaggggatagaatacgcttcaagtctgatgtacttgaattcaatcagatgtctgagttgcttaatcagaaatcagcagtgcaagggaaagttccttctggctattttaatgcgctctttgatttgagtggggattggtttcgtgatgctgctgacaccaagtaccttgcttttgatgggtatttcatttcactctactatttgcacctcactgcttctccactcatactgcaagaggaggtaaagaagtctgttccggctcggtgggatccggcttcgttgtctaggttcatccagacatatggtacacacataatagtgggtatggctgtaggaggtcaagatttaatctgtgtcaaacaaaaacattcttcaaagattcctcctggtgatctcagaagacatttggaggatcttggagattttttattctcagatgtgagaagcccttctttactacagaggaagacagcggatggcaaacaaaaggtccctgaggtctttaaccgtgtgatgcaatcaaacacgatgcagttcactagtatttcagaaacatcaagcaaggatggcctcactattatttgctcaaaaagaggaggagatatgttcaagcacagccactcaaattggcttcagacagtgccgtctaaccctgaagcaatcctcttcaagtttgttcctatttcctcacttctgacaggaattcctggaagtggatatcttagtcatgcaatcaatctgtatctacgcttttccaagccatcactacttgaacagccactgtttaatttctttactgttgaggtgcacaacactccattgattcacttactctctgcagataagccttctcctggagatttacaatactttttggagtttcaaattccaaggcaatgggcacctatgttttgcgagctgcctctcaggcatcagcgtagaaagactgcttccccttccctgcaatttagtttcatgggtccaaagcttcatataatctctacacagtttgctacacttgagttttcttgtacaccttcccaagattcaggggtggaacaaggtgtgggatgttttcagactgaaagagactggttgtga

SEQ ID NO: 21261 - DNA, 591 bp, Glycine max
  Peptide Sequence Number=SeqID_112946
aatggtgaaaccgtcttcaaactccagacaagattcacccacatagtaaatcacttacttggtcttggaaatatgtttgaagatggtgagctaaacatcaagatcctcaactgtctcacaagaacctgggaaccaaaaaatatagcagtcaaggaatccaaggacttggcatcaatgtcaatggaagctctctttgaaaaactgcttttgtgtgaacatgagttgattcaacaatctcatgcaaaagatatagaaatgaaaaggaaaaatattgcactcaaagctagttcctcaaagaagactctatcgaattgtcctgtctacctcaaaaagcattatgctaaaatgaaagggaagaaggatggaaaaccgaaaaaggcctacatagcttgggaagaaaatgagtcatcatcctttgactcttctagtggagaagaaattgcaaatgtgtgcttaatggctgattcaaccgatgactcctcaaccgttgaagaaattggggtaaattctgaatttgaggaagttttggaaacctttaatgaaatgcatgaggatgcacaaaagcttgctactttgaacaataagctttga

SEQ ID NO: 21262 - DNA, 318 bp, Glycine max
  Peptide Sequence Number=SeqID_112947
atgggtaaagcagaggaggtgcaagagaaggtgaaggctgacatggaggccatgaaagagaaaatggccacaatgatggaggccatgatgagcatgaagaagataatggaagtcaatgcggttacaattgccgctaccagcactgttgctaaggtgaacccgacgtccccattcgacatcaaccaaatgaatcatccaacctcagctatggtaggcaagatttgggaagcacgggcggcccccattatgcgcaaagtcaaaacaggcaggccttcccaccatatggcttgcctcccaactatacaccacccaatgtag

SEQ ID NO: 21263 - DNA, 2046 bp, Glycine max
  Peptide Sequence Number=SeqID_112948
atgaaagcattcactgcctcttcggatatagtgttagcttcctcgcgccgccagaggatcaatgaacaaggcgatgttcttcctgatatcatggccacagcatatccttttcgtggagacgttatcattgaagggcgagatttaatcgcgttccttagtgattatatcatcaattggattggtgaaccctcatgtgtgctttgccgtcgccaggacttagtagatctgggagatgaattattctttctgaatggaaaacgcatgcgttatctgggggatgtggcgatttatgtcaatttactcagtaaaggaaattttgcttttctcagtgaaccactttcgcaattccgtatctcagaacagcaagtcagccagatggccgcttcggatcaggaagctgtggctacgacttaccaacaatttccattgatgatcgagaaattgggttggtacaaaggcgatcacatcaccaaccagacagtgcgtgcatctgctcttactcatccaggaaattatattgaatgtaatttgctcgcggcgctgagtagtgctttgcatctttcaggtggcagtcgtgctaacaagaaccttggtgactggttaaaaagtcgggaaataacgaaagttcagtctgcttatatagaaaatcacctgtcttcaatttcaattaataaagttgttgtatatgtgcttgccagagaagcagataatgaaaatattaatgtcacactagatagcctggagaaaaatgccacaccaggattgatagttcatccagtgctgatcaatgcaaatttaactgattttacctcaattgagaatctgaagaatagcgatctgaatgagtttgagcttattaatcaacatttgtcagaagctacagttgactggattctcattcttaaagcaggctctattttgactagcagtggtttattgcaaatgtcgttcgccctgcctgatgcgaaaggatgtgctgcagtttatgctgatgagctttatcatcaatctggtgaggtgacaggctcatcatttcggcctgacttcaatcttgatttgttactaagccatcctgctgaaatggcaagacactggctttataatcgaaatgtgctgttgaatgtgggcggatttgacccagcctaccataaagcatcagagttcgaacttattgttcgtctggtcgagcaatatggtatcaatagtattggtcatctgccagaacctctggttatttctgaaagttttttattaactgacgaaccagagtatcgggatattcttcagaagcatttgcacaggcgtggatacacaaatggctgggtgaaaaacacatggcctggtttatatagtcttcgctacgaacacgcaaatcagccgctggtttcaattatcattcctactaaagaccaattgccagtactcatcacgtgtgtcacttctcttttagaaaagacgcattataaaaactacgaaatcattgtcgtagataataacagtgaatccactgaagcgcagcagtggctggccggattagctgaaattgatccgaaacgcataagagtacttagttatccccaccccttcaactactcagccataaataattttgcagctcgtgaagcccgtggtgagtatttggttttactcaataatgatacagcaataatcagtgaaaactggttagacgaactgttgaatcacgcacaacggcctgaggttgggatcgttggggccaaattactttatcctgatggtcgtgtacagcatgctggtgtaattctcggtttacgtggtccagctgagcatccttttattggcgaagctgcagacgcacctggttatatgcgccgcctgttggttgaccaaaactacgccgcagttacggctgcgtgtctgatgattcgtgcagaaatttacagagaagtaggtggactcaacgaagaagactttaaggtttcatacaacgatgttgatctatgtttaaaagtacgtgaatctggatatttaactgtatggacacctccacgctgtggtaatgcatga

SEQ ID NO: 21264 - DNA, 291 bp, Glycine max
  Peptide Sequence Number=SeqID_112949
gatccccttatcaccctggcatcccgcgcggaagccgccggcgtttatcactactgtggcgatgtggcggtcagctggtgcgaattcgcccaggcgatttttgtggccgcgcagcgggatgtgctggtgaaagggattggcagtgcgcaatatccgatggcagcggcaaggccggcaaacagcgtactgaataccgtgcggatagcggcgctgggggttgaagcatcggactggcaaaataaacttaccgcggatttttttccgcagagtgaaagttcagctatcgcctga

SEQ ID NO: 21265 - DNA, 621 bp, Glycine max
  Peptide Sequence Number=SeqID_112950
ggtggacccttgggtactaatacccttacctttagaggactacacgtcctcgccttcagagggctacacgccctcatcttcagagggctacaccccctcaccttcagaggactacacgtcctcgccttcagaggactacacatcctcgccttcagaggactccatgtcctcaccttcagagggctgcacaccctcaccttcagagggttgcacgccctcaccttcagaggactgctcgtcctcgccattagagggctgcacgccctcgccatcagagggctacatgccctcaccttcagagggctacacgccctcgcctgtagaggtctacatgtcctcaccttcagagggctgcacgccctcgcctttagagggctacacgccctcgcctttagaggactacacgtcctccccttcagagggctacacgccctcaccttcagacggctacacgccctcgccttcagaggactacacttcctcgccatcaaaggactacaagttctcacctttagagggatacacgccctcgccttgagaggactacacgtcctcaccttcaaagggctgcacgccctcgccttcagaggactacccgtcctcaccttcagaggactacat

SEQ ID NO: 21266 - DNA, 1048 bp, Glycine max
  Peptide Sequence Number=SeqID_112951
atggtgaaagaatttgaagagatcctaggatgccctctagggggaaggaaaccatacctcttctcagggttctatccctctttagctaggatttctaagatagtccaaatctcggtgcaggaattagaccacagaaagcaagtcgaaaatggggtggttggagtaccgagaagatgtttggaggcaaaagcaaggatcttggcaggtagaggcgaatgggctccgttcatagacatcctcgcactgttgatcttcggaggagttctctttccaaatgtggatggattggtggacctagcagcgatcgacgcttttctcgtctatcatgaccgcaaggaaagcccgattgtcgctatactagctgatctatatgacaccttcgaccgaagatgtgagaagagcagtacaaggattgtttgttgtaccccgaccctctctatatggttggtttcacacctttttcgccaagaggagcgtctgttaactggttccctcgttggaaagaaggaagaaccggggcaacttgactaccctatgagaggggcaccactagaggaagagctcgtgcctgtcattacgcgaggtttcaataagaccaacgtggaggcacttcagaaggtccccaaggcatgggaggtggtgcaaaagaaggacaaagaactcagaggcagtaataatgggcccatcggtggctaccgtaagtggttgaaagcccacgtgcaaggtttggattggctcccgagtttgagaaccgctaaaggggaggaagttgaggcaccggaggaagacgaagaggtgcaggcccttagggcagaactcgagcaaacccaaactgtcaaagaaaggttgaaatcagcatctcttaagatccaaaacgagaatgccaaactgagagatataaatatagctaccaccaaggccttggaacaagagaccaagagggctcatagggaagagcacggccggaacaagtttcgaggggctctgtggggcagtaacagcgagcttaagctccggagagaggaaagggaccaatcacaagtagaca

SEQ ID NO: 21267 - DNA, 201 bp, Glycine max
  Peptide Sequence Number=SeqID_112952
atgacaggcacaagaacaagaaacaagactcaaacagatttatttttttttgacacaaagtctgaaagacacaagaaacaagaacaagaacgtgacaagaacaagaacaagaacgcaaataacagaacacaagacgcaaacaagaacgaaacaagatgctacggaggtttggatgacgccacttccggtgaaggaagataa

SEQ ID NO: 21268 - DNA, 320 bp, Glycine max
  Peptide Sequence Number=SeqID_112953
gtaaaggccacctcagtaccagttgcccacatccaaggagggagaagaggagtggaagtctgaataaccagagcgaacgaccaaggatcacgggagagtgtttgctcttagtggtgctaatgcctcacagtctgatgatctcatccaaggggttagacctgaatcaggaaggtaaggccctaatggattctttggagtctaggcctgggggtaaagacactcggtttgagtgctcctttaagtctatgctgattccatatggttggagcattctcgcaaaacagagtgaccctgactggtcaccttatgattttacttag

SEQ ID NO: 21269 - DNA, 165 bp, Glycine max
  Peptide Sequence Number=SeqID_112954
atggctctgatgggcgtgacattgatcccacaagaagcacagcaaactcttgaaatagcagaagctaatttgaataaggcggaaggcaagagacaaacaattgaggcaaatctagctcttagacgagctaggacacgagtagaggctatcaatgtgatttcataa

SEQ ID NO: 21270 - DNA, 511 bp, Glycine max
  Peptide Sequence Number=SeqID_112955
tttggtggacctagccgcaattgatgctttccttgcatatcactatagcaaagaaagcctggtggtagctatgttggcaaacttatttgatacatttgaccgaagaacgatcagctggtttcctcgatggaaggaaggaaaggagggagtccttttctcatgtggggagtacccaaacattccgttgatagggacgaggggttgtattaactacaatcccgcacttgctataagacagttagggtaccccatgaggggagcaccggtggaagagagcctctctcctttgcttgtgagagatttcggcgcgcaaagtttcaagattatacaaagagtccacaaggcgtgggaaagcccattaaggaaagataaagaacttaggggcatccgtaatggcatcatcggtggttatcatgaatggctgaaagttcgtacgcgagggttagattggctctccaagttgaaaattatcaacgaggagaacttcgagactccagaagcggatgaagaa

SEQ ID NO: 21271 - DNA, 876 bp, Glycine max
  Peptide Sequence Number=SeqID_112956
atgacacgaccgccgtcgcgcagccacgcctgccagttcgccggcagtgcatcgctgcggctccacacgccgatctcgccgcgttcgggcagcagccctgcggcgagcgcggccaccgacagcggagcagggtgcatgcagcgccccacgcgcgctgcagtgcgttcaaccagtgctgggcagtggcggatgcctcgccgtgcgcgcgcagcgtgcaatgccgctgcagtctgcggcggtgtgaccggcatcggctgcgtgtgccttgcacgtcgcgcgacagctgccgccatccaggccgggcaggggatcgggaacgtgcacgcgtcgaacgggaagtcgcgctcgtcgggtcaggatctgcagcagttcgccaacaggcttcgcggcgggtgcgctggccagctgttgatcgatcggcgggtcgaagccaggtgccagccagtgcctgcggtgcgcacgcgttcccacagcggcagcaggcgttcggccgcaggccaccgtccacgcatcggaggcgggagtagggcgttcagttgcagatgcacacggtcgcgctggcgcgcgccgttcgctgcgggtaccagctgcaggccatcgccactgattgccagcaggccaaagcggtcgctgttgcagggccagttcgaccaggcatgcggccacgccgcacatgtggtccaggcgcgtgcgttgcggcgccgcgcgatcggcctggccggccgaggcggtggcatcgagcagcagccagaccgtgatcgggctttcgcgttcggattcgcgcacgaaaagcagggtcatgcagcgcccccacggtccgaacagcgcgtacagcttccatggtcgatctggcgcagttcgtccccgggctcgtag

SEQ ID NO: 21272 - DNA, 581 bp, Glycine max
  Peptide Sequence Number=SeqID_112957
ttggcccagggcttcccggtatcaacagggacaccaggatttatttattctgcgaagtgatctccgtcacagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttacacataaccctcacgcctcagttacttaggcttcgtaaatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgaggggtgtcagtga

SEQ ID NO: 21273 - DNA, 389 bp, Glycine max
  Peptide Sequence Number=SeqID_112958
catcggatatgcgaaagagggagaatgtgctacatcggatattgctgtagttgatgaaagagctgtagtttatgctaaagcatcggttacgaatgacccaatctatctatgcattggtctcggcaaagccctccctcggtacgcgctaaggatacgacagccgattcaccagagtgcaaattccgtacttatcccagctctcaagggaagattcgaaagatctttagatggcatattgctagatagcgtcaaagacagtgcatatccatgtatacggtgtcgatatccgagctctgcttacatcgacccgactgctatgataggtttacttttttctccgactaaactcgactctattgtcccgatccggaactacacggcttattgtg

SEQ ID NO: 21274 - DNA, 300 bp, Glycine max
  Peptide Sequence Number=SeqID_112959
atgtttatacggataaccatacggtatttccgcgtatcatcgggcccgccgcctctggatgatacaaggtgcagaatgaccaaacttggtctctgcttgtcatcgggcccgccgcctctggatgacaaaagggtgcgaataaccataagaatgaccaaatttggtctctgcttgtcatcgggcccgcagcctctggatgacaaaagggtgcgaataaccataaggcatctccgcgtatcatgggtgcagaatgaccaaacttggtctctgcttgtcatcgggcccgccgcctctggatga

SEQ ID NO: 21275 - DNA, 1002 bp, Glycine max
  Peptide Sequence Number=SeqID_112960
atggattgggaccagctcttggccgggataggaggtagaacaatcagttggttcccccgatggaaggaaggaaaagaaggagtccttttctcatgtgggagatacccaaacattccgctggtaggaacgaggggttgtattaactacaatcccacgctcgctataaggcaactagggtaccccatgaggggagcaccaacggaagaaagcatgtctcctttcctcgtgagggatctcggcgcagaaaattccaagactatccaaagaatccataaagcatgggaaaccccgttaaggaaagatcaagagcttagaggcgttcgtaatggcatcattggtgggtaccacgaatggctgaaagttcgcatacgaggtttagattggctcgccaatgagaagttcaagttggccgctacacacgttcggaaggagtgtgtcgggttatgggaagagaatgcaattaccgcaagagcccttgaacaagagaccaagagggctcgcaaggaagagtatggccgaaacaaatttcgcggagctctatggggtagcaatagtgaactcaagttgcgaagggaagaaagggaccagtcgcgagcacatggcatggttctggaagaggagttgattgcttgttcaaggtccaaaagaagcttgtctcagcgtttatgcgagacagagaccaacatgttagctatcatcgccaagtacgaagaagagttgggtctagccacggcccacgagcatagaatcgcggatgagtatgcccaagtatatgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagatccacggacttctcggctattgtcagcatatgatagacttaatggcccacataattagaaatcggtag

SEQ ID NO: 21276 - DNA, 678 bp, Glycine max
  Peptide Sequence Number=SeqID_112961
atggtcattgaccaatccctattttttgacttaaccaaattgcctagtgaaggtgtgccttttgagggtgcactgattgatgaatggaaattttatttctctgtgcatgatgtccgccggttagtttgcaccaaccaagtggatatgacaggaagacttcttgccggtttattggcttttgaaagccgcatcctccattaccttatagtttgcattttgcttcctagatcttcaaaccttgcccaggtttctgaagaagatctcatggtcatgtgggcctttcataaaggtttacaaattgattgggcacatcttgttagatatcgcatgcataaggcattgcgattgaatgccccattgccttatcctcaccttgttaccctcttccttcaacatttcaacatccctcttgattctgaaccttatgttccaatcaagagatcattccttataggcgcttcagtcatagcatcctttggttatattaaggagcatgatggatcatgggtaaagaagggtgctagaaatattggtgaagaaggacatgagggagaagattcatctcttctttcaaagattttggaaaggtttgatggtcttcaaacctttgttggtgagaggtttgatactttggaactgcaagtggatatgcgcttcaatgaaatggagtcagaatga

SEQ ID NO: 21277 - DNA, 267 bp, Glycine max
  Peptide Sequence Number=SeqID_112962
atgaatagccaatatatttgcttttatctcatgcctttcttcgttcatggttcgatattctggtgtcctaggcgtagaggaaccacaccaatccatcccgaacttggtggatactccggggaacagatatccagtggagatgacggggtggggcctgtagctcagaggattagagcacgtggctacgaaccacggtgtcggggggttcgaatccctcctcgcccacaaccggccaaaaaagggaaggatttttccctctgggggtag

SEQ ID NO: 21278 - DNA, 300 bp, Glycine max
  Peptide Sequence Number=SeqID_112963
atggctccaaggaagctccctgctaagagggcaaggaaagatgccgtcggagaaggttccaatgctgccccacacgtggatgtggagttcgacgggcataggttccgaagtgaggaacaccaacaccgatttgagtcaattaagggctggttgttcctcaaggagaggcgggtccagttgagggacgaggagtatgctgagtttcaggaaaaaatttcctggaggaaatggactcaacttgcgacacccatggctaagtacgatcccaagatagtcatggagttctatgccaatgcctag

SEQ ID NO: 21279 - DNA, 102 bp, Glycine max
  Peptide Sequence Number=SeqID_112964
atgacagacatgcagagtgggcaccaatccgaaccgtttgatgtagaaatgggagatcgcttggaggatatgattcgtgaccttgtgatgcaatcctacctc

SEQ ID NO: 21280 - DNA, 109 bp, Glycine max
  Peptide Sequence Number=SeqID_112965
atggcgactaagatgaagcgatgtccatttgaagccttaggctcaatggctccgatcaagtctatgccccacatagagaatggccaaggtgctgccaagatgttcaaag

SEQ ID NO: 21281 - DNA, 494 bp, Glycine max
  Peptide Sequence Number=SeqID_112966
atggcaaatatagaggcgcatcagctttactgtagagcgaatgaagtatcactggtgcatctgaaagatggactaacgcagatagcctttcaggatgatgtgaagcgcttcattgacgcacagctaaatatcatccggtctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 21282 - DNA, 210 bp, Glycine max
  Peptide Sequence Number=SeqID_112967
atgggtgatcaagagaagacactggaacagatgaaagccgacatgtcggctttgaaagaacaaatagcttccatgatggaggccatgttaggaatgagacaactcatgaagaaaaacgtggccacctctaccgctattagttcggctgccgaagcagacccaactctcctagctactgcgcaccatcctccctcaaacacggtaggatga

SEQ ID NO: 21283 - DNA, 558 bp, Glycine max
  Peptide Sequence Number=SeqID_112968
atggcggcaggcgtgaaggccggaaaaacggtggtacgtttacaaaccggtgatgtctcgctctacggttccgtccgtgagcagggcgaagagctgaccaaacgcggcattgcctggcaggtggtgcccggcgtcagcgccttcctcggcgccgcggcggagcttggggtcgaatacaccgttcctgaagtctcacagagcctgattattacccgcctcgaaggccgtacgccggtaccggcgcgtgaacagctggagtcatttgccagccatcagacctccatggcgatttatctctcggtccagcgtattcaccgggtggcggaacgtctgatagaaggtggctacccggacaccacgcccgttgccgtcatttataaagcgacctggccggaaagccacaccgtacgcggcacgctggcggatatcgccgacaaggtacgcgaggcggggatccgcaaaacggcgctcattctggtcgggaagttcctgggcgaggagtatcactactcaaaactctatgctgcggattttagccatgaataccgccaggcctga

SEQ ID NO: 21284 - DNA, 276 bp, Glycine max
  Peptide Sequence Number=SeqID_112969
atgaaagaggcccacatgataacaagatcttcctcaaaacctggcgataaaacaagtaattggaagatcgtggaagaaaatccgcataatcagatagatgaaggagcggtggggtgtcaaagcaagacggagaaggagacatcttcttcaatccttggtgaccttcggaatccatgtgcagaaaaatcaaacttccaatcgtcattcagtgaccttgcaattccatggtacatcaacaacttgggttcaactcaacaaaagtctgaagaccattga

SEQ ID NO: 21285 - DNA, 231 bp, Glycine max
  Peptide Sequence Number=SeqID_112970
atggcagcggaatggagaaggaacagagagaggagacgccacttcaaggagaagatgagtctagaagaagctcaccaccataggaggccatggataagagcttggaggaagaaggagatgaacgaagggagaggaagagaagagcatgaaattttgtgctctaaaatagctctgaaatttgaacccactaatccaagatcaattccaagattctccactaagtgtgcttag

SEQ ID NO: 21286 - DNA, 366 bp, Glycine max
  Peptide Sequence Number=SeqID_112971
atgattatgaggagacaagacatttatagtagccaagatgaggctactacttcaccttcctctagtgaaagtgaagaagcaaaaggggaagaatcaagtgaagaaatctacccccaagaagaaggaaaacctttaatgacacttgttagcattgccacacctcttaggcttgagtttattcctcaagtaaaggagttattagatgaaggtttggttcacaagagcttaaatccttgtgctttgttggtgcccaaaatagatgttgaggaaaaaagcccagagtttcaagaacctcgggatttgaggtcaaatccttttcaagggggagggaatgatgcaatcctaccccacaagggcattggatag

SEQ ID NO: 21287 - DNA, 246 bp, Glycine max
  Peptide Sequence Number=SeqID_112972
atgacattttcaaaatttagaacaaggggcattgcacaggccgaaaggcatcctcctataggcaaaagtgtcgaaggggcaggtgaatgtggtcttttcctgatcctcaggagcaatagtaatttgcatataaccagaaaaaccatcaaggaaatagtagtgagatttacctgccaggcgttcaagcatctggtcaatgaatggcagtggaaaatggtgttagacaagtggcctcagatatcttaa

SEQ ID NO: 21288 - DNA, 114 bp, Glycine max
  Peptide Sequence Number=SeqID_112973
atgaagatgctcttgatacaacatgatatgaacgacagtgggatggagaaggaagagagagaggagacaccacttcaaggagaagatgagtctagaagaagctcaccaccataa

SEQ ID NO: 21289 - DNA, 309 bp, Glycine max
  Peptide Sequence Number=SeqID_112974
atgttgtggaagcttgagaggattgatggggacccggtgttgagagaaacgaggatatgggctacgtgggagtacgcgagctcagttggaggtgggcaacaggggatggtgggtttatgcgcgcattgtggatgtggaaaaacttgttgtgcaccatcgcccgaccgccacctagtaccacatgtgatggagtggtacctggagatatgtcgcgggggtcaggagaccttggggacgtcaggtggggtgctattgcccaaaaccaagcttgaccaatcccgacccaacccgggcatagtcggtcagtga

SEQ ID NO: 21290 - DNA, 538 bp, Glycine max
  Peptide Sequence Number=SeqID_112975
gaaaataattggtgttaatgtagaagatgatgattcatacatggacacttatcatcagagtctctgtccccacaagaagagattgagaacatatttggggattatcgctcgtgataaggtcgatgtgacatatgacacctggaaggaagtccctgttgctcagaaggatttgatatgggaggatattcagaccgaatttgaaatccctgaagcttttgatagtaggacaaagaagaaagttcttcagattgtcggcgagcggtggaggaagtttaaatctgatttgacaaggaaatgggcacttgcagccgacaaggacggtgtggaggacactgccatccagaagcaaaacaccgccccccacatgttgtctcgtgggggttatgaatatttagaacatatgctcgtggctaagaaaacaaagaaaagactggaggaagctgctcagtccggaagcactgagggcgtcattgaccctccatctcctatcaaacgatacgtgaagtggaagatggcccacaccaagaaaactgggtag

SEQ ID NO: 21291 - DNA, 261 bp, Glycine max
  Peptide Sequence Number=SeqID_112976
atgttggttgagttactagaggtctacggagaggcagccagggatgagacagcacagtgtcatggaccatacatacacctatcttggctacgagatatatatcagagtagatgtcaagctagacattggaatcctgcagctcgtgcctatgttcttcatcttttaggttgcactctttttgctaacaagagtgcaacccatgttcatgttgtcttcttagacgctctacgtgacttgagtcagagtgggagctatgcatag

SEQ ID NO: 21292 - DNA, 950 bp, Glycine max
  Peptide Sequence Number=SeqID_112977
ggactggatttcgaagagcgtccgttgcccctcaccgtcatcccgaccgtggaggatggtttttcgaagacggtgccgatcctgcgggacggcgaccgcctgggcggcaaggccatggcgcgctttgtcgaaagctggtcccaaacccagctgcatccggccatcgtccgtatcgccgtgctggatatccacaatatgctggatgagccggatcgtcgttatttccgcgaaagccggacaagggcgcttggccgcccgctcgaggatgtcgtcgccaaccgcgaagacgagatcgcggcctttcctgccttgctcgctcccatccgccggatgctgagttttcagcccttcatcggcggcacgtcgccgcttttttcggattacatcgttttcggcgcgctgcaatgggcgaggatcaccaccggtgcggatctcttttcagataatgaccctgtgcgcgactggttcgaagggtgcctcgatctttacgatgcaaggggccgcagtgtgacagcggcaccgcccactttctctgaaggaaaaggaaacggacacatggcgattgaacgcacattttcgatgatcaagccggacgcaaccaagcgtaacctcacgggcgcgatcaccaaggtatttgaagacaacggcctgcgcgtcgtcgcctccaagcgcgtctggatgagcaagcgcgaagccgaaggcttctacgccgtccacaaggagcgccccttcttcggcgaactcgttgaaggcatgacttccggcccgaccatcgttcaggttctggaaggcgaaaacgccatcctcaagaaccgcgaaatcatgggcgccaccaacccggcccaggccgctgaaggcaccatccgcaagaccttcgcgctttccatcggcgaaaactccgttcacggttccgacgctccggaaaccgccgctcaggaaatcgcctattg

SEQ ID NO: 21293 - DNA, 366 bp, Glycine max
  Peptide Sequence Number=SeqID_112978
atgggtgaagtagaggaggtgcaagagcagatggaggccgacatggaggccatgaaagagaaaatggccacaatgatggaggccatgataagcgtggagaagatagtggaagccaatgcggttgcagttgccgccaccagggctgttgctaaggcaaagatttgggaagtacgggcggcccccatgatgtgcaaaattcaaaacgagcacgccttcccaccatatggcttgcctctcaactatacgccacccaatgtggcgtacactcccaataagaatgtcaataactccactcctatacccattgagagccaacaaccccgaactatcatgcacatgtctcttaatcgtgggggaggcacatga

SEQ ID NO: 21294 - DNA, 168 bp, Glycine max
  Peptide Sequence Number=SeqID_112979
atgtggaccaccacggttgaagaccgaagaaaacgaagagcgaacgatggatgtcgaagaacggttgaaaaccttcgcgtaattactcacggaaacattacggacacgttacagaagcgcctcggcttggattttctacacggaaacaattttcctcaacaaatttaa

SEQ ID NO: 21295 - DNA, 156 bp, Glycine max
  Peptide Sequence Number=SeqID_112980
actcatcttctccttgaagtggcgtctcctctctctcttccttctccattccgctgccatttatcttccaagaagcaaaggaatccattgatgaagaagatcctaggcctacaagctccaatggagcttgcatcaaacactactcttgatttctag

SEQ ID NO: 21296 - DNA, 304 bp, Glycine max
  Peptide Sequence Number=SeqID_112981
gcagaattgatgccgatatctggaaaaaggaatccgagattccgaccttgacagatatccatttgaggaggattgagaatgtcggaattgttgtctttggtagtgattttagggttcacgtcatatttttgagccgcctcgggatcctccacagcgccctaagaggactagaattgtatactgtagcaggctactccccgaaaatgaatgcctacggaaggtggggtaacctctccctcgctatccatccttcgccaattcgccttaacaaaataccttaccttaaagggctaccacgggatac

SEQ ID NO: 21297 - DNA, 762 bp, Glycine max
  Peptide Sequence Number=SeqID_112982
atgcctgagcggggcgaagccagaggaaactctgtttccctcaggatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcaggacggtggtcatggaagtcgaaatccgctaaggaccccgatgagtaggagggcgcggcggtcgcttgcaaaacccagggcgcgagccccgggcggagcggtcgtcggtgcagatcttggtggtagtagcaaatattcaaatgagaactttgaaggccgaaagaggggaaaggtttccatggacgggggaagcccgtctgatagcgctctgtgcgcgtactcccgaaagggaatcgggttaaaattcctgaaccgggacgtggcggctgacggcaacgttagggagtccggagacgtcggcgggggccccggaaagagttatcttttctgtttaacagcctgcccaccctggaaacggctcagccggaggaccgagtgcctcccacgcccggtcgtactcataaccgcatcaggtctccaaggtgaacagcctctggtcgatggaacaattcccgaacccgtcggctgtcggtggactgctcgagctgcttccgcggcgagagcgggtcgtcgcgtgccg

SEQ ID NO: 21298 - DNA, 630 bp, Glycine max
  Peptide Sequence Number=SeqID_112983
atgggcagcaattttctcatgtcgattcttgatctcgggaagggcaggcccgtcgctccttgcgggcaaagcttctgttcagcctgttgcccggttgccgcaacgggcggggcccgcaccccgcctaagttgatattgtataatcgatggcttcaccgattttgtcgcccgacgcgccgtcgggcgattcgggtgttcggccagcgcccttcagacgcagcgctagcgaatgaggcgatacgcggtatgagaaggtcgcggaaagagcgagcgttacgactcgttcgccgcaacctctacagcctcgaccttcttgccggcaaaacgcagggcgacctcaccattgatgagcttcagcgccacattgccgaaaagctcccgccgccaaccggtcagcgccgccaccgttgccttttcgccctcggcggcgatcttgtccagatcgtcgctattggcgatgaccttggcggcgacgccgtgcttgtcagctgtcagcttcagcagaaccttcaacacgccagcgccgcattcaccgtctcgacgatggcgttgccggacgcggagcgttcccagcccttgggaatggtgcgaagccgcgacagcgcctcggcatcctttggctgctgctga

SEQ ID NO: 21299 - DNA, 282 bp, Glycine max
  Peptide Sequence Number=SeqID_112984
atggactcgggaaggtttcaagttagtgtactaggtagcaattacccccgaacaactcttctaggcacaatcttcacttccttcaatggccctgagcctttcctctacatgatccaacttttccatttctgccatagcatgagggtttttaatcgctgtggaatgcaaggggtgtggttgtgggtgatactgagggcccttccaaagtgttttgcaaggggtataccacccaactgcttgcccttcagtggcatatccgagccaaggctcgaagtcggctga

SEQ ID NO: 21300 - DNA, 84 bp, Glycine max
  Peptide Sequence Number=SeqID_112985
atgatggtggcccacgtgatgttagggaatggctatgagcccgaaatgggtttaggcaagaacaacggcgtcagaaccagcctg

SEQ ID NO: 21301 - DNA, 506 bp, Glycine max
  Peptide Sequence Number=SeqID_112986
gggttgtgcccacaaagacacccaatggacccggagaagtccaacaaggctctggggtttccagttctagttatgggcctctgtcggtcctacagggtgcccgtttccccccagcaaggtcacgccatcatgtcatagggattgtgcccgcaagacacccagtggacccgaagaaggccaacaaggacttggagttgccagctctaattacgggcctctgtcagttctacggggtgcctgtcgcccccagcaagaagtactgcgccccaaggcaggcgcagggcgcaacaccccagcagcttagggatggccgacagcgggcaatagacgcactgccgccacctccaaagaacctcagctcatccacaaaaaagttagtgcgttgcctacgacccatggccgaccagcaggcgaccaagtacaaagccaaagataagaaaagtactaggtctgtgaccgacaagtcatcaagcgtccaactcaagacgttaaagaagcgctactag

SEQ ID NO: 21302 - DNA, 270 bp, Glycine max
  Peptide Sequence Number=SeqID_112987
atggagaagatgaatgtgcatataataataagggtgacccctaagggcaaagggtcactttggggtagttgcagctcacccaggcgagttggtttcttcatcatgaagttatttggtagcccaggcgagctagaggctagcctgggcgagctagaggctagcctgggcgagctagggtccaggaaaaccaaggaaaatacccttttgccccccttttttttggtttttttgcattcttggtcaaaacaagaggacattgaagtcttataa

SEQ ID NO: 21303 - DNA, 441 bp, Glycine max
  Peptide Sequence Number=SeqID_112988
atggcattgggttttcctgctttagttataggtctctgccagttctatggcgagccggtcacaccaacaaaacacattcgacctcccattaacagatcactcatcgacaaatattgcatgccaaggaaggtacaacaaccagagaaagttcaacaacctcaaccaccagcatatgccccaccaccacctccacaaaagcctccatccttggagtctatctcaacacacttcaccagcatcgccaagaccctaatcttaacccttggcctactcccgagtagtttagagccattgttgcattgcctagagataggcccatttttcatgaggagacgagtcctgcaaatgctcaagaagctgcccaaggagatagagaaagatgaagacatggcaaatcatgttgattattttatgggaggaaatggatcttcccagccatga

SEQ ID NO: 21304 - DNA, 291 bp, Glycine max
  Peptide Sequence Number=SeqID_112989
atgattcttgatgccttagctggaggtactatgttttgtaagagcctagaggaagcaattgtaaacattgactcaataacaaccaatgataatcagagtcaccatgatagagctctgataggccaacctcctcaacaatttcaacaatgtggatcacaaaaaacaccccaagctcatcaagttcaacaagttgagattgccaatcggaagaagaggcccattatgtgcaaaaccaggagagatctcaacagaacttccaagcaaattaccaaggttacagaggtggctcag

SEQ ID NO: 21305 - DNA, 615 bp, Glycine max
  Peptide Sequence Number=SeqID_112990
atggtggatattgctgtttctgagcatcaaattgccaaggaaatcactgccaaacaagtccagcattggccaaagaaagggaagctttctgcagggaagctaagtgtgaagtatgcaatcctgcataggattggcactgcaaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctgctctgtccctgcattacaaactgtttgaggggacacatgtcccagacattgtctcgacatcagggaaagctgctgcttcaggtgttgtgtccaaggatgctttgattgctgaactcaaggacacatgcaaggtgctggaagcaaccatcaaagccaccacagagaagaaaatggagctggaacgcctaatcaaaagactctcagacagtggcattgatgatggagaagcagctgaggaagaagaagaagcagctgaggaagaagaagatgcagcagaggatacagagtcagatgatgatgattctgatgccaccccatga

SEQ ID NO: 21306 - DNA, 585 bp, Glycine max
  Peptide Sequence Number=SeqID_112991
atgtcttgcctagcaatcataactccaatctccctcttccaaagtgtgccacccaccaggcaccctctagacccggataagtctaacaaggccctggggtttccggcattaatcacgggcctctgccagtcattcggggttcccgtcacccctagtaaggtgatccgaccgccgatcacccaggccttcatcgagaagtattgcacgcctaggcaggcgcagggtgatgcacctcaggccgcagacgcaccgccaccaccttatcaggccgatcccgctagatcactaggcatggagtgttatctacagcacttggttcgccagcaggcggccaaccaccgggggcaggtacagatacatgagtgtctctactggttcagcctcagtcaacaggggcaaggttttgctccttttgcatgccctactccagagcagtttagggctgaggtcgcatggcccggagattggcccgaggcccaggcaggggaggagcctactggatctcccggcgatgcagaggaggcccgtatggatgaggagataacggacttgctcggtttcttgggaggaagcggagccatgtga

SEQ ID NO: 21307 - DNA, 537 bp, Glycine max
  Peptide Sequence Number=SeqID_112992
atggtgcctaccaggcaccctctggacccggataagtccaacagggccctgggatttcccgccttgatcacaggactctgccagtcgttcggagtccccgtcgcacctagcaaggtgattcggccgcccatcacccgagcttttattgagaagtattgcacacagagacaggtccagggtgatgcaccacaggccgcggacgcgctgccacctcatcaggctggtccagccggatcgtttgatacggagcagtatttgcggcatttggttcgccagcaggcgaccaaccaccgggctcatgtacaaacccatgattgtctttaccagatgagcctcagcctgcagagccagggttttacttcttttccgtgccttactccggaccagttcaaggcagaggtcgcatggcctagagattggcctgaggcccgggcaggggaggcgccagcaaaggctcccgacgaggcagatgaggcccgcgaggacgaggagatgaccgatttacttgatttcttaggagggagcggggccacatga

SEQ ID NO: 21308 - DNA, 875 bp, Glycine max
  Peptide Sequence Number=SeqID_112993
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatctattccatggtttccattgatgtattcattggaatgccatggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 21309 - DNA, 210 bp, Glycine max
  Peptide Sequence Number=SeqID_112994
atggggcaacaaatgaagaaatcagagctgccactgaagttgctaatgcagcaaaattcattgatagatttccacataagaaagacacaagaagaagttgaagattgggaactggagtattggcctcacaggataggtttccatgagatcgatgcagcaacaacggggttttctgaagagaatgtggttgctgtaggagggaccaggaag

SEQ ID NO: 21310 - DNA, 537 bp, Glycine max
  Peptide Sequence Number=SeqID_112995
atgatgagcatgaagaagataatggaagccaatgcggttgcagttgccactaccagggctgttgctaaggtgaacccgatgcccccatctgatctcaaccaaatgaatcatccaacctcagatatggtgggcaaagatttgggaagtatggacgaccccatgatgtgcaaattcaaaacgagcacggcttcctgccatatggcttgcctcccaactatacgccacccaatgtggcgtacactcccaatgagaatgtcaataactccactcctatacccattgagagccaacaaccccaaactgatcatgcacataaatgggaaagttggatcatctaaggaaaggcttagggccattgaaggaggtgaagattatgcctttgctaacctagaagagttgttcctagtacccaatatcatcaccctcccacgttcaaggtgctggactttgacaagtacagggactacttgccccaagaaccatccaaagatgtattgtcggaagataagggcatacgcaaagatgaggaactgctaa

SEQ ID NO: 21311 - DNA, 168 bp, Glycine max
  Peptide Sequence Number=SeqID_112996
ggggagatcaaagttgaggtggtgcgcatgatccgcactcgtctccctatggcggtctgggcgaaatcttgccccggtatgcatagtagctacgcgatagcctccctctctagttgtgctcgcacagttggccgtcctccgagatcaggggggtggccaaggaactga

SEQ ID NO: 21312 - DNA, 330 bp, Glycine max
  Peptide Sequence Number=SeqID_112997
atggcttacactcacattccggtggaagattcaacaagcgattctcctcaaatttcagccagcccgtatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagtagatatgggatcaagtttagcatatgacaacggaatttgggactttgtggttgatttagggatggcctttgtggataactgggtggtgggtaaggaggag

SEQ ID NO: 21313 - DNA, 525 bp, Glycine max
  Peptide Sequence Number=SeqID_112998
atggaaaaacggctttgccgcggccctctcactttccctgttaagtatcttcctggcatcttccaggaaatctccgccccgttcccttttttctcctgccacatgaagcacttcactgacaccctcatcagtgccaacatagcactaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 21314 - DNA, 75 bp, Glycine max
  Peptide Sequence Number=SeqID_112999
atgtcgagtgctgcttttttccccaagcttgtgttgaggaaaaaagcccagagtttcaagaacctcgggatttga

SEQ ID NO: 21315 - DNA, 584 bp, Glycine max
  Peptide Sequence Number=SeqID_113000
atgcttcccccctcatgtcaaaagcgatactcacggatttacgagttttcagccctagggtcatcattttttgcatttgtggattccgtttcgcgcttttattcgtcaccaacaagaaatgccccaaggaagcttgcctcaaagagatccaggaaagacaaggcggttgaaggaaccagttccgctcccgaatatgacagccatcgttttaggagcgctgagcaccagcagtgcttcgaggccatcaaaggatggtcattccttcgggaaagacgtgtccagctcagggacgacgagtatactgacttccaggaagagatagttcgccggcggtgggcatcgctggttacccccatggccaagttcgacccagacgtagtcctcgagttttatgccaatgcttggcctacagaggagggtgtgcgagatatgcgatctggggtgaggggtcagtggatccctttcgatgcagatgccctcagccagttcctgggataccctttagtgctggaggaaggccaggagtgcgagtatggccagaggaggaaccaggccgatgggtttgatgaggaggccatcgccca

SEQ ID NO: 21316 - DNA, 691 bp, Glycine max
  Peptide Sequence Number=SeqID_113001
atgagcaaaatccctaacgcggtcaatctggtgcagcaggcgaaagtcagcccgtatcatctgggcgtgtggggctacgtctacaccatcggctaccgtccggatctggtgccgaaaggggaaacctttaccagctggaacgacctgtggaagccggagctgaaaggcacgctggcgctgcccgactgggatccaagccacatcatcgccgtggccgcaaaactctccggcagcgatgccgcgcactggcagcagggccaggcgaagctgaaggcgctgattcctaacatcaaatcgttctacaccgatgatgccaacagccagcagctgatctccaccggagaaacgccggtgcaggtgatgctgtcgatgaacgcctacagcatgattgcggaaggggtcaacatcaagctggcgataccgaaagagggcgcgatcctcggcgtggataccgtcggcatcaataaaggcagcaaacataccgatctggcgtacaagttcatcaacatcgcgctgaaaccggaaattcagcagcaggtggcgaagatctatcgcggtagcccgacggtgaccaacgcgcatatcgatccggagctggcgaagctgccaggcatgctgaccacgccggcgcagtggaatgccaccatcaataccgatccccaactgcgtgcggagaaaactgccgagtggc

SEQ ID NO: 21317 - DNA, 373 bp, Glycine max
  Peptide Sequence Number=SeqID_113002
cctaagtgaagaacttcgtgactattacgaaggaaggcataggtcacatcttagacctcactcccatagaagagaaaaggaaagaaagcctcaagaggctaacattaaactctcatacttcgatgggaaggacaatgtagaggctaacttagattgggaaataagggtagagcaacaacttaaaaagaagtctacttcaaaatcttatggctctcactcttatcgaaagaaagaccaaggtcaaggcatcttaggggtgacaccttctaagcccaaagatgataaggggaagacaatagaaaagcaagcctccctgaagattagtacaagaagaaagggactactctataagagctttaaatgtcttggataa

SEQ ID NO: 21318 - DNA, 537 bp, Glycine max
  Peptide Sequence Number=SeqID_113003
ggaatactcctccaggttataaagcccactaggactactaaggaagaggaggaaaaaaaagcttatgatgagcatctatttgagtcgattaatcatcccttgcatcatccttacaccggttctcttgttcccctcatgattattctttgtgttctttcgggcctcgaatccgggtatacgttgcacatgatggatccagcaggaggtcagcctgctgccaatcctgcagcggagcaaccctcaaacgtgccttcaggcgcatcgacctcgggctggagaagtttcgaagaaggtgttttgttagaatcttcaaacgaatccagcgaagcgagcgtgaatcagcagcctgtgattcccgaacttgaacctccgcttctcgatgacaacacccggcgagcagagctcgctgttcgattgagggcgaattggtgggggatcgcttataacgagcgaatcctcgactccttcgtccggagtcaacttgcaatcgaaaggcacatagaggccgcacttgtggcggacggatattcccctcaa

SEQ ID NO: 21319 - DNA, 108 bp, Glycine max
  Peptide Sequence Number=SeqID_113004
atggcaaacctccaccctgaactcagtaggcatggaagcagtatgactagaggccagtggtggagcccttggagacatgacccctgcggaagccaggaatttaattga

SEQ ID NO: 21320 - DNA, 510 bp, Glycine max
  Peptide Sequence Number=SeqID_113005
atgagacttaagaatcaaggaagtcacttagttcattatataagccaccaaggaaatcaagtagctggaaagaaatttatgaagaagcatgataaaggaaaaggttcattaaaggtcaatgacgactctttgcaaatccaaaaaaagggattccttacaatccaaatcataagcccaaatgagaagttcatcttcatggggaatagagtgaaagctccagtggaagcagtcgggacttattgtttaaaactcgacattggacatcatttagatttattggaaactctttatatttttatggatctaaatatttgtttggattgtatcaaacaaaacatacaaagaaaggagctacaagaagctcttagcttcttgaaattgtgcacactgatatttgtggaccttttgatgttagttctttcgaaaaggaaagatacttcatcacctttattgatgattattcacgttacggttatgtctacttactgcatgagaaatctcaggcagtga

SEQ ID NO: 21321 - DNA, 726 bp, Glycine max
  Peptide Sequence Number=SeqID_113006
atggaaccaattgcctccctcgcccagtattatgatcagccgttgaggtgcttcatctttggggacttccagctatcaccaatggtggaagaatttgaagagatcctaggatgtcctctagggggaaggaaaccatacctcttctcagggttctacccctcattggccagaatttctaaaaaagtccaaatctcggcgcaggaattagaccgccaaaggcaagtcgaaaatggggtggtcggaataccgagaaaatatttggaggtaaaagcaagaatcttggcagataaaggcgagtggaccccattcatagatattctcacactgttgattttcgagggagtcctctttccaaatgtggatgggttggtggacctggcagcgatcgacgtttttctcgcctatcataaccacaaggaaagtccggttgtcgctatgctagccgacctatatgacaccttcgaccgaagatgtgaagaaagcaatgcaaggattgtttgctgtactccaactctctatgtggggctggtttcacacctttttctccaagtaggtaggcccgtctatccgctacaaggtcaccgctcgtgcgttgaaaaaggaaaggcgaattgggaccaactcttggctagcatgggggggcgtctgttaattggttccctcgctagaaggaaggaagaatcaagattctatcttcatgcgaaggatgtccaaatgttcccttga

SEQ ID NO: 21322 - DNA, 426 bp, Glycine max
  Peptide Sequence Number=SeqID_113007
atgtaccctctacttgtaccacaaaggatgtaccctccaatgtgtcaagacaaagatctcagggaaagggaagaatcaaaagaattctcagacagtgtcattttgaattctttgacaagggagaagggagacacaaaagaattcagccggttagtcaattgttcttttggaaaagggagaagagaaacacaaaaagaattcaggcggttagtccttggcgaattctttttggcggagggagaagagaatgaaaagatgaatagcacaagttttcaaggtttagaaaaccagaaaactttagaaagcttctggtacaaagaagaagaagaagttcaaagagattcaaggcttgtaaaggattgtaagagattgattggaaaagtattcaagattattgaaatgcaaaacaaaaccttgcttttatag

SEQ ID NO: 21323 - DNA, 351 bp, Glycine max
  Peptide Sequence Number=SeqID_113008
atggccgtgggaaacatcttaggccatgccacaggctcctacagcggcctccataacatctctcccttcaccaaaacaaaagcctgtgatgtctactgcgcaaatttgaagagttgtttcttcctctccatcgcgcttcttctcactctctccacacttacattgagctacgtgaaggagaaaacggtgatgacttccgtggatgtggatgatggtgggggtactgtgccgaagacgatgagagagggattcaaaggcttttggggtgcctctcagacgttgacatgtggcagtcaacgtcactgcttaacggtcaacatccaattgaggtgtccgggaccaacattgtag

SEQ ID NO: 21324 - DNA, 349 bp, Glycine max
  Peptide Sequence Number=SeqID_113009
atggatgacgggtatagactcctctcacctacatcgagtgctactgagaggctgacaacaacctgtcgttctagtctactagctcttctgcccggtacttttgtcttctacctcctccaacctagtggaagaataagcttgtttcgtagtccagtattactttctctccgcaagtgcactaccgcattccttcctaccaccaacttggaagaagaggttattgtactgtcttacttaagtggaggggtggggttcatgtggtcagtcatcatgttagaagtagtgaagggtctcaaggaagtatgtaaagagggtgatgatgaggatttactggagaccagtctagtag

SEQ ID NO: 21325 - DNA, 195 bp, Glycine max
  Peptide Sequence Number=SeqID_113010
atgagtagttctcaactcgtatactactatggcggtagtttcatcactggggataatagagagctgggagctgttgaagcactgatagtagttaccgttcaaaaggggaccttggcgcatcaactaggtagctgggagtacaaccaaccctccccaaccaccatcgcagttgctagtagctggcagttcaagtag

SEQ ID NO: 21326 - DNA, 276 bp, Glycine max
  Peptide Sequence Number=SeqID_113011
atggtgaaagttggaacctcttacgtgccgatcaacgtctcattttcgccaaaagttggcccagggcttcccggtatcaacagggacccccaggatttatttattctgcgaagtgatcttccgtcacaggtgctccagtggcttctgtttctatcagctgtccctcctgttcagctactgacggggtggtgcgtaacggcaaaaacaccgccggacatcagcgctggcaagtgtagcggtcaccctgcgcgtaaccaccacacccgccgcgcttaa

SEQ ID NO: 21327 - DNA, 381 bp, Glycine max
  Peptide Sequence Number=SeqID_113012
atggcacgcagagaccaagtttggtcattctgcacccatgatacgcggagataccttacggttatccgcacccctttgccattcagacacagtcgtgtccgatggcacgcagagaccaagtttggtcattctgcacccatgatacgcggagataccttacggttatccgcacccctttgccattcagacacagtcgtgtccgatggcacgcagagaccaagtttggggctgacacagtcttctgcaccttttgttcctccgggaataacaaagtcatttacatgcggaaatttcatggtcgcccgcgactctcgtcaaccgagaggagcgaaattagtgtcatacactgattttcggggacctttgcttgacgacatgtga

SEQ ID NO: 21328 - DNA, 612 bp, Glycine max
  Peptide Sequence Number=SeqID_113013
atgggctcaaaaatctaccctaaggttcatgacaaccctcgggccttcttcaatagctctagcctaatcctcttggagcctcttgctcatggctctggaaggcataggtcaaatcttagacctcactcccataggagagaaaatgaaagaaagcctcaagaggctaacattaacctcccatacttccatgagaaggacaatgtagaggcttacttagattggaaaataagggtagaacaacaacttaaaaggaagtctacctcaaaatcttatggctctcactcttatcaaaagaaagaccaaggtcaatgcatctttggggtgacaccttcaaagcccaaagatgataaggggaagataatagaaaagcaaccccttaaggctagtatgcaagaaaagactagctccataaagttctttaaatgtcgtggaaaaggacatgttacttctcaaagccccaccaagaaaatcatgattatgagggtccaagacatttatagtagccaagatgaggctactacttcatcttcctctagtgaaagtgaagaagcaaaggggaagaatctagtgaagaaatttacccccaagagaaggacaaccttttatggttag

SEQ ID NO: 21329 - DNA, 573 bp, Glycine max
  Peptide Sequence Number=SeqID_113014
atgcctaagtgccagctggtgtacgccatcctgacacggatgagcatccatgtggctcagttaatcgctgatgccatctatatttttgcaggtatggcgcccactaggcaccctttggacccagataagtccaacagggccctgggattccccgcactgatcacaggactctgccagtcgttcggagtccccgtcgcacctaccaaggtgattcggccgcctatcacccgggcttttattgagaagtactgtacccagagacagggtcagggtgatgctccacaggccgcaggcgcgcccccaccacctcatcaggcgggccaggctggggcattcgatatggagcagtatttacggcatttgatgagccttagcatgcagagccagggcttcgctcctttttcatgccctactccagaccagttcagggcagaggttgcatggcccggagattggcccgaggcccaagcaggagagacacccccagaagctcccggcgatggagaagaagcccacgaggatgaggagatggctgatttgcttgacttcttgggagggagtggagacacgtga

SEQ ID NO: 21330 - DNA, 381 bp, Glycine max
  Peptide Sequence Number=SeqID_113015
ggtttcagaagcaaagaagaagaagggtttcagaagcaaagaagaagaaaggtttcggggtttcggaagcaaagaagctgaaggggtttctctgaggttcaaagaagtatttacgaagtacaaagctaagacaagaaagaggacttcgagctattgggcaattcgaactggtgtatggacgagtcgaagtcgaggcagcaagagttctggacttagcgtaatttctgaacaaatcttcaccaaatcagttcgatttcgagtaatgtggataaccgttctagggagcggttatgtgtgcatgcaagggtcgcaaatcatttacacaaatccttatacactcaaagtacccagcgcagagagaaacgagtacgcaaggagaat

SEQ ID NO: 21331 - DNA, 168 bp, Glycine max
  Peptide Sequence Number=SeqID_113016
atgaaccctaagagaataaaggtcattcctgagtggtccattccaccatgtgttgagggaaggagcccaaagtatgaagaacctcgggatttgaggtcaaatcctttccaaggtggagggatgaggcaatcctacccgcaagggcattgggtagaagactccaagtag

SEQ ID NO: 21332 - DNA, 342 bp, Glycine max
  Peptide Sequence Number=SeqID_113017
atgacggtgaaaacctctgacaacatgcagctcccggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccttcagttcaccaggtgtctcttgcctgcccgtggattcagcagcagttcgaaaggttga

SEQ ID NO: 21333 - DNA, 336 bp, Glycine max
  Peptide Sequence Number=SeqID_113018
accaatctggtctctactgatcttgcaaaatctctcaaagcatgcatctacgtgatcaagggaagatccaacagaggatttagctttccataccaggaagtcttcttaacgaacaaagagaagaacaagatggaagattgcaaaaatacaagtggtgaggatgtctccttcacctctaggatctcacaatcactcacaaactcatctcaagctctcaaactggctcttgcttcaagctctgggtctctacagatcttcacacagcaaaatctctcaaactctctggatcataaaggcatactggacctttctctctctagaaatcagatccactag

SEQ ID NO: 21334 - DNA, 414 bp, Glycine max
  Peptide Sequence Number=SeqID_113019
atggatagttggggtactctggtagattgtccttcggagcagcagttccctgagcaccttcaaaagtttcaagtaacgtgtttcccgtggtcaatgttcgatgactatgttgaatcttctcattgggatatgaaaaaggtattacaaaatagtcttggagacctctgtagtgtttggaatgtcatgaacaatatgatgacgctgcagcatactcaaattaaagcatcattcgaaacaattttaaggtacactttaaatgaaattgcgtatgagtttgagcatgtacgctattttggaaacaatccatcttcttgtagttgtgtcttgagaaccacactaagtcttccttgtgcatgtgagatacaaaggtatgatggtggcaacatcccactcgatgcagtccatatgtactaa

SEQ ID NO: 21335 - DNA, 159 bp, Glycine max
  Peptide Sequence Number=SeqID_113020
atggaggatagggtcacgactgaccgatcgtcgtcccttcccgcgctggacgagcagagaacgtcgctgcaaggcaccctaatttcgcaatttgtgaagctctgtgacatgccggaactcaaaaggaagcatcgttgcacaattcatgaggttccgtaa

SEQ ID NO: 21336 - DNA, 477 bp, Glycine max
  Peptide Sequence Number=SeqID_113021
atgactttgttgttcccggaggaacaaaaggtgcagaagactgtgtcagcccctgcatgctatcaagcgttctgtcttacagatagcaaaagaatgggtgcgaataaccataagcaaaggggtgcggataaccgtaaggtatctccgcgtatcataatgatcaaacttggtctctgcttgccatcggacacgactgtgtctgaatggcaaaggggtgcggataaccgtaaggtatccccgcgtatcatgggtatctccgcgtatcatgggtgcagaatgaccaaacttggtctctgcttgtcatcgggcccgccgcctctggatgacaaaagggtgcggataaccgtaaggtgtctccgcgggctaccagctcttgagtcatggcacaaaggcggtgtggtcgacaaaagcgaggctcttgctcctacgtatcctcccatgaggaattcagactacgtagttctggataactggtga

SEQ ID NO: 21337 - DNA, 903 bp, Glycine max
  Peptide Sequence Number=SeqID_113022
atggggacgaggggttgcattaattataatctcgtcctcgccataaggcaacttggctaccccatgaggggggcaccatcagaggaaggcctcacaccttttattgcacgaggtttcaatagccccaacgcgggggtgcttcagggggtcaacaaggcatgggaaatggtgccaaagaaggacaaggaactcaggggaagtagcaacagggccgtcggtggctaccgtagatggttgagagccactaaagaggtggaggttgaagctttagaagaaggcgaagaggtacaagccctccgaaaaaagcttgagaaagcccaagcagtcaaggaaaagttcaagtcagcaatcgttaggatccgaaaggagaacgccgaactgagaggcgttaacatagccaccaccaaggccttggagcaagagaccaaaagggcccgcaaggaagaacatggccggaacaagttccgaggggctctgtggggcagtaacagcaaacttaagctccaaagagaggaaagggaccagtcgcgaatagatggcatgattctgaaagacgaattgaagactttcctaaagtcaaaaaggagtttgtctcaacggctaagcgagactgaaacaaacatgttggccatcatcagcaagtacaaagaagaattagatttggccaccgcccacgagcacggggtggcggacgaatatgcccgagtatacgcggaaaaggaggctaggggaagggtgattgactcgttacatctagaagcgacaatgtggatggatcggtttgctcttactttgaatgggagtcaagatcttacccgactactggcaaaggccaaagcaatggcggacgcatactccgcccctgaggaatccacgggctccttagctattgttagcatatga

SEQ ID NO: 21338 - DNA, 676 bp, Glycine max
  Peptide Sequence Number=SeqID_113023
agggatacacgccctcaccgtcagaggactacaagtcctcgccttcagaggacttcacgtcctcaccttcagagggatacacgccttcgccttcgtaggactagacgtcctcaaattcagaggactgcacgtcctcgcctttaaagggctatatgccctcgccttcagaggacaacacgtcctcaccgtcagaggactatacgtcctcaccttcagagggattcatgccctcaccttcagaggactacacgtcctccactttagaggactacaagtcctcaacttcagaggacttcacgtcctcaccttcagaggactagacgacctcaaattcagaggactgcacgtcctcaccattagaggactgcgcgtcctcgcctttaaagggctatatgccctcgccttcagagggctacacgccttcgccttaagaggagggcttcacgccctcaccttcagaggactacacgtcctcgccttcagaggacttcatgacctcaccttcagagggctacacaccctcatctttagaggactatacgtcctcaccttgaaaggactacacgtcctagccttcggagggctacacgccctcgccttcagaggactacatgtcccccttttcagagggctacacgcccttgcctttagagggcaacacgtcatcgccttctga

SEQ ID NO: 21339 - DNA, 480 bp, Glycine max
  Peptide Sequence Number=SeqID_113024
atgaaaagagaaaaacatgcctcttatagtagtcataactcttgcaagagcctaagtgaagaacttcgtgactattacgaaggaaggcataggtcacatcttagacctcactcccacaggagagaaaaggaaagaaagcctcaagaggctaacattaacctcccatacttccatgggaaggacaatcccaaagatgataaggggaagataatagaaaagcaagaccctaaggctagtatgcaagagaagactagctctataaagtgctttaaatgtcttggaagaggacacattacttctcaatgccccaccacgaaaaccatgattatgaggggccaagacatttatagtagccaagatgaggctactacttcaccttccactaatgaaaatgaagaagcaataggggaagaatctagggaagaaatctatccccaagaagaaggacaacctttaatggttaaagaggagtgtaaggag

SEQ ID NO: 21340 - DNA, 534 bp, Glycine max
  Peptide Sequence Number=SeqID_113025
agtgagtcatggttactcaaaacaataagagtagcaaatttttgctcctgggaccgtgaatgtgctgaattgattggtgaaacagctgatgatgtgaatagggtcaagattgaagatggtgatcttgatttaaatgcttcccctcaagcacttgacaaattgttgggtcatgtgcttgcttttaaggtcaggattcaatcaaaattaaaaaatgcagttgttcttagatactcaaaagacctagatttgatcaatgctgttctcgagaggttgcctgatagtgaggcatgttccaaaatagatccttccaatgttgattgcaataatgctacgcatgctgaatgttttatgctttatgagcaatctctgtctgtcacagctgaccatgatccggttgcgggattgcctttaacgcccaaaaaacggatgtcatctgatgaagttgatgatgagttagggagctcgcaaatttccccagcccaactatcgtctaacaaattaacaagacattctcataagagccaatttagctga

SEQ ID NO: 21341 - DNA, 282 bp, Glycine max
  Peptide Sequence Number=SeqID_113026
atggctaagtttgacccagatatagtcctggagttttatgccaatgcttggcccacagaagagggagtgcgggacatgcgatcatgggtgaggggtcagtggattcccttcgacgcagatgccctcagccagttcctgggtgacccgttggtgttagaggaaggccaggagtgcaagtttagtcagagaaggaacaaagctgatgggtttgacgaggaggccattgcccaactattatgcataccgggtcaggattttgcccggaccgctgccggaaggcgg

SEQ ID NO: 21342 - DNA, 300 bp, Glycine max
  Peptide Sequence Number=SeqID_113027
atgcttcagagcattcatcggggacagatcattttactacaaagtttacaggtggtggcacctccaggatctattccttcagtggagcagttcactgagatggtagcctggcccgggacccaaccttctcttcacagggaagatgaagagcccttggttagaaggaagaaggcagataaaacacaagaagttgcagccacttctgagaaatctcttttggccacttctgagccttcagaaccagtggcagatacaacttcacttcagcaggcagcaaacccttccactcctgaggattag

SEQ ID NO: 21343 - DNA, 54 bp, Glycine max
  Peptide Sequence Number=SeqID_113028
ggtgctaagtatttcaaagcggttaatcaaaggttgcatgccatcaagcaatag

SEQ ID NO: 21344 - DNA, 171 bp, Glycine max
  Peptide Sequence Number=SeqID_113029
ggagtccgcatcgacaaattagctcccttcttgatgaatctgactacccacactcctcgtgacattggtataagaagcttcttcgacccatttggtgaagtagtctatcaccacaaggatgaagcggtgaccattcgaagccttgggttcgatggccctgtcataccctaa

SEQ ID NO: 21345 - DNA, 315 bp, Glycine max
  Peptide Sequence Number=SeqID_113030
atgagaggatggccaaatttgagaaatacatggagatgcgacaagggaagaaggaggaaccacttatttaaaactcacatgggacgtgctacatcaagtaggacccacaagacatttggaggacaagggataggaggactagagtctacacacttagagagggcaagaaacaaatgttctaatacatcaaggcattggagattttctcaacaaatcagctcaccaacaacatcatacaacaccttgacaatccacatgccacgtcaagctattgatgttaagaagcacttactaggaggcaacctaacattctaa

SEQ ID NO: 21346 - DNA, 577 bp, Glycine max
  Peptide Sequence Number=SeqID_113031
cattcacgtggctcaattgattgctgatgccatttatctatttgcaggtatggcgccgaccaggcaccctttggacccggataagtccaatagggccctgggatttcccgcattgatcacaggactttgtcagtcattcggagtcctcgtcgcacctagcaaggtgattcggccacccatcacccgggcttttattgagaagtattgcacgcagaggccggcccagggtgatgcaccacaggccgcagacgcgccgccacctcatcaggctggcccagctgagtcatttgattcggagcagtatttacggcatttggttcgccagcaggcggccaaccaccgggtgcacgtacagacccatgactgtctttaccagccgagccttagcctgcagagccagggttttacttcttttccatgccctactccggatcagttcagggcagaggtcgcatggcccggagattggcctgaggcccaagcaggggaggcacccgtagaggctcccgatgaggcccgcgaggacgaggagatgaccgatttgcttgatttcttgggagggagcggagccacatga

SEQ ID NO: 21347 - DNA, 252 bp, Glycine max
  Peptide Sequence Number=SeqID_113032
aaaaatgctaggtcaattttcagactgactcctcagccgcctccttcgcctctcaatttcgttttcccttctcaacctctcttttctcgcagaccaccaaacatgtctcagaaaaacgatgatctcggacacattcaccgttggatcgttgtgaaatttaagcaccaggttcgcaacccaattccgagaattctcactattgtgaattttaaaatcatgtctgagcttagaggaaaacccttcgcattgtag

SEQ ID NO: 21348 - DNA, 395 bp, Glycine max
  Peptide Sequence Number=SeqID_113033
atgtcgatggattacgacgaagaagattgtgaagaagatatagaccggagagggttatgcgccagttcggctacgtctagtgcattcctgcacaccctgtccattcatgggtgtcatatgatgacgtggatgatacttggacgcattactcagaccatctggcggcagcaagtgatctatgtgttatgccagcccaatcatatccctcatgaggcaacaccggcatcgacacatgcggatcttgatgcggacgaacccagacatgtagtggaggcttgccatgcgatcgcggaggcgttggagcagcatctaaatgcgccaggcacatccacacatgaagaggtcatccaaaaatgtctcaggattgccaaaggtgtcacagaagaccgcaatgt

SEQ ID NO: 21349 - DNA, 240 bp, Glycine max
  Peptide Sequence Number=SeqID_113034
atgaccggacgccttcttgccggttcattggctttgaaagccgcatcctgcattatctcattgtgcgtattttgcttccacgatcttccaaccttgcccagatcctttttaattggtgctgctgtgattgcttcttttggttaccgcaaagagcatgatggctcttgggtcaaaaagggtgctcaacccgctgatgatgaaggcaacctaccagttgaagataattcctctcttctttga

SEQ ID NO: 21350 - DNA, 273 bp, Glycine max
  Peptide Sequence Number=SeqID_113035
atggattatgtaatccgcaaggctccgtacattacagaaagaaaacaggatcggtacgaaatcgtaagtttccgtactttacgaaaaagatcaccaaaaaaggcagggggtgtacttagtaaaaatgggaggcaaatagcaaccaggcccacttgggccctccagaagattcctccagaaggctgttgcttctggaggaagcaaccttgctcgcctgggcgagctgggtggcaagcttctcccccaattttctataaatatggggagaagtga

SEQ ID NO: 21351 - DNA, 893 bp, Glycine max
  Peptide Sequence Number=SeqID_113036
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggaggatgagcgctggcaagctgcgcaactgttgggaagggcgatcggtgcgggcctcttcgctattacgccagctggcgaaagggggatgtgctgcaaggcgattaagttgggtaacgccagggttttcccagaattcgatagtaatatattcggaaaagtggataacaagggaaacagtgcattgcacttggcagccaaacttggagactataaaccttggctaattcctggcgaagctcttcaaatgcattgggaaatcaagtggtacctggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 21352 - DNA, 495 bp, Glycine max
  Peptide Sequence Number=SeqID_113037
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctcatcctccggcggtgcttttgccgttacgcaccaccccgtcagtagctgaacaggagggacagctgatagaaacagaagccactggagcacctcaaaaacaccatcatacactaaatcagtaa

SEQ ID NO: 21353 - DNA, 213 bp, Glycine max
  Peptide Sequence Number=SeqID_113038
atggggacccccaagggtacagagaatgaattaaaaagtttgatttcgggaacttaccagttaaagaccgaagaacgacgaagaacgaacaacgaacgacaaagaacggttgaaaatcttcgcgaaatcacccacggaaatgttacgaaagcgcctcggctaggattttcttcgccgaaacaattttcctcattaattttaagtgattactaa

SEQ ID NO: 21354 - DNA, 339 bp, Glycine max
  Peptide Sequence Number=SeqID_113039
atgaagagtatgaagtacctgttgttctcatgtgatagcgtcctcattggtccacaaacgtccatatgtatcagttccaatagatctttcactctccaagctccgcttgttgagaaaggaaatcggtgttgcttaccaaggagacatccttcacacacttcattgttctcctttatgcttggaagatctctcatcatgttcttctcatgtaacaacttcaaggcatcgagcgaagcgaggctcacgggtgcgctttccaaaggaggaagatgcacggagtctccaccaacgtttattgtggaaaacgtcggaaaaaccaaaggaaaccggtcgaaataa

SEQ ID NO: 21355 - DNA, 720 bp, Glycine max
  Peptide Sequence Number=SeqID_113040
atgctggataagcgcgtcgatggcatcatcgtcgcgccgtgcagctcattgtttgaggataacgagcatcttcgccaggtgctggcagaagggcgttcattaatgatgttcgaccgggcagtgcaggggatggaggtggagactatccaggcgaactttgtcgcagtggccaaacaggcgacggagctgttactggcggccgggcatcagcgaattgcttatctctccagcatgcgcagcgctgcaccgtattcgccgtcaatcacgctgggccccacaccggtggcgcaacgtgttagcggaatgattgatgcctaccgggccgcgggtaaggaactggatccggcgctgattcggcttaatgcgctcagcgaagccatcattgagcagatcctgactgaactgctggcgctcgccgaaccgcccagcgcgctgattgcctccgataacctgattgcgatgggcatcctgcgcggtctggccaaacgcggcctgcgcgtacccgaagatatctcttttgtgatgtacgacgattttccctggaccgagctgatgtcaccgccgctgaccgtggtcgcccagccggtgtatgaaatggggcgcgaagccgcgcgccggttgatttgccacatccgccagcaatccgccggcgccttacccgcgtttgacagctggatggtggtgcgcggttcggtgggggaaaacccgtcggcccggtga

SEQ ID NO: 21356 - DNA, 285 bp, Glycine max
  Peptide Sequence Number=SeqID_113041
atggtgacaccgccaaggtcccctccgcagtcagatggtaattcggagccacaacctaagaagacacgacaaagcacacgtcttagaaggttgactttaagaagattagatcagcctagaccaatagttaatgtggatcctgcaactggaagagcatcaggcccagagaagcaaaagttccacagttttttaggggttgtagctcgagaaaagatccccattgtccacagcaattggaaaaatgtgccagaaactcttaaggacatggtatggggggacattttg

SEQ ID NO: 21357 - DNA, 591 bp, Glycine max
  Peptide Sequence Number=SeqID_113042
atgaaaagagaaaaatatgcctcctatagtagtcataactcttgcaagagcctaagtgaagaacttcgtgactattatgaaggaaggcataggtcacatcttagacctcactcccatagaagagaaaaggaaagaaagcctcaagaggctaacattaacctcacatacttccatgggaagaacaatgtagaggctaacttagtttgggaaataagggtagagcaacaacttaaaaagaagtctacatcaaaatcttatgggtctcactcttacccaaagaaagaccaaggtcgaggcatcttaggggtgacactttctaagcccaaagatgataaggggaagacaacagaaaagcaagtccctaaggttagtatgcaagagaaaactagctctataaagtgctttaaatgtcttggaagaggatacattacttctcaatgccccaccacaaaaaccatgattatgaggggccaagacatttatagtagccaagataaggctactacttcaccttcctttagtgaaagtgaaaaagcaaaaggggaagaatctagtgaagaaatgtaccccaagaagaaggacaacaattag

SEQ ID NO: 21358 - DNA, 63 bp, Glycine max
  Peptide Sequence Number=SeqID_113043
atggagttgcccactgctttgccagagaataacaattgtttgaccacaacaatgctggaggcg

SEQ ID NO: 21359 - DNA, 512 bp, Glycine max
  Peptide Sequence Number=SeqID_113044
atctactccaggagaattagtaatgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgttgtaggaattgctaagagtaaaattcgggaaaaagaaccgattgtatgggaaatacttcaagaagttatgcagggacatcccgtattgctgaatagagcgccgactctgcatagattagactttgatggggatcaaatggctgttcatgtgcctttatctttagaagctcaagcagaagctcgtttacttatgttttctcatacgaacctcctgtctccggctattggggatcctatttccgtaccaactcaagatatgcttattggactttacatattaacgagcgggaatcgtcgag

SEQ ID NO: 21360 - DNA, 147 bp, Glycine max
  Peptide Sequence Number=SeqID_113045
atggtcaaataccacgtcaaatccaagacagagatgaatcgaggtgctcggggacgggtacgaatggacactaggcccgtggtcaacaaatcgttgtcccgcgtctggctccatacgatcgagaagcgctatgtggaggcagcctag

SEQ ID NO: 21361 - DNA, 649 bp, Glycine max
  Peptide Sequence Number=SeqID_113046
atggccgagagaaattcccgaggagcattgtggggtagcaacagtgagctcaagctccgaagagaggaaagagaccggtcacgggtgcatggcatgatcttaaaagaagagttagctgtgtgcgcaagatccaagaggagtttggctcaacacttggaagccacggagcaaagcatgctagctattatagggcaatacaaggaagagttgaaccagtctgtggcccatgaacaaaagctagtggaggattttgcacaagtgtacgccgaaaaagaagcaagagggaggggccctgatgatgcattgcatcaagaagcgactatgtggatggataggttcgccttgaccttgaatggaagtcaagacctcccgcgtctattagctaaagcaaaagccatggccgaagaacagatgaaggccgatctatcggccttaaaagatcaaatggcttccatctcggaggtcatgttaaaactccagaaaactatagaggataaagccacggcaaccgcctccaatacagttagggaagcggagccggtgctgcagcccgccttaaatccgagccgagacagaaacacggcaatgtttggtcgaaggtatagcccgcaagcttatccttatggcttgccttcggacttcactcccc

SEQ ID NO: 21362 - DNA, 306 bp, Glycine max
  Peptide Sequence Number=SeqID_113047
atggccaaaatgcaaggtccaaaagatggaaaaatctattctaatattaacaaagaagagaggacccaaccttggtccgtgggctcagaaatctaccctgggattcataagaaccccaaggccttctttagcagctctagccaaatcctcttggagtcttttatccaatacccttgcggggtaggattgcatcaatacgtacgcctatggtggctacaagatatttatcaaactcgtgcctatctgctgcatttgttaggttacactcattttgctaacaagagtgcaacacattttcatgtttga

SEQ ID NO: 21363 - DNA, 609 bp, Glycine max
  Peptide Sequence Number=SeqID_113048
atgtcgcaagaacaatcagttccgtttgctgggaagtggcaccactttacagtcaggactgatggagaaaaggtggttccagaaccacatggtgacgccgaacaaacagaagcctgggaatcagaggtgatgatccctttcgcagtggaaagaacagtttacgctttcggtggacccctgccagaccaagaatcactttcgagtgcaatgaacaaggtatttccctgctacccaacttgcgaacctaggatttttgatagtgagccttacaactttaattgtttaagcaaaccccacaaactctttcgatccgccccgtcaatagcccatagggattacctaccttggcttgatcgagtcgaacaagcgtatgaggatttctggaagacatatggcatctttgatttgatacaattctctcgatctggtcctgaatatcgaccagaaatgctgatagcagctatgcactttttcgagtcttctaccaacacctttcaatttaaatgtggtatgatgacccccactctcttagatgtagccgccctcacaggccttaggcctagcggagaaacttatgaccccactaattctagtgacaatatcaagcta

SEQ ID NO: 21364 - DNA, 315 bp, Glycine max
  Peptide Sequence Number=SeqID_113049
atgaaacaaaaaccccccacacttattcccaaaacaattccaaagctccaaaattccttaaggatatggaaatatcatggtttttcacttaaggcttgtagtgagcttcaaaacaaggaaagggaaacaaggctgaaaagggctatcaaaggaattaattcaaggacgcatcaacaagaatcaagccaaggctattgtgcaagcaatcaatggggcaaaacacaccaaatgattataatgatggacggctcaaattctcacaaaggtaaaatcatcactttcaaattgagctttcaaaactatcatgacatgtag

SEQ ID NO: 21365 - DNA, 159 bp, Glycine max
  Peptide Sequence Number=SeqID_113050
atgtgtaactgtgtaatcgattaccaagaggctgtaatcgattaccaatcgatggtagtggaatggagatggaagaaagatgattggagacactacttcaaggagaagatgattcaagaagaagctcaccactataggaagtcatggataagagcttga

SEQ ID NO: 21366 - DNA, 382 bp, Glycine max
  Peptide Sequence Number=SeqID_113051
atggctcacaacaacattttgaatatcacgaatcccagcatggtctatgctgcctctggtcaacacgacttaaaagtggcatctgaggaaatgggccaacagacatgtggcccaactctttctgccacaaaggtttatgtgagaagaaaggaggtgttgaggggtaatagcaaggcccagcagtttgagaaatcaattgtggacttcaacctagcctctaaaattgaccctctgccttcattacacgaggactctatagagctgcaatgtgcccttttgaaggaaatgggattgacttatggggaagatgataacaaggctgctggtggcctattatgtttgtggaataactccatttttgaggtggataggagggagaaag

SEQ ID NO: 21367 - DNA, 315 bp, Glycine max
  Peptide Sequence Number=SeqID_113052
tgatcccaatgcaaggatgtttcaaagagtccgtaaagcatggagtgcggtgcaaagaaaggataaggagcttaggggaagcagcaatgggatcatcggtggctaccacaagtggctgaaggctagaacacaagagataacttggctcccgaagctaaagatctcaagtgaggaagaggttgaaacccctgaggatagtgaagaggtgcaagccttgaagggcagcaacagcgagctcaagcttcgaagggccgagagagaccagtcgagagtcaagggcatgatattaaaggacaagttgaaggcttgtccaag

SEQ ID NO: 21368 - DNA, 240 bp, Glycine max
  Peptide Sequence Number=SeqID_113053
atgacagacgtgatccataatcagtggcatctgatttattctatgcattataagaagatatttcctaataaaggccatccgccacaattgctccctggcaagggtcgctcccgagcagcagagccacctcaaggggaggctatgcatcaagttttgttggtttaccacttctgctataggattttaatggtctataacgatggaggcttcttcctattttctcttacgtgcttggaatag

SEQ ID NO: 21369 - DNA, 279 bp, Glycine max
  Peptide Sequence Number=SeqID_113054
atgccaatgttggatcaatttcatctcttcattcacgattccattgaaaacattgtcaatgtcaaagctaacggtatgggtgaagattcatggttgttggtgcacaaccatttgcttaaagaacttgacaaatggtctgatgagtatatcaacctccttggtagcatagacaaatttgagaaattaaagaggtccctacttgttgatggattatccatagttactatggataagtggatggatatgagacatgagataagtcattgcatcaaggtataa

SEQ ID NO: 21370 - DNA, 417 bp, Glycine max
  Peptide Sequence Number=SeqID_113055
atgaccatgattacgccaagctcgaaattaaccctcactaaagggaacaaaagctgcccgggggatccactagttctagagcggccgccaccgcggtggagctccaattcgccctatagtgagtcgtataacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 21371 - DNA, 149 bp, Glycine max
  Peptide Sequence Number=SeqID_113056
gctgctccacattagaaggggcatgtgccggtgctgctgctggtgccactgggaccttagggatatgtggctccacatatgtgtcatcctacgtcataggtggatgtctggccggatcagcaggctgtgccggtgtcatgaatggatga

SEQ ID NO: 21372 - DNA, 285 bp, Glycine max
  Peptide Sequence Number=SeqID_113057
atgaaaggaaaccaacaaagggtcccagtggagtcgccaactgtcgcaacctacccttcggcgggagggcgacgcgtgactcgcgggatgcgtgttccacgaaaggaatacgcgcggagtcgccaccaatgtttattcgaggaaaacgtcggaaaaaccggaaaagacgcgatctacgaactttttagtgaaaggttcgggagttgtatttacgcacggggaagggtgtttccctttgctcctacgtgttcctcaatttgtgatgaggaaatcagacctacgtag

SEQ ID NO: 21373 - DNA, 255 bp, Glycine max
  Peptide Sequence Number=SeqID_113058
atgaccatccagaatatgcaatttcagcaagagacaagagcctccattcagagtctgacaaatcagatggggcagatggctactcagttaaaccaagctcagtcccaaaattctgacaaattgccttcacaaactgtgcaaaatctgaaaaattgcctccaccagtgggcagcacctacacctgaacctatcaagcgtcattctacacctgaaaaagaggatgagatagttgcactaaagagaaatcttccttaa

SEQ ID NO: 21374 - DNA, 147 bp, Glycine max
  Peptide Sequence Number=SeqID_113059
atgagttcaacccagtggtcaggccattttgttgcttttactggtaagagtttttttccaacccaacttggcccaaacctatggtactatatgcaagagtcaaagggaaatgaaggggcaaaggaactttggcatgagccttggtaa

SEQ ID NO: 21375 - DNA, 654 bp, Glycine max
  Peptide Sequence Number=SeqID_113060
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatttggactcgattgtctctagatagcaaaggtgtggataaccgtgaggtgtctctgcatgctatcggacttgattgtctttggatagaaaagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 21376 - DNA, 581 bp, Glycine max
  Peptide Sequence Number=SeqID_113061
cctaagtgaagaacttcgtgactattacgaaggaaggcataggtcacatcttagacctcactcccatagaagagaaaaggaaagaaagcctcaagaggctaacattaacctctcatacttccatgggaaggacaatgtagaggctaacttagattgggaaataagggtagagcaacaacttaaaaataagtctacttcaaaatcttatggctctcactcttatccaaagaaagaccaaggtcaaggcctcttaggggtgacaccttctaagcccaaagatgataaggggaagacaatagaaaagcaagcccctaaggctaacatttatagaagccaagatgaggctactacttcaccttcctctagtgacagtgaaaaagcaaaaggggaagaatctagtgaagaaatctacccccaagaagaaggacaaccattagtggttaaagagaagtgtaaggaggcacttgctagcattgccacacctcttgggcttgagtttattcctcaagtaaagaagttgttggatgagggtttggttcacaagagcttaaatccttgtgctttgttggtgcccaaaatag

SEQ ID NO: 21377 - DNA, 204 bp, Glycine max
  Peptide Sequence Number=SeqID_113062
atgaatattgaggaatccattcatgttacctttgatgaatctaatgctatcttgtcaagaaagaatatgctagatgatattgcagaatctttagaacaaatgcatattcatggacaagattctaaaggaaaagattatttcgcacctaaggaatccctcaacgaagaaggtatagattatgaggaaacatatagctccagttga

SEQ ID NO: 21378 - DNA, 693 bp, Glycine max
  Peptide Sequence Number=SeqID_113063
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgacaaatgttcatgatctgaccgttgcaatctgcgatatgtcttttgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggagatgccaggaagatacttaa

SEQ ID NO: 21379 - DNA, 474 bp, Glycine max
  Peptide Sequence Number=SeqID_113064
atgaccatgattacgccaagctcgaaattaaccctcactaaagggaacaaaagctggtttcctctcatctcaaaacaacttcttcctaggaaggacttatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 21380 - DNA, 654 bp, Glycine max
  Peptide Sequence Number=SeqID_113065
ggacaccaggatttatttttctgcgaagtgatctccgtcacaggtatttattcggcgcaaagtgcgtcggctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttagaagttggtcaccgtaaagcattgagtgatatcttaaccgcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtgacacgagaaaaaaggctgcaccggtgcgtcagcagaatatgtgatacaggatatagtccgcttcctcgctcactgactcgctacgctcggtcgttcgactgcgcgagcggaaatggctga

SEQ ID NO: 21381 - DNA, 265 bp, Glycine max
  Peptide Sequence Number=SeqID_113066
gaaaataggggaggagcttgccagccagtttgcccaggcgagccaggttgcttcctccaaaagcaaccgccttctagaggaacatcctggaaggcccaagtgggcctggatccacgatgtcggatacaatgtccaggacatcctgcccgaaaatactggagttgttgcacaatgcacaaggcaagataaaagaattgaagctgcaggatccacgatgtcggatacgatgtccaggacatcttgcccgaaaatactggacacataa

SEQ ID NO: 21382 - DNA, 565 bp, Glycine max
  Peptide Sequence Number=SeqID_113067
atggcacaacctccaccccgtgagaggactctaagggaaatggctgcacctgatttcacctacgaaagcttgtgcatccaataccctgatgaggatgtcccatatgttcttaaaactggactgattcatttgcttccaaagtttcatgcccttagggagtggcaaaggactgggctgtattaccttgctccaaggtccatcacgagctgggatgaccttaagagagtattcttagaaaaaattttccctgctcccaggaccacagccatcaggaaggatatctccagtaatatggagagaagtatgatagatgctgccagtggtggagcccttggagacatgactcctactgaagccagaaatttaattgagaagatggcctccaactcccagcagtttagtgccagaaatgatgccatagtcattagaggagtgcatgaggtagctacaaacccatctgcatcatctgaaactaagaagcttgaaggcaaactggatgcgttggtcaacttggtaacccagctggccttgaatcagaaatttgtacctgtcgcaagggtttgtg

SEQ ID NO: 21383 - DNA, 680 bp, Glycine max
  Peptide Sequence Number=SeqID_113068
tttcgcacctttttcgccaagaggtgaggcatgcttccccgttagaaagctaccgttcatgcacagagaaaggaggggcgaattgggaccaactcttagcaagcaaagaaggagcatctgtcaactggttccctcaatggaaggaaggaagaaccgaagttcttatttcatgtggaggatttccaaatgttcccttgatggggacgaggggttgcatcagctacaatctcgttcttgctataagacaacttggctatcctatgagaggggcaccactagaggaagagatcgtacctgtcatttcaggaggtttcaataagaccaacgtggagacacttcagaaggtccgcaaggcatgggaggtgttgcaaaataaggacaaggaacttagggggagtaacaatgggcccatcggtggctatcgtaagtggttaaaagcccacatgcaaggtttggattggctcccgagtctgagaaccgctaagagggaggaagatgaggcaccggaggaagatgaagaggtgcaggcccttaggatggaactcaagcaagctcaaacagtcaaagaaaggttcaaatcagcagctcttaaaatccgaaaggaagaatgccgaactgagagatataaatatagctaccaccaaggctttgggaacaagagaccaagaggggctcgttag

SEQ ID NO: 21384 - DNA, 324 bp, Glycine max
  Peptide Sequence Number=SeqID_113069
gttaagcgtgccctgtgtgctaagcctaagggtcattctgatgaggctgagctaagtgcgccatgctacgctaagcccagaccctcttctattttgaaaattatgcatcaaagaagagaaaggcacctgccacaccttcctaggtccgatatgaccgatcctggttcacttctcctgattcatatctctccagcacttatatttgaagacataatgccatcaacaccagccatggagccagagaagcccattcttcaggatacaccagctgctccagtgctggatttaaatgaagatcagccacaggatgagcaggatgtttaa

SEQ ID NO: 21385 - DNA, 264 bp, Glycine max
  Peptide Sequence Number=SeqID_113070
atgcaaagcgaagaacctaccagggctgacatgcgcgatcctctgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 21386 - DNA, 741 bp, Glycine max
  Peptide Sequence Number=SeqID_113071
atggcacgtattgatgacaagataaaatccattgatggatctaaagaaactctgaaacttgctgtaaggataaccaagctctggtttgttgggacgccgggtaggtctgaacaagctgagatgatcatcgttgactctgatccgttagttagatatttttatgattcacagggtgatcaaatccatgtggtctgtaagcaagaccagttaaagacatggaaaatggatttgaaggaaggttgtacttatgtgatgcacaattttagagtcagcaagaatgatggacagtacagagtttgtgatcatccatataaattgacatttattgaagttacagttgtcagacaatgtgaattggatgggcttccttttaaaaattatagatttgcagatttttcggatgtcgttgctagccaattacagtctggcctattagtagacatcattggtgtggttgacgaggttgtctttcgtcatatttcatccagaagtaaaagagttgtttttaagcttatgaatttgagtaaccaattgttgtcttgcactctatgggatgatcattgtctccaatttttggaatatttggatcagcatgagactgaaagacctattattgtgttgttgaccaatgccagaattaaagagggccagggatcctatccatcctcggttagcaattctttgaaggcttctaaattgactattaatcagccagtggcaccaattgaagaattcaattag

SEQ ID NO: 21387 - DNA, 393 bp, Glycine max
  Peptide Sequence Number=SeqID_113072
gtgagggcaaagaaggctcttctgggggggccagagccatcagtgagataccactctggaagagctagaattctaacctttgtgccaggactacgggccgagggacagtctcaggtgccgaaagaggttaatcggttcaggacgcaaggtgcccctgctttttcgggaaaagctcgaagacttcaggacgaaatcgggtaccttgtcgaaaccgacggtgccgaggtagagaaccgggccgtcgccagacggataaaagttactctagggataatcaggcaaaatgcttccccaagagctcactcgacgggaaggtttggcacctcgatgtcggctcttcgccacctaggggctgtagtgatgttccaagggttggcgctgttcgcccattaa

SEQ ID NO: 21388 - DNA, 549 bp, Glycine max
  Peptide Sequence Number=SeqID_113073
aattcaacctgcgatgctgggataataagagctttcaagatgcattaccgtagaaggttttaccgcaaaatattggaaggttatgaggtgggacaatctgatccagggaagataaatgtccttgatgctatcaatttggcaatcccagcttggacgatagatgttcgaaaagaaacaatagagaattgctttcaacactgtaaaattcgttcaactagtgacgttgcaagaaatttggatgaatccacttttgatgaagaaactcaagacttcgagactatgatcaatcaatggggctatcgtaataagatggatatcgacaatctaatgaactacccaggtgaaaatgaagcatgtttggaggttcagagtttagaagatatcgtgggtactatcattgagaacaatgcagaggatgacaacgaagatgatacgatgtctttggagcctgttacgcgaaatgaagcacttatggcgtcgaacactcttcacaactttatgatacaatacaaaaatacaacacctgagctattggatgcaataagaaaa

SEQ ID NO: 21389 - DNA, 498 bp, Glycine max
  Peptide Sequence Number=SeqID_113074
atggaaacctgtcccgcggtagaggaattgcttcagcggctcatggattgcgggcagcttgaagtatccataggagggagggaagaaccacatatttgcatgcagtcggaagagaagaaggttcctttaacccccaaggccatagtaatatgttttactaggaaagggaccggctccacacccatatacccgcgggcggcgcccaagctgacgccatttgcatatcaaagtaataaggccgttccgtggaagtatacccctcccgcgtccagcgaaagaattgcaaccgaagttgactccttatcagctaaggtaaccaacatcaccggcctcagtggcgtaacccgcagtggtcgggtgttcgcttcccctcacccggaggaattgccctctaaagggaaagcgcctatggtccaagagcccacagacatagccaccccctcgaaagaagtagaccctccagtggtaagaggacgaacaccttatcaatctgtgtaa

SEQ ID NO: 21390 - DNA, 770 bp, Glycine max
  Peptide Sequence Number=SeqID_113075
gtcctcgtgtcagcacaaaggagagttatgttgatccctcagggaacgatcctgagacgggtgactcagacaagtgcaggttatacatcgaagcaaatcctccccgcccagttgccctgggaagagtttatgagggatcaacagttcacaacattcctttgttgtctagccaagtgaaggttggtgttgaggaggttagagatgcacaggctctcgttcctgtatccactgatgaggttaccttagtggggcaggcacttaacaccttccttgcttggctgacacatctcgtgaagcctttatcagaacaggcagcagtttctctagcaaaacctccacaaaggctggatcctgaggtcgatgatcaactatatctgatgacattgaccatcccagatcttgaagcctttccagacttcccgctgtacataaagcacgaagatctctctgaaatcacacacggtggtcaatgtctcagcatatctgtcttacagttgtggattctatctgggcaatcacagtttgacactgaaagttacatcaagagttggatgcagagttcaaaacgcgatgtctaccttggagcctacttaaatggacactggcaaatggtggtcattctccccaaggaaaaccttgttgtctggttttgttccttgcataacaggccagacaactaccttaagggaataactaacagtacattgaaaggacttgatgacactccacagcctaaatccaaggctgctgctaggtggattgttgttaag

SEQ ID NO: 21391 - DNA, 297 bp, Glycine max
  Peptide Sequence Number=SeqID_113076
gaattctacgccaacctctatgacctcaaggacaaatcacctaagcaggagttggctgctaagctctgtatcccagggaggggattcgagcttaatgctgatgagcagcccttgaagattttgaggaagaacatgaccaccttagctcagacatggagtgttctttccttctctaactcgattcccacctcccacacttctgatgtcactcttgacagggacaaactcatttatggtatcattatgaagatggacatgaatgtggggtacacatacaattcaggaggaggaggctag

SEQ ID NO: 21392 - DNA, 394 bp, Glycine max
  Peptide Sequence Number=SeqID_113077
tttagaatttattttcttcttgaattgcttaactgttgttcctgttagtgtatgcacgcgtagatcttctgtaggtgaattggttccattggatttagaaattgaagccacctttagaagaaataacgcagagagaaaaagaaagcttttgcacgacagaacagtagcatcaatccttgaagaggctcacttttctgagtcatcatcttctaattcatctacatccagggaatctcaaacagcagaatttgaagtcgaagtcatggctgaagagcaacctcgtcgagtgaccttggaagattactcaagtactttcgtgccacaatatttcttaagtgttgcacagccagaggttcaggcacaaaacttaacttacccaccttcattgatatag

SEQ ID NO: 21393 - DNA, 399 bp, Glycine max
  Peptide Sequence Number=SeqID_113078
atggtcatcatttccgggcgagccctcggctgcgccatgaacatctcgaacgcagcgggattgaggcagggcagacggtcgccatcatcgcttgccgcccgccgcggggcacgggtcattgccatatcgcggcggcctttttcgctggaagtagcgcaccggatgggcgcgactgagcttgtcgagatggatgatcactggcgcatcattgaatgtgtcaggcagttgactgacgggcgcttctgcgatcgtgtcatcgaagcggtgggcaaacagtggccgcttgatctcgcaggcgaactgacggccgaacgcggccggttgatccccctctcccggctatcaccaggacgggcccccccagatcaatatgcaattgtggaactggcgcgggcttga

SEQ ID NO: 21394 - DNA, 324 bp, Glycine max
  Peptide Sequence Number=SeqID_113079
atgtgtaacacttgttgtaactttgatgtaccctctacttgtaccacaaaggatgtaccctccaatgtgttaagacaaagatctcaggcagttaaacctttgatactttgtgaatggggatacaaaagaattctcaggcggaagaagggagacacaaaagaattcaggcggttagtcctttattcttttggaaatgggagaagagagacacaaaaagaattcaagcggttagtccttggcaaattctttttggcaaagggagaagggaatgaaaagataaatagcacaagttttcaaggtttggaaaaccagaaaacttcataa

SEQ ID NO: 21395 - DNA, 396 bp, Glycine max
  Peptide Sequence Number=SeqID_113080
atgacttttaacgacgacattcaaagacggttattacttaataaagtaaagacacaacttttggaagaagcgatacagggggtcgtcttaaatcaccatggtcacgcaggaaaagaaaacatgtccttacacctcagcaatggaaaagcgtgtttacccaggatggggggtgttgatcctagtatcagagctgaagtttggccattcctacttggagtctatgacttggacagtacaaaagaagaaagagatgctataacaactcaaaatagaaaggagtatgagaaactccgcagacaatgccgccaactactaaagcacagcaatgggagctttaagttaaatgaaataggtgaaatcaactatgaaggagatagtgcaagttttatcatgtga

SEQ ID NO: 21396 - DNA, 375 bp, Glycine max
  Peptide Sequence Number=SeqID_113081
atgacgaaactggcaaccctcttcctgactgccactctcactctggcaagcggcagcgtccttgccgctgaaacgggcacctcagataacaacggtgatgccaatgcggcggcatcagcaggtcaggtcgcccctgatgcaaaacagaatatcgccccgaataatgtcgataacaaccagattaataccggcaacaccaataccgggggcaccatgttgcacccgaacggtagtggttccggtaccatgaatcatgacaacatgagttcgcctgaagttcataagaactcgatgtgtaaagacggcaaatgcccggatcccaacgacaaagtgggtaatgacgccaataccaaaaccgatggcacgacccagtaa

SEQ ID NO: 21397 - DNA, 279 bp, Glycine max
  Peptide Sequence Number=SeqID_113082
atggcgcctcctctcacctcttctcctttgtcttccgctgcatctccatggggtgtgcaaatagcaattaggcccacttgggccttccaggatgttccaatagaaggcggtgccttctggtggaagcaacccagcttgcctgggcgagctgggtggcaaccaccgccaaaatccaagccgaggcgcttccgtaacgcttccgagacgtttccgtgggtgatttcgcgaaggttttccaccgttcttcatcgttcttcgtcggtctttggtcttcaaccg

SEQ ID NO: 21398 - DNA, 207 bp, Glycine max
  Peptide Sequence Number=SeqID_113083
atggaaaaagaaaaacatgcctcctatagtagtcatgacttttgcaagaccctaagtgaagaacttagtgactattatagaggaagacataggtcacatcctagacgtcactcccataggagagaaaaggaaagaaaacctgaagaggctaacattaacctcccatacttccatgggaaggacaatgtagaggcttatttagattga

SEQ ID NO: 21399 - DNA, 306 bp, Glycine max
  Peptide Sequence Number=SeqID_113084
atgcatattgttgtggtaaaacaggggcaggatcaccttgggctaccttctgagatagagacaaaacgtgagcggcaaaaaccaatcaaggtagggtacttaaggacggatgcaagtggggatggggtcacgaccgaccgatcgttgccccttctcagtgcgaaacaagcagagaatgtcgctgcaaggcagccccgtatcctttgtattttgcagctttcttttactatttgtttgtttaaaaaagttagctcgcctgggcgagctgggctcgcctgggcgagccacccctgcaccaaattataa

SEQ ID NO: 21400 - DNA, 228 bp, Glycine max
  Peptide Sequence Number=SeqID_113085
atggctcaagccttgacgtgtgttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgctttcatgtggcaggagaaaaaaggctgcaccg

SEQ ID NO: 21401 - DNA, 939 bp, Glycine max
  Peptide Sequence Number=SeqID_113086
atgcaatccttcctcaaggtgtatggaaagattttagatttgacaatagcagagatatccacggaagccgttgtatcactcacccaatactatgaccagcctttgagatgcttcacgtttggagacttccaattagtaccgactgttgaagaatttgaggagattctaggatgtccttttgggggaaggaaatcgtatcttttctccgggtttcttccctccttgagcaagattgcagttgtggtcagggattcggcaagagaattggatcgggtaaagcaaactcgaaacggcatagtgggcctaccacggaagtacttagaaggcaaggcaagggatatggcgaatcaagaggagtgggtcccgtttatggatgtattagcattgttaatctttagggttgtcctctttccaaacatggatggtttggtggacctagccgtaattgatgctttccttgcatatcaccatagcaaagagagcccggtgagaagagtagattgggaccaacacttggctgggataggaggtagaacaatcaactggtttcctcgatggaaggaaggaaaggaggaagttttattctcatgtggggactacccaaacatcccattgataggaatgaggggttgcattaactacaatcccgcacttgctataagacagttagggtaccctatgaggggagcaccggcggaaaagagcctttctcatttccttgtgagagatttcggcgtgcaaagtttcaaggttatacaaagagtccataaggcgtgggaaggcccgttaaggaaagataaagaacttaagggtatccgtaatggcatcatcggtggttatcatgaatggctgaaagtttgtacacgaaggttagattggctcttcaagttgaaaattatcaatgaggagaacttcgaagctccggaagaggatggagaa

SEQ ID NO: 21402 - DNA, 264 bp, Glycine max
  Peptide Sequence Number=SeqID_113087
gttgaggaggagcctcagttgcttgttgtctttgttgtgactactgctgctgctgttgtattggaggaggaacatatggcttgcttggaccagcagcattctggaaaggagggacaggctgatgttgttgtggaggacttgcccatctcagattttgatgattccttcaacttggattgtatctgttgcttgaaaggtaataattattctgctgctgaggggattgctgcaaagaaggacagagaactgtatggtgatctgtag

SEQ ID NO: 21403 - DNA, 135 bp, Glycine max
  Peptide Sequence Number=SeqID_113088
atgttgattgatctgatgcgttcaatatttctcaggttaaataggcaactttggcaaaatgctgtttttcactctttcgctaagccaagctgctggcttagcgagaatttgctaagcgcaaccttcagtggctaa

SEQ ID NO: 21404 - DNA, 959 bp, Glycine max
  Peptide Sequence Number=SeqID_113089
atggcgagccaagagaagtggggcccgtttgcggatattttagctttgctgatttttggggttgtcctctttccgaacgttgacggtttggtagacttagccgccattgatgctttcctcgcatatcaccatagcaaggaaagtccagtggtggctatcttggcagatttgtttgacacctttgaccagaggtgtgagaaaaacagtgcgcagattgtctgttgtttacccgctctctgtgtgtggttgatttcacacctattccaacaagacatgagacactcgtgtccgcttcaaagctatcgctcatgcgccgaaaaaggaagagtcgattgggaccaacatttggctgggatagggggcagcgcgatcaattggtttcctcgttggaaggaaggcaaggaaggagttatcttctcatgtggggactaccctaatgttccactgatagggactaggggttgtgcgcaaggtctcaaggttatacaaagaatccacaaggcgtggaggagtccgttgaggaaagacaaggagcttaggggcatccgaaacggcgtcgttggaggttatcatggatggctaagaattcacacgcggggcttaggttggctctccaaattgaaagttgtcgatgaggagaaattcgaagctccggaggaagatgaagaagtccgagctctaaagttagagctagggaaggcgagactcgccaaggagaagttcaaatcagctgctacacacatccggaaggagtgcaccgagttacaagaggaaaacgcggccactgcaagacctcttgaacaagaaaccaaaagggcccgcaaggaggaacatggccgagaaaaattccgaggagcattgtggggtagcaacaatgagctcaagctccgaagagaggagagagatcggtcatgggtgcatggcatgatcttaaaagaagagttagttgcttgcgcgag

SEQ ID NO: 21405 - DNA, 538 bp, Glycine max
  Peptide Sequence Number=SeqID_113090
atgggatcaagtcaaaagccttcgcttaaaaaagggttctatcaagtcaaaatcaagagcttagaggtcaccagtttacgaaagttggggcaattaatgggtcaacttcaacagcaagccttcgcaaagcctatggacttccagctagtgccgactgtgaaagagtttgaagaaatcctgggatgcccactgggaggaaggaagccatatcttttctctgggttctatccctccacgacaagagttgccaaggtagtgaaaatctcagcacaagatttggaacgtgtaaagcaaaacagaaatggagtagtcagagtaccaaggaagtgtgtcctctttccaaatatggaagggttagtggacctagcagcgattgacgctttcctcacctttcatcatggcatggaaagcccggtcgtcgccattttggccatgcatgacacgttcgaccagagatgtgaaaagagcggcgcaagaattgtttgttgtacaccggctctctatgtgtggctggtttcgcacctttttctccaagaag

SEQ ID NO: 21406 - DNA, 339 bp, Glycine max
  Peptide Sequence Number=SeqID_113091
atgaaacaggccaaatacagtctaaaggcccaagtggagaaggacgaaggcccaagtggagaaggacaaagcccccgagtggagaaggatgaaggcccaaagtttctctccgggttcctggttgaaccaattatcagacttatcaaggtaatccttgtggcgtctacccagacttatcttccttcactggaagtggcgtctacccagacttatcttccttcaccggaagtggcgtctacccagacttatcttccttcgccggaagtggcgtctaccctgacttatcttccttcaccggaagtggcgtcatccaaaaactctatagcctgtatcaagtga

SEQ ID NO: 21407 - DNA, 309 bp, Glycine max
  Peptide Sequence Number=SeqID_113092
atgggggagacacatgaaatatcccaccacaacctagccaatttcgagcctcacctcggatatgccactgagggacaagcagttggtggtgtacccctgttaaacactttggagggccctcagtttcgcccacaaccacaacccttgcattttgcggtgggaagagcccctcctgcgatggctgaaaagggaaagttggatcagatagaggaaaggctaagggccattgaaggaggtggagattatgcctttgctgacatggaagatttgtgcctagtactcgacgtggtcattcctccgaagtttaag

SEQ ID NO: 21408 - DNA, 354 bp, Glycine max
  Peptide Sequence Number=SeqID_113093
atgtcgggccggatccagaggcagaaaccaatcaaggtacttaggggcggacgcaagtataggctaggatcacgatcgatagatcgtcgtcccatgcccagctctggacaagcggaaagcgcagctgggaggcagcctaggttggctcgcctgggcgagcacccctgcacctggaaacataaaaacgaaggagggggagtttctctcctccctcattcaaaaaacgcaaacacccacaggatttgcagatttttgcccctaggccaccatttttgcgctttttcttccattcttagtgtttttggtcactccatacaagggatggcctcaggcctaggttgtggtctgaaatga

SEQ ID NO: 21409 - DNA, 315 bp, Glycine max
  Peptide Sequence Number=SeqID_113094
atggagagggaaatgataacaatgatagcaaacacattaccggtgttgtactatcaaaagatggtgggttacatgccttcaagctttgtcgatttagttttcgtcggcgaaaggatcaaagtgggtttgagaagaggcaaatttgattatcctgctttgatgaataggaagcctagggcaaatggagagaataagaaagaggaagaaacccatgtcgtggttgccgttcctacatggccaaatttcccattagcccaacaatatcaatacttggccaatatcattcattctcattacccactgttcgaactctag

SEQ ID NO: 21410 - DNA, 489 bp, Glycine max
  Peptide Sequence Number=SeqID_113095
atggagcaagaaacgaatcaaacggaagataaagatggcgccaacgaggatatgggactaccttcccccagaattagaaaggatgtcgcccatgatggactcaagaaatgccggggcaacttatcaacgaagaagccagaactagtagactttggaattccagtgaaaaagggaaatatgcccggtttgagttctgacattgtacagcccgattaccttaaatcccgagtgtttccccgaagtccgaagaagaaatttccagacgcttggtttttggccgtcgctcggtatccagaatgtgaggttgccaagcatctgtaccggtccctaagaaagatcgctggaaagtacgaatgctgtgtggattatcgggacctgaatcgggcagtcccaaggacaattttctttgccaccacatcgataggcctcctcgttggatacatgacaatcttggacgagtcaatggggttatgtcctggggcatcatga

SEQ ID NO: 21411 - DNA, 519 bp, Glycine max
  Peptide Sequence Number=SeqID_113096
atgtcgatggcctcttccttccttttgcttggaggttcatacctccacgggactgcgtggccgtttcggtatggaaacagaataggtttaactatcgaggggtatcggggcgtttggggagctgcgtctttggtgaaatataccaccaaaggcttaggccttccaaaacttctctcatctacggactacatacatatatgttgctcttccctcccctcatcgccgacttccagtcggcctcgatctatcatctgttgcaacaggcttagacctgcgtggcctacacgactcgacgacattaattgttccccctccatgattggcgagcggagtggcccggggttttcccacggtatgcgcaagttacgtcagggttataccactttaggaaatgaggttggtagatcttcccgggagatatcacagtcatttgattggcgaccatgggaggggccacttatgctgccaggtccctccaccgctgggcatactcttaaaggtctcaccttcctttcttaa

SEQ ID NO: 21412 - DNA, 261 bp, Glycine max
  Peptide Sequence Number=SeqID_113097
atggtcattcggcgccttgtgtcacccgaggggaacgaattcgacagtatcaggatgatgtgtcggtactgtcataccctaatttcgtccggggaccatctgttgttgggatgcgaccctcttttgaccacttcgagaaaatccaagccgaggcgcttctataacgtttccgtggctgattttgcgaagattttcaaccgttcttcgtcgttcgttgttccttcttcgtcgttcttcggtcttcaaccggggatcctctag

SEQ ID NO: 21413 - DNA, 558 bp, Glycine max
  Peptide Sequence Number=SeqID_113098
atgggatcaagtcaaaagccttcgcttaaaaagaggttctatcaagtcaaaatcaagagcttagaggtcactagtttaggagagttggggcaattaatgggtcaacttcaacgagttggaagaaatcctgggttgcccactgggaggaaggaagccatatcttttctctgggttctatccctccacgacaagagttgccaaggtggtgaaaatctcagcacaagagttggaccgtgtaaagcaaaacagaaatggggtggtcggaataccgagaaaatatttggagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctctttctccaagaaggtaggcccgtctatccgctacaaggttaccgctcgtgcgtcgaaaaaggaaaggcgaattgggaccaactcttggctagcatgggggggggcgtctgttaa

SEQ ID NO: 21414 - DNA, 396 bp, Glycine max
  Peptide Sequence Number=SeqID_113099
atggatatctgtgaagatactgacattcttgtaatattgggaaggccattcatgttgaccgcaagctgcatagttgatatgggtaggaggaagctggagttgggttttgaagatcagaaaattgattttgatttatttgatgaagacaagcctgctccaaaacaaaatgtttgcttacaggtaatggaaggaggacaagaggttctgacagaactgaaaaataacttagaaaacatttttttgaaaaacagtcctttcgctaaacgcaagcctcgcgctaagcgcatctttggtcatgcgctaagacgagagtctcaagcgcttagcgcccaacccttgcatctaaggctgatttggtccgctaagctggctaaggctgagctaagccaactttaa

SEQ ID NO: 21415 - DNA, 492 bp, Glycine max
  Peptide Sequence Number=SeqID_113100
atggggaacaagcaaagtagttatggcgtcgttgctggggaaaaatttttgcaggacttagaggcagcaacaattccagaggaagaacctcaatcttttgaggcatcttctagttttcctattgcagaacattctcatttatatcctagtgaagactacatcatggctgaagagccaagaagagttactctggaagattattcaagttctaatgtgccacagtttttcaccagcattgcacaaccagaagttcaagtacaaaccattacttatccaccatcattgattcagttgattcagaataatttgtttcatggattactaaatgaagacccatatgcacacttagccacttacatagaaatatgcaatactattaggttggcgggtaccgagctcgaattcgtaatcatggtcatagctgtttcctgtgtgaaattgttatccgctcacaattccacacaacatacgagccggaagcataaagtgtaa

SEQ ID NO: 21416 - DNA, 102 bp, Glycine max
  Peptide Sequence Number=SeqID_113101
atgatggttggaagggtcctttcaactgttggtgatcctgtcttgacccaagagatgttcggaggaagctatggaaatgatggaaaatggagaagaaattga

SEQ ID NO: 21417 - DNA, 713 bp, Glycine max
  Peptide Sequence Number=SeqID_113102
atgccaggttctcccgcgatcctgttcgatattccatgcgccggtgcagatattctccaggaaccaacgccgttccgacgcatcgggaataatatcgagataggcgagttctggatcgtaatggatgagaaccctgccgatgtcgaagacgatgtgcttgacgggactgctcaacggtttttcctcttccctttgaaagcttctggtatggcagcggtgatcgcctttttcatgactgttgccgtcgctggatgcagccttgctgacattttccgaacgatagacggagagccgcagttcgaaatgcgtgaaaacatgcgtaatcgaaccggaagctgtccatcgcgcggggaacggagccgcatcgatggtcgtatcgccatcaatgcgagccgtccatcggctgcccggaacttcggtcatcccggcgagcagtccctcatcccttcgcttgcgcagaaaaaccgaaccatcttcggcaatggcaatgaatgccgcgcctgtgcgaattggcttttccgctttgggcgcctttaccggaaacttttccgggtcgcgggatttgagcgccatgcaatcgtcattgagcggacagatggcacaagctggacgccgcggcgtgcatatggttgcgcccagatccatcaccgcctgcgcaaaatctcccggcctgtcgatgggagtcaattgccccatgagcgcgcggatttccg

SEQ ID NO: 21418 - DNA, 319 bp, Glycine max
  Peptide Sequence Number=SeqID_113103
atgagtcttgattcttcatctagtgttaatggaaggcataggtcacatcttagacctcactcccatatgagagaaaatgaaagaaagcctcaagaggctaacattaacctcccatacttccatgggaaggacaatgtagaggcttacttagattgggaaataaggatagagcaaaaacttaaaagaaagtctactttaaaatcttatggatctcattcttatccaaagaaagaccaaggtctaggcatcttaggggcagcaccttctaagcccaaagatgataagggaaagacaatagaaaaacaaccccctaaggcta

SEQ ID NO: 21419 - DNA, 336 bp, Glycine max
  Peptide Sequence Number=SeqID_113104
atgcagaaattcgttgttgttatgtattatgacagtgacgtggtatcaaatcttgaagggatattgatcgaattcctgcagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 21420 - DNA, 405 bp, Glycine max
  Peptide Sequence Number=SeqID_113105
atgaggggcaccgtgcatgagcctcaagtgaacataggggacgatcaaaataccctcgtctcaagaggactatacgtcctcaccttcaaagggctacacgtcctcaccatcagagggctgcacgccctcacctccagaggactacatgtcctcgccttgagaggactacacgtcctcaccaccagagggctgcacgccctcacctccagaggactatatgtcctcgccttgagagggctacacgccctcaccttgggtactagttaccctcaccgtcagaggactacacgtcctcgccttgagaggactacacgtcctcaccatcagagggctgcacgccctcacctccagaggactacatgtcctcgccttgagagggctacacgccctcaccttgggtactag

SEQ ID NO: 21421 - DNA, 615 bp, Glycine max
  Peptide Sequence Number=SeqID_113106
atggcttcgggcgcaacttgcgttcaaagactcgatggttcacgggattctgcaattcacaccaagtatcgcatttcgctacgttcttcatcgatgcaagagccgagatatccgttgccgagagtcattgtatgtaaatgttgtgtcggtgacgaccccggcgggaccaccatgcttccttgcgcctacgggccgacgccaggagcgcgcaggtgccgaggcacgccaagggcgcgcgctgccatccacaatcgcgatgatgacgtctccacgagcatatcaacagcccgggcttgggcccctccgcaatcccgtacggttcatgacttctcacaacgtcgcgggcattgttcgaacttcggtctcacgtcgccgcagtatttccggaacgacttaccggaggctgcattcaatcggacaacccggagcgacgggcggtggtggacaaagggcagggacgacggggctctcaccctctctggcgcccccttccaggggacttgggcccggtccgccactgaggacgcttctccagactacaattcggacgccgagggcgaccgattttcatggtgggcttttcccggttcgctcgccgttactaagggaatcctt

SEQ ID NO: 21422 - DNA, 120 bp, Glycine max
  Peptide Sequence Number=SeqID_113107
gctacaaaggtttggatgacgccacttccggggaaggaagataaggtcagggtagacaccactttccggttgaggaagataagtctgggtagacgccacttcgcgggtgaaggaagataa

SEQ ID NO: 21423 - DNA, 234 bp, Glycine max
  Peptide Sequence Number=SeqID_113108
atggacataattggaggcgactattgttgccagcgcttaatgaatggaatagtctctatgaaaggcggtttcaagaaacgccaccacaagttggggctcctcatgtggagacccaagctcccccggagatgtagggaaagtgtagccgcacaagcacatgttattcctgcgatgccaaagcagcaacatagaatgtattacacacctgatcagttcacccaagagtcgtcttaa

SEQ ID NO: 21424 - DNA, 407 bp, Glycine max
  Peptide Sequence Number=SeqID_113109
ggacaccaggatttatttattctgcgaagtgatcttccgtcacagtggcttctgtttctatcagctgtccctcctgttcagctactgacgggggttgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattggcgctagcggagtgtatactggcttactatgttggcactgatgagggtgtcagtgaagtgcttcatgtggcaggagaaaaaaggctgcaccg

SEQ ID NO: 21425 - DNA, 207 bp, Glycine max
  Peptide Sequence Number=SeqID_113110
atgaggatccacttcttgaggtggagtatccccgaggagtcatgtcggcatcgtgaggcagactctaccgccaaagtggcccaagggagactatggcgatcagcggaaggtcttcaggtcctagtgcaaaatagtttagagattatgagcggtaagaaagaaatgactccgaatagagttgtgaactggccattcaggactctgtag

SEQ ID NO: 21426 - DNA, 153 bp, Glycine max
  Peptide Sequence Number=SeqID_113111
atggaggagatacatggagcagaagatgaagagcgaggaattaaagccttggatcctcttcatcaatggagtcctttgcttcttgaagatcaatggcagcggaatggagaagcaagaaagatgattgaagatgccacttcaaggagaagatga

SEQ ID NO: 21427 - DNA, 267 bp, Glycine max
  Peptide Sequence Number=SeqID_113112
atgggggtgcaaatagcaaccaggcccatttgggccctccagaagattcctccagaaggcggggaggaaatgaagaaggaagggatcccagccctttggcacttctctctctttggaatttgcttggaaaattgtttccgaagaaaatctaagccgagcgcttccgaacgtttccgtaacgtttccgtgaggaatctcgcaaaggtttcaaccgttcttcgacgttcttcattcgttcttcatcgttcttcgatcttcaacgggtaa

SEQ ID NO: 21428 - DNA, 243 bp, Glycine max
  Peptide Sequence Number=SeqID_113113
atgagtgttgcgcttagcggacgctcgctaagccagcagattggcttagcgagaaggcaagccaaatgcgagcatgggcgagctagggtccagaaaacccaaaaaaagaccctttttgatgcaatcctccctaggaagggaccaactaccagggccatgagcaagaggctccaagaggattgggctagagctgttgaagacggcccgagggttctcatgaacctcaggggcttcataatgtag

SEQ ID NO: 21429 - DNA, 438 bp, Glycine max
  Peptide Sequence Number=SeqID_113114
atggagtccatgaaggaccaaatgacctccatgatggaggccatgttaagtatgagatggatgatggaagacaatgcggccgcagttgtcgccaccagcgccgccactgaggcagacccgactcacccatccagcataaaccaaacaagtcgtccaatcccaaacatggtaggtcggggaggagagtgcacgtgcccaatgagaacgccaaccactccgttcccattccccttgaaggctagcaaccccaattggggcatacaacttttgctcagcctatgggggaagcccgtgaagagccccaggatcatcctctgggcgagtttgaaccataccctacatatgccactgagggaccagcatttagtggtatgcctcaacccaatgccgtgggagcttctcaacactgcccactgcaacctctgcatttcttggtag

SEQ ID NO: 21430 - DNA, 543 bp, Glycine max
  Peptide Sequence Number=SeqID_113115
atggggacaaatcaaaatggaaaaagattctatcaagtcaagattaagagcctagatgtcaccagccttaaggagttgggacggttgatgggacccctccaaaggcaagccttttgcaaagtgtacagaaagattttagatttgaccatagcggaggtatttacggaagccattgtatccctcgcccaatactatgaccagccgttgagatgcttcacgtttggggatttccaaatagtatcgactgttgaagaatttgaggagattttaggatgccctcttgggggaagaaaaccgtatcttttatccgggtttcttccctccttgagcaagattgcagctgtgatcagagattcggcgagaaagttggatcgttatgaagcaaacacgaaatggcatagtgggcctaccgcggaaatacatcgaaggcaaggcaagggatatggcgagtcaagaagagtggttctggtttgcggatatactagctttgctaatctttggggttgtcctctttccaaacgtggatggtttggttggacctag

SEQ ID NO: 21431 - DNA, 519 bp, Glycine max
  Peptide Sequence Number=SeqID_113116
atggggacaaggggttgcattaattacaatcccattctcgccataagacaacttggctaccctatgagaagggcaccattagaggaaggcctcacacctattattgcacgaggtttcaaaagcaccgacgcggggttacttcaaaagatccgcaaggcatgggagacggtgcaaaagaaggacaaggaacttagaggcaatagcaacggccccatcgacggctactataggtggttgaaagcctatgcacaaggactggattggctcccaaatttgagaaccactaagggggtggaggttgaaactccggaagaagacgaagaggtacaggccctcaagacagaactcgagaaagcccaaacggacaaagaaaagttcaagtcagcaactattaggatccaaaaggagaacgccgaactgagagacgtaaatataaccaccactaaggccttagaacaagagaccaagagggcccgtagggaagaacatggccgaaacaaattccaaggggctttgtga

SEQ ID NO: 21432 - DNA, 462 bp, Glycine max
  Peptide Sequence Number=SeqID_113117
atggattcactggtcgttccgggtcttgatacgttacgtcattggctcgacgagttaggcatcagtttttttgagtgcgactcctgccaggcgttgcacctgccgcatatgcagaatttcgacggtattttcgatgccaaaatcgacctgctggacaacgtggtgttgttttcggcgctggcggaagtgaagccctctgcgctgctgccgctgtcggcggatctgtcggcgattaacgccagttcgctgaccgtaaaagcgttccttgatattcaggatgataacctgccgaagctggtggtctgccaggcgctgcccgttggagcgggcgtcactctcgaacagtttgcctggttcttccgccagagcgaagagcaggtctcgatggtcattttggaagccggcgcaaatcaactgctgtataaagcggaagagcaggaagaagaggccgcagccgaagaa

SEQ ID NO: 21433 - DNA, 210 bp, Glycine max
  Peptide Sequence Number=SeqID_113118
atgggccttgaccactcttgttgtccccttctcagcgcttttttccttcttgctcagttgttactggggggtagcgagaagagcaaacagccaaaacgagcaagaaggacacgagcggggagtggcaataataccagcaacaatcagaacagtggacttggaggcggatcatccatcccggaaatagatgatgtggagaagggtgattag

SEQ ID NO: 21434 - DNA, 422 bp, Glycine max
  Peptide Sequence Number=SeqID_113119
ggccctggggtttccagctctggttacgggcctctgtagtcctacagggtgcccgtttcccccggcaaggtcacgtcatcatgacatagggatcgcgcctgcaagacacccagtggacccaaagaagtccaacagggccttggagttgtcaaacggcaagggcattaggccccctactaatcgagctttcatcaagaagtactgcgtccccaggcaggcgcagggcgaaacaccccagcagcattgggatggccgtcatcacgcgtccggttctaaagacgttaaagaagcgctactaggaggcaacctagaattggctacggagaagctccctgcgaagcggtccaggaagggcaccatcgaagaggattccagtgcggccccgcaagccgacgcaggcttcgacaaacaccgattccaga

SEQ ID NO: 21435 - DNA, 243 bp, Glycine max
  Peptide Sequence Number=SeqID_113120
atgtctagaagagttggatgggttgaaaggaaggccttcagaaaaagtggtgttgaagaattgaagaaggaccttcccatagagaaagctaaggtggacttgaagatcttgccggagcatttgaagtatgtgttcttagaagataataaggcaaaaccaatagtgattagcaattctcaaactgatgaggaggaatcttggctggtgaaagttttgaaaaagcatagggcagtgattggatga

SEQ ID NO: 21436 - DNA, 420 bp, Glycine max
  Peptide Sequence Number=SeqID_113121
ttggcccagggcttccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcccaggagcctcagccatagccggaggttactccagaggtcacactagaggtcactccacggacttcaccggtcactacaccacttgtggaggtctctga

SEQ ID NO: 21437 - DNA, 232 bp, Glycine max
  Peptide Sequence Number=SeqID_113122
atggaatcttctaaagattcagaaaatgaagagataaaactctgtctaatggctaaaagttatgaaagcgatgaagaggtgtctttgaggaaggaatggtacatagatagcagatgttcaaaacatatgactagagatgcatcaaagtttacacatatctctcccaagaaaaacgggcatgtaacttatggtgacaacaacaaaggtagaatccttggagttggtaaaatag

SEQ ID NO: 21438 - DNA, 186 bp, Glycine max
  Peptide Sequence Number=SeqID_113123
atgaggagagtttatgagggatccactgttgttcatagcactcctttgttgtctggccaagtaaaggtgactgtggaggaggttacagatgcagatgctccagttcctgtacccactaatgagctgtgtctccggcaaaaccacctccaaagcccgatccgaaggtcgatgatccgctttatctga

SEQ ID NO: 21439 - DNA, 759 bp, Glycine max
  Peptide Sequence Number=SeqID_113124
accctcatcagacggaacacagtctggacgtgacgttgctcacctccgccagcgaagacgacatcagcgccgtgctgtgcttcgtgctggagccggaacaaatcagcttctcgacgccgacgcagagcgaaccggccgttgcagaagcgagcttaccggcagcggtcgccgcgccggaacctgcacctgtgccggtcgcgaacgccgcgccgcctgccgccaaaccggccgccgctccggcggaagcgccgaaagcgcgcgccaaggcgagcgaatccagcagtattcgcgtgacggtggaaaaagtggatcagctgatcaacctggtcggcgagctggtgattacccagtcgatgctggcgcagcgctccggtgcgctggatccggtggcacatggtgacctgctcaacagcatgggtcagctggagcgtaacgcccgcgacctgcaggaatcggtgatgtcgattcgtatgatgccgatggagtacgtgttcagccgcttcccgcgtctggtgcgcgatctggccagcaagctgggcaaagaggttgaactgacgctgctcggcagctcaaccgaactggataagagcctgattgaacgcatcatcgatccgttaacgcacctggtgcgtaacagtctcgaccacggcatcgaaaccccggaaaaacggctagccgccagcaaaacggcggtcggcaatctgacgctgtccgcggaacatcagggcggcaacatctgtatcgaagtgatcgatgacg

SEQ ID NO: 21440 - DNA, 251 bp, Glycine max
  Peptide Sequence Number=SeqID_113125
atggctccgcagaaactctccacgaagaggtctagaagagacgccataggagaaggtgccgagcaccagcagcgcttcgaggccatcagaggatggtcattccatagggagaggcgtgtccagctcagggaggatgagtatactggattcccttttgatgcagatgccctcagccagttcctgggtgactcgctagttttggaggaaggactacagtgtgatttcagccagaggaggaacaacgccgatgg

SEQ ID NO: 21441 - DNA, 157 bp, Glycine max
  Peptide Sequence Number=SeqID_113126
gaaaaggctacaatgcgaaaggtatttctctcagctcaaacatgatatcaaaattcccaatggtgagaatgctcgaaattgggctgcgaacatagtgctcaaatttcacgacgatccaacggtgaacgagtccgagatcgtcatttatctgagatag

SEQ ID NO: 21442 - DNA, 417 bp, Glycine max
  Peptide Sequence Number=SeqID_113127
atgccttcaacgttcaagtccacagcgacattgatcttaaactataaaggggtcgatcctgttaccggaattacattgcctgcgcaattaatgcctgggtacatggctacgcaagttaatatattgaacagccatagaattgctacagctgttgtagataggttggatttaacgaaaaatccacttatcgttgagaaatataaagatgaaaaagataatgggtactccatacgagattggaccgcaaagttaattagtaagggtttggaggttgcgccttccagagatagtagtatgattgacatatcatatttatcctccagccctgacttttcagcctttgtaactaatgcatttgccgctgtatatgttgacgaaagtttgaagttagatgtggagccttcaaaaaaagcggcc

SEQ ID NO: 21443 - DNA, 417 bp, Glycine max
  Peptide Sequence Number=SeqID_113128
acaactgtagctagctttactttggcaagaactcggatcaaatcgctcggcgagctaatctcgcgtgttttcactcgctttcgcaagtgtggttggatagccgttattcgatccttcggatacgcaactgtaagtcggagtttgacccgcagaagcatgctgccacagtcccgggcgcggggcagataccatggtcatcaacctattatgcctgtcacagtaggaacagctgcaatacgaccccttcaaggggagaacatcttgtaccgcaagaaatctcctggccgcagcttctcaccgcttgacttggttctggagtggttcgaggagattaatgaggataaaatgggagaggttgggcgggagatcgctcaatctaaacagtgcgttggagctatcacaggctatgccggctaa

SEQ ID NO: 21444 - DNA, 84 bp, Glycine max
  Peptide Sequence Number=SeqID_113129
atggacacccgtctccgtgtgattcgtgatcccatgaatggagttcaacaggggtcacaacccactcttgaaggattcacctag

SEQ ID NO: 21445 - DNA, 878 bp, Glycine max
  Peptide Sequence Number=SeqID_113130
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattactatacctaattcgtactactatgatgctactataaaagaatacccatcaccagcctcatcaaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 21446 - DNA, 462 bp, Glycine max
  Peptide Sequence Number=SeqID_113131
atgaaactgaaattttttttcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgctttttgccgttacgcaccaccccgtcagtagctgaacaggagggacagctgatagaaacagaagccactggagcacctcaaaaacaccatcatacactaaatcagtaa

SEQ ID NO: 21447 - DNA, 360 bp, Glycine max
  Peptide Sequence Number=SeqID_113132
atggtgggttacacaccttcaagctttgcggatttggtcttcgccggtgaaaggatcaaagtgagcctagaaagaggtaaatctgaccatcctgctttgatgaatgtgaaaactagggcaaatgaagaggatgagaatgaaggagaaacccatgttgcgactgtcattcctacatggccaaacttcccaccagcccaacaatgtcattactcagccaataacaacccttctccttacctaccacccagttatccacaaagccataacccctgccagggttcctcaaaatccatttttccgaggatacgacttgaacgcaacatgtgcatatcatggaggagccctggggcattccattga

SEQ ID NO: 21448 - DNA, 180 bp, Glycine max
  Peptide Sequence Number=SeqID_113133
atggataagagcttgaaggtaggagaagatgagtggagagagagggagagaaggagcacaaaattttgtgcctcaaatgaggtcttaactttgaagtctatggttcagcccactaatccaaggtcaagtccaagattctccactaagtgtcttaggtgtcatgaggcatgtaaagcatga

SEQ ID NO: 21449 - DNA, 558 bp, Glycine max
  Peptide Sequence Number=SeqID_113134
atggataacgaagagggagtgcaagaacagatgaaggccgacctatcggccttaaaagatcaaatggcttctatcacggaggccatgctaaagattcaaaaaactatagaagataatgctacagcggccgcttccaatacaactagggaagcggaaccggtgctacagcctgcaataaacttaggccgagacagaaacgcgacgggtttcaatcggaggtataatcctcaagcctacccttatggcttgcctctagacttcactccccataccgctccagacgatttgagccaagcccctaccttcgaggggcagctccctcctcatgccgactatcctctgcaagaagatgatgaaggagatgcccatttaggccctctacttcccctcaaggaaccagccccccatgagttcccccaaccaaacatagtccgccacgtcccgtctccatctgcacccgttaaggaactcgttccttttgcaaaagacaagggaaatattgatctacttgaagagaggctgagagcggtagaaggcctcgacattgtgtgcacatag

SEQ ID NO: 21450 - DNA, 426 bp, Glycine max
  Peptide Sequence Number=SeqID_113135
atgaagcacttcactgacaccctcatcagtgccaacataaaaccaaggccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 21451 - DNA, 249 bp, Glycine max
  Peptide Sequence Number=SeqID_113136
atggtagccataaccctagccaaggttcatcaacctccatttctccgagaatatgactcgaacgcagcgtgtgcttgtcacggagaagccccggggcgttccattgagcactgtatgaccctcaggcgtaaggattttcaagtgcaagccattggtcagtttgctcaaacgacctttgctcctgagtttggacttccaagaccgttcaatcagagattactcgtcttgcacgttggtggggtgccgtaa

SEQ ID NO: 21452 - DNA, 165 bp, Glycine max
  Peptide Sequence Number=SeqID_113137
atgggagaactaaagtacttcctgggattaaatgatcaagcaaactcaagaaggtatgagattctcaatcaatccaagtactgcaaggaattgatcaaaagatttgggatggaaagtgcaagacacatgggtttcaatccaactccaaacagtagaaaaacctga

SEQ ID NO: 21453 - DNA, 1068 bp, Glycine max
  Peptide Sequence Number=SeqID_113138
atggccaatcaaggagactgggtcccgtttatggatgtgttagctttgctaatttttggggtcgtcctctttccaaacgtggatggtttgatagacctagcagcaatcgacgctttccttgcctaccaccatagcaaggaaagtccggtggtagctgtcttggcagatctatttgacacatttgaccgaaggtgcgagaagagtagcgcacggatcatctgttgcttacccgccctctgtgtttggttggtttcacacttgttccaacaagatacaagacatccatgtccgctcctgagccatcgctcgtgtactgaaaagaggagaatggactgggaccagctcttggccgggataggaggtagaacaatcagttggttcccccgatggaaggaaggaagagaaggagtccttttctcatgtggaagatacccaaacattccgctggtaggaacgaggggttgtattaattacaatcccacgctcgctataagacaactagggtaccccatgaggggagcaccgacggaagaaagcatgtctcctttccttgtgagggatctcggcgcacaaaattccaagactatacaaagaatccataagcatgggaaccccgttaaggaaagatcagagcttagaggcattcgtatggcatcattgtggagaagttcaagttggccgctacacacgttcggaaggagtgtgccgggttacgggaagagaatgcaattaccgcaagagcccttgaacaagagacccaagagggctcgcaaggaagagtatggccggaacaaatttcgcggagctctatggggtagcaatagtgaactcaagttgcgaagggaagaaagggaccagtcgcgagcacatagcatggttttgaaagaggagttagttgcctgttcaaggtccaaaagaagcttgtctcagcgtttatgcgagacggagaccaacatgctagctatcatcgccaagtaccaagaagagttaggtctagccgcggcccacgagcataggattgcggacgaatatgcccaagtatacgcggaaaaagaggctagaggaagg

SEQ ID NO: 21454 - DNA, 189 bp, Glycine max
  Peptide Sequence Number=SeqID_113139
atgcagggacttcctcaattgccccagatcctaagcgtagtatcgcttgacaacatcggagttcacggtgaagcacaaggtccccctcatggaacttgtgcgagcgcaccttcttgtcgaacgcgttcttcatcctttgttgatacaggcgcccatggctcatggccgtcaagcgcttaccttcaataa

SEQ ID NO: 21455 - DNA, 279 bp, Glycine max
  Peptide Sequence Number=SeqID_113140
atgatgggagatgcatcaaaattcattcatatttctcccaagaaaagtggacatgtgacttatggcgaccacaataaagaatcattagaagaaatgcatattcatggagaagatcacaaaggcaaaggagatggaaataatgaagattttcacattgatgaaattaaagcaaatgctgatcttccaagagaatggagagcttctagatatcatcctcttgacaacatcattggtgatatatcaaaaggggtaaccactagacattcccttaaaatttga

SEQ ID NO: 21456 - DNA, 249 bp, Glycine max
  Peptide Sequence Number=SeqID_113141
atgaagaacgtcgaagaacggttggaactttgcgaaattcttcacggaaaacgttacggaaatgtttcggaagcgcctcggcttagattttcttcacggaacaatttttccaaggaaattcgaaagagagagaacaagggggctacgaaccctttcccaagtgtgaaaggttcagaagttgtttttacgcacggggaaggcattggacctttaaacgatcttttgattttgaaaggggagaaacgttaa

SEQ ID NO: 21457 - DNA, 315 bp, Glycine max
  Peptide Sequence Number=SeqID_113142
acttacgctttgggcaatccttttagaagtgtccagattgcccacagaaagcacaatgacaattattgctctttgatgtcttcttctagcaatgacttccaagattattttgatgatgccaaagaatcaagagttaagcaagtttcaaagaatcaggagtcaaaaagcttcaagaatcaagtttcaaagaatcaagattcaagaacaatcaagtttcaagattcaagattcaagaacaatcaagtttcaagattcaagattcaagaacaatcaagatcaaaattcaagaatcaagagaagactcaatcaagataa

SEQ ID NO: 21458 - DNA, 432 bp, Glycine max
  Peptide Sequence Number=SeqID_113143
atgctgtgtacatccccgtgttgtgcttttgtgcgtctgcatcatgtcgtcacgcacgcattgtatgttggtctcatcttttgtcacgggaagctagaagatccatatcaccttcttaactgcacacatgggggcactgcaaccccaaatgtgcaagtaagaagagatgatttttcgggctctcgtgtcttattggcgatcgaaattgccattccttgggttatggggttgaaccaagctcatgcttttacgaaaaaggttcatcaagtcaagttgaagtatggaagtaaccatcttgcgaaattggggcaaaagatggatcgggttacatcgctgctacgcctactgccaaacacatttaggactgttgatgtccttgttacttctagtttcaccttgacaaagatgtcatggaccatgttgaaaatctaa

SEQ ID NO: 21459 - DNA, 303 bp, Glycine max
  Peptide Sequence Number=SeqID_113144
atgaaaggtgtagaagcaaagcttcatggtgaatcaaaggtgatgacaaaaagctcaaagatcaatcaaagaacaactcaagagaatccaagatcaatcaagaacaattcaagagttcaagataagaatcaagaagaattcaagactcaagaagaaagtctagagacaaggatcaagattcaaggttcaagatctcaagaatcaagatcaagattcaagactcaagattcaagaatgaagagaagattcaatgaagatcaagattcaagaatgaagagaagactcaatcaaaataagtattaa

SEQ ID NO: 21460 - DNA, 231 bp, Glycine max
  Peptide Sequence Number=SeqID_113145
atggtctcggacacggaaacgtcgcacacactccagacatcttctcgaagatcccaacggtcagatcgtggaaaagtgtcttgtgaagctgcagaccaaatttcgagaagctccaacgggtgttacaaatacaaatgtcactcaaagagttgggcatttaaaaggacacaacttcttcaagctccaaagtatagtcttcatatagcttcccctatctctaacatattttag

SEQ ID NO: 21461 - DNA, 159 bp, Glycine max
  Peptide Sequence Number=SeqID_113146
atgtcggctattgagttttctattcaatcccttaatgaaatatgcatgatgtcggccaaatacagtctaaaggcccaagtggagaaggacgaaggcccaagtggagaaggacaaagcccccgagtggagaaggatgaaggcccaagtggagaaggatga

SEQ ID NO: 21462 - DNA, 325 bp, Glycine max
  Peptide Sequence Number=SeqID_113147
atggctcctaataaagtatttcctctatttatgccatttgggcaaaacaatgcattgaaatatgagaatatggatgagtccatactgtggcacttgagatgcacaggttaccatttccaaaaacatcttagagagctaaagctccacttcaattggtgcatgctgatatctggggaccatcaagtacccccagctttggtggaagaagatatttttctcctcttcgttgatgactacactcgaatgatgtgggtgtacttcatccaacaaaaatccgatgcattctcttacttcaaggagttcaaggcccaaatggaaaagcaaa

SEQ ID NO: 21463 - DNA, 318 bp, Glycine max
  Peptide Sequence Number=SeqID_113148
atgacaagcagagaccaaatttggtcattctgcacccttgtatcatccagaggcggcgggcccgatgatacgcggagataccttacggttatccgcacccttgtgtcatccagaggcggcgggcccgatgatacgcggaaatacccgagtggttatccgtataaacattcttttgctatctcacccaggcccacttgggccctccagaagattcctccagaaggcggttgcttctggaggaagcaaccctgctcgcctgggcgagctgagctcgcctgggcgagctgggcggcaaccacctcccctattttgctataa

SEQ ID NO: 21464 - DNA, 126 bp, Glycine max
  Peptide Sequence Number=SeqID_113149
atggaggttgatgaaccttggctggggttatggctaccattgaattatcaagtggattttgtggttgattcagggatggcctttgtggataactgggtggtgggtaaggagaaggaatggcagtga

SEQ ID NO: 21465 - DNA, 585 bp, Glycine max
  Peptide Sequence Number=SeqID_113150
atgggtggtggtgcatggccgttcttagttggtggagcgatttgtctggttaattccgttaacgaacgagacctcagcctgctaaatagctatgtggagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgaactcaaatctgttaagtgcgactcccgggggcccggagacggtgtcccgcgggagtcgtcacgacacaacatttacatacaatgactctcgggcaacgggatatctcggctcttgcatcgatgaagaacgtagcgaaatggcgatactttggtgtgaattgcagaatcccgtgaaccatcgagtctttgaacgcaagttgcgcccggaggcattaggccgaggcacgcctggctgg

SEQ ID NO: 21466 - DNA, 51 bp, Glycine max
  Peptide Sequence Number=SeqID_113151
atgggggtggtcttcgtcattggaagtgcggtagacaggctttggggttga

SEQ ID NO: 21467 - DNA, 437 bp, Glycine max
  Peptide Sequence Number=SeqID_113152
atgcggagacaaaatttggtcattccgcacccctttgccattcagacacagtcgtgtccgatggtacgcagagacaaaatttggtcattctgcaccctttgtcatccagaggcggcgggcccgatgacatgcggagacaaaatttggtcattccgcaccccttgccattcagacacagtcgtgtccgatggcgcgcagagacaaaatttggtcattctgcaccctttgtcatccacaggcggcgggcccgatgacatgcggagacaaaatttggtcattccgcacccctttgccattcagacacagtcgtatccgatgagacaaaattttggtcattctgcaccctttgtcatccagagtcggcgggccgatgacatgcgagacaaaatttggtcattccgcacccctttgccattcagacacggtcgtgtccgatg

SEQ ID NO: 21468 - DNA, 980 bp, Glycine max
  Peptide Sequence Number=SeqID_113153
atggcagagccatcaaagaagagaaagggatcatcctccaccgctaccgctgctgcccatcgccgtcacggcccatccggagcacccacagcacctattcctccttctttgtcatctccaagatcatcaacattgttttcatccgatgatcaacgtctacggtacctttctcagttttcttctagaataatcttagaccctaagtatctagacgtagagttctttaatgatgaaacgtttgattgctatcaagtgtttcaaaattctggtcttgttgatttcatgtcatttaaattgtcatattatcctgaacttgtaaaggtgcatggtacttctatggtcattgatcagtcacttttcttttctttgactcatttacccagtcaaggtgcaccttttgagggcaccattgttgatgactggaaattcgattattcaagtcatgatgctcgtcgcatggtctgcaatgatcaagctgaaatgaccggtagattgctggctgggtcattaacttttgataatcgcatcatgcattatatcattgttagaattttgcttcctcggtcttcaaatttagcacaagcctctgaggaggatttgattcttatgtgggcttttcttaccggtcgtcagatcgactgggcccatttggttcgataccgaatgcataaggcattacgggccaatgcacctcttccttatccacatttgattactctgtttttgcgtcattttcaaattccgcttaatgatgaaccttttgttcaagtcaagcgttcctttgcaattggtgctggtgcagtgacctcctttgggtatcgtaaagatcggaatggacaatggctgaagaaggatgcactccctcctcaagatgaacgtactccttcacctccccctcaacgtgaagattccgcactcatgaatgaagtcctctccgaattacggggtcttcgttcttatgttggtgaccgcttcgactc

SEQ ID NO: 21469 - DNA, 382 bp, Glycine max
  Peptide Sequence Number=SeqID_113154
atgactagaggcaatccatctgacttacaaccctttgatcctgagatagataggacatttcatagattagttaggcatcattttataccttttgatcattctgagcattccataactggtgaatctgtgcattctgttattggtgattttgaacatcctgatctggagcattataattttgagcattctgattctgagcattctgattttgcacattctcagaacatggcacaacctccacctcgtgagaggactctaagggaaatggctgcacctgatttcacctatgaaagcttgtgcatccaataccctgatgaggatgtcccatatgttcttaaaactggactgattcatttgcttccaaagtttcatggccttgcag

SEQ ID NO: 21470 - DNA, 174 bp, Glycine max
  Peptide Sequence Number=SeqID_113155
atgggtgcccaagccccctcccgagggaccaaaagaaatggtcgcacgtccatcgagcaaaaggtcccccggacaaaaattaggaggaaaaacttatcagaattcaatagtaataacaaaacctcaaagagagttgtgcttgatcctcaagagaaaacaacgctggagacttag

SEQ ID NO: 21471 - DNA, 564 bp, Glycine max
  Peptide Sequence Number=SeqID_113156
ccagtatacactccgctagcgcccaatacgcaaaccgcctctccccgcgcgttggcccgattcattaatgcagctggcacgacaggtttcccgactggaaagcgggcagtgagcgcaacgcaattaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgggaccgctacacttgccagcgctgatgtccgggcggtgcttttgccgttacgcaccaccccgtcagtagctgaacaggagggacagctgatagaaacagaagccactggagcaccctcaaaaacaccatcatacactaaatca

SEQ ID NO: 21472 - DNA, 345 bp, Glycine max
  Peptide Sequence Number=SeqID_113157
atggttaaggagaagtctaaggaggtaagtgtctcctccaagaggttagctaagaaggaaagtcattttgaaataaagacaaatattaatgaaacttcccctcttagaaaacctccacatcttctcctttgtaaaaagacacttgttagcactgccacacctcttgggcttgaggttattcctcaagtattaataggcacctgtcgcaacctacccttcggcaggagggtggcgcgagactcgcgggtgcgtcttccaagaaaggaatacgcgcgaagtcgccaccaatgtttatttgaggaaaacatcggaaaaaccggaaaagacgtggtctacgaactttaa

SEQ ID NO: 21473 - DNA, 522 bp, Glycine max
  Peptide Sequence Number=SeqID_113158
atgggtgcatattctagagacgagaagttattgatgtatttcttccaagatagtttggccggagcggtggtcatctggtatactaacttggaagcttctcacatccgcacatggaaagacttcattactgccttcattacgcaagtggcccttcccatggttgagagggagatgatcatgatgatagtagatacactgccaatattctactatgagaagttggtgggttatatgcccgctagctttgcggatttagtgttcgcgggagagagaattgaagtaggcttgaagagagggaagtttgattatgtctctcccgccgacaccaacaataggaggactgaaacagttggggcaatgagaaaggagggggacgcccacgccatcaccttgacacctgcttggccaaaacctcagcaagccccgcatgctcttcctgctcagtgcccgtctagccaaggacgtctgcgtcagctcaaaggggccctcttcagacatcggctccagcccaacctcgcctag

SEQ ID NO: 21474 - DNA, 651 bp, Glycine max
  Peptide Sequence Number=SeqID_113159
atggcgagccaagagaagtggggcccgtttgcggatatactagctttgttgatttttggggttgtcctctttccgaacgtggacggtttggtggacttagccgccattgatgctttcctcgcatatcaccgcaacaaggagagtccagtggtggctatcttggcaaatttgtttgacacttttgatcggaggtgtgagaaaaacagtgcacaaattgtctgttgtttacccgctctctgtgtatggttggtttcacacctattccaacaagacacaagatacccgtgtccgcttcaaagttatcgctcatgcgccgaaaaaggaagagtcgattgggaccaacatttagctgggataggaggcaacacaatcaattggtttcctcattggaaggaaggcaaggaaggagttcttttctcgtgtggggactaccctaatgttccattgatagggactaggggttgtattaattataatcccgcactcgccataagacagctagggtaccccatgaggggaacgccaacagaagaaagtctctcgcctttccttgtgagggatctaggcgcgcaaagtctcaaggtgatacaaagagtccacaaggcatggagaagtccgttgaggaaagacaaggagcttagaggcatctaa

SEQ ID NO: 21475 - DNA, 129 bp, Glycine max
  Peptide Sequence Number=SeqID_113160
atggataagagcttgaaggtaggagaagatgagtggagggagaaagagagaaggagcacaaaattttatgcctcaaatgagcccactaatccaagatcaggtccaagattctccactaagtgtgcttag

SEQ ID NO: 21476 - DNA, 297 bp, Glycine max
  Peptide Sequence Number=SeqID_113161
atgtcaaaatatgtcttatgtcaacatagttggaagatatgtcttaactctggaggtaatatagctgcatcttctaagatatgtctccacggtggtggtattgttcttcgtcgtcgtgatggggttctctgcggtggtagcgttgttctttgcctctgtgatggggttttccgtggtggtggtgctgttcttcgttgccatgatggggctctcctcagtggtttttgcgttagtgtagcagaagtgcagaacagcaaaagccaagatcgaatagaggtaaacgaaaatgacaaatga

SEQ ID NO: 21477 - DNA, 480 bp, Glycine max
  Peptide Sequence Number=SeqID_113162
atgctgtgtaaatccccctgttgcgcttttgcgcatctgcatcatgccgtcacacatgcattgtatgtgggtctcgtcttttgttgtggaaagtcggaagatccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 21478 - DNA, 100 bp, Glycine max
  Peptide Sequence Number=SeqID_113163
atgtcattacgtcggctcggcagctcctcactagaatcttactccctacaccctgccactatcattctgctcccacgaacaaagttcgtgatcatcacag

SEQ ID NO: 21479 - DNA, 507 bp, Glycine max
  Peptide Sequence Number=SeqID_113164
atgaggccctggagagtagcccgccctccacttactcccataaccttggttccattctcggacacctacattccaaactgggggccccctccagctttttcacacggcatgttggagacagtcaagaaaaaactggaaagaaggtcacccacatccggagttggatctggatcgcctaaatctactaagttttgcaaagagcccaaatcagttgggtcgggaacctgtgataccggttcctccggagaagcgaccgtcggatgtgcctccccttggggggcctccagcttaggttccgaaacgttcggatttgacgaggacgcctcctcgtccaatttcgttcgtttagattgggaatctaaagggtcgtcctctcggggtcgtttccccaatgaggcgtcttcccctccctttttatggcaaaaggaggttacagcaatagtgaaaatggctgttagagtggccagtccaattatactggccgtgtccaataaaaaatcaaagtga

SEQ ID NO: 21480 - DNA, 243 bp, Glycine max
  Peptide Sequence Number=SeqID_113165
atgttcaaccctccaggtatcttagaatcacttaaaattagtgagaaaaattgtttccgtgaagaaaatccaagccaaggcgcttccgtaacgcttccgagacttttccgtgggcgatttcgtgaaggttttccaccattcttcgttcgttcttcggtcttcaaccggtccaacgccttgaaatggtcttttccgcttttattagttaaacgtggacttctaaagcctaaagtcaacacatag

SEQ ID NO: 21481 - DNA, 300 bp, Glycine max
  Peptide Sequence Number=SeqID_113166
atggcacaagaatgctttccaaatgaatatatgatgtggaattgcccctccagtgtagataaatggcatgaaagttccttttcaaatgcaagaaatggccccgaggaaagctcgcctcaaagagatctagcaaggataaagcggctgaaggaaccagttctgctcccgagtatgacagtcatcgctttaggagcgctgaacaccagcagcgcttcgaggccatcaagggatggtcatttctccaggagcgacgcgtccagctcagggacgacgagtatactgatttccaggaggagatag

SEQ ID NO: 21482 - DNA, 248 bp, Glycine max
  Peptide Sequence Number=SeqID_113167
ctgggcagaaggaaaagaggctcctagcgtgaaggttgcttgtctcgcccaggaggtgggaacagttgaaaacaaagtggcgaacgggctgaccaagccaatgatgcttagctggtcttttcggatgatcagccacactgggactgagacacggcccggactcccacgggggcagcagtggggaatcttggacatgggcgaaagcccgatccagcaatatcgcgtgagtgaagaaggcaatgccgctt

SEQ ID NO: 21483 - DNA, 237 bp, Glycine max
  Peptide Sequence Number=SeqID_113168
atgtttagccctcctgaaaatccaagccgaggcgcttccgtgggtgatttcgtgaagattttcaagctttcttcgacgtttttcattcgttcttcatcgttcttcggtcttcaaccggataaaaacaacttaaccaaacactttgttcacaaagaactacgtaggtctgatttccttatcgcaattaaggaatacgtaggagcaagggaaacacccttgtcgaccgcaaaaagataa

SEQ ID NO: 21484 - DNA, 556 bp, Glycine max
  Peptide Sequence Number=SeqID_113169
ggctggtggtgcatcaacgaatcctgccgtaacattcgcggctaccagaaaagacccggaaaaattcatgccggttgaatgggataaagtgaccgatcaggagtttgtcgccgagattaaggtggatatgtttaaccaccagggcgcgctggccaacctgaccgcggcaattaataccgcaggttcgaatattcaaagcctcaataccgaagagcgtgacggccgcgtttatagcgccttcatccgcctcaccgcgaacgatcgcgtccatctggccaatatcatgcgtaaaatccgcgtgatgccggacgagatgctggccatgcgccagcacgatctcaccgtctgcatggagcaggtgcataagccgcacaatgtctctgcggtgatccgcaccgccgacgccgtcggcatccacgaagtgcacgccgtatggcccagcgtgcgtatgcgcaccatggtgtccgcgtcggcgggcagtaacagttgggtgaaggtgaaaacccatcgccacattgctgatgcggtgcgccatctgaaagatcgcggcatgcag

SEQ ID NO: 21485 - DNA, 399 bp, Glycine max
  Peptide Sequence Number=SeqID_113170
atgagtgaaatagaggaggtgcaagaacagatgaaggctgacatggaggccatgaaaggccaaatggccgccatgatggaggccatgttgagcatgaagaaaataatggaaaacaatgtggttgcggttgccactacgagtgccgccactgaggtcagggaggagaagcgctacgaagtacgggcggcccccattttgtgcaagttcaaaacaagaattccttcccactatatggcttacctcctaactatacaccacccaatgatgcacacactcccaatgagaatgtcgacaactctgcacccatacccattgagagccaacaaccccaatctgatcatgcacaagtctctcaacctatgggggagacacatgaagcaccccaagaccacaatctag

SEQ ID NO: 21486 - DNA, 237 bp, Glycine max
  Peptide Sequence Number=SeqID_113171
atgacgcagaaggaggaggaagccaccatgaagggtgataagtgccctaaagctaccgatgaaggacccaagggcgccacagggtcatacagtgctcaatggaatgccccagaactctcccatgataagcacatgtcacatttgagttgtatcctcatcgaaatggaggtggtgcttggtcttggatgtgcagcgagtggatattatggccgatttaagggtggcctttgtggctga

SEQ ID NO: 21487 - DNA, 1014 bp, Glycine max
  Peptide Sequence Number=SeqID_113172
atggagctggctttgagtttaggagacacgtccaagtcctttacatttctcgacaaggcggtgactttaccccccaacaaggacccacctgggttctgcttggcgccgagtttcgccgagaaaagaagcgattctgagagaggaaccgcttctggttcttcagatccaccggttcagctcgaccttcttcctttctctccggttctcagaccccaacaacatcctccctctcaccttcggatcccttggctcacccaagcatgtggtggagcggcgagggttctggacgtgaacctatttcccgcggccaccgcggaggatggcgacgacggcacgtcgctgtcgtcgtcgccgaacagcgcggtgtcgccgtttcagatggatttctgcaccaggaacggtaatgcggcggagttcggaagcagaaacaagagagagcagcaagaggctgagggtagagcgagtgatgacgatgaaaatggctccacgaggaagaaacttagactctccaaagaacaatcagcttttctcgaagaaagtttcaaagaacacaccactctcaatcccaagcaaaaacttgctttggctaaacagttgaatctccgtcctcgtcaagtggaggtttggtttcagaacagaagggccaggaaagccattaatatggttatggacttatggacaaagttgaagcaaacagaagtggattgtgagtatttgaagagatgctgtgagaccctaacagaagagaataggaggttgcaaaaggaacttcaagaactcagagccctaaaatcttctcaacctttctacatgcagcttccagccaccactctcaccatgtgcccctcttgtgaaagggtagccacaaattccaccacaaccaaccaaacttctatagttaacaacaatgcttcttctcaaatcccagtggaattgtctctaagcaagcccagaatattgcccttccctaatggccaggtccaagcccaagcccatcaaatagcctcttcatga

SEQ ID NO: 21488 - DNA, 909 bp, Glycine max
  Peptide Sequence Number=SeqID_113173
atgggtgcacgggtcaccgtcgttgaaacttcaaagaacaacgacggtgtgctcaccaccgacgttgacatactgtcaaacaacgttggtggtgagcccgccaccgatgttgaaaggaaacccaacaaatacgggtgttcggcgtacctgacgttgaaatggaccacaacaacgacgggtcttcgcgcactgacgttgtattctgacattacaaagacgggtcctattatgatcgatgtcgttgttgtcgacatacaacgacatctggaacaaagacggtgtggggcccgtcgtagatacatgttttcaaccgatgacctaatggcagtcataacaatactgctaaagcaagaaagtggattcatgatcacgatgcaaattgcagctaagatgtacatgtctatgtcttactcatatgggaagaaatttgcaagtccaatcacgccattaatcctaaacgatgttggccatgtggatcatgttgctgacgaggttcatgagcagcctcaggagccaattacaaatcatgtcaatgttgatacagagggttttccaggcggaccctatgatataacagtgttgatgtcatatggttatcatgtggcacacaaagtttgggcaggagaggtagagaaatttggaaggcctgcacctgagattgaaggcatagtgactattacaagattaagttctctaattgcatgtttgttggacactggagaggttactataaccctcgatgatgtggcatctttgttacatctgcctattacaggtgtctttcataccttcgatgctcttgatgaagaccatgttgtggacttgttagttgagttgcttgaaattagtacacaagaagcaaaagatgagattgagcaatgcaaagaggcgtatgttcgcctagcctga

SEQ ID NO: 21489 - DNA, 207 bp, Glycine max
  Peptide Sequence Number=SeqID_113174
atgagtgaaaggaaagggagaggagaagaagaaaatgaaaagccaacaatgaagaggcaggcaacatgtgagataaggatgcagttgatgcaatcctaccccccaagggcattggatagaagacaccaagaatattggaccaaagatgcaagagaaggccctagggttctcatgagccttagggtagatttcgggcccatgggctaa

SEQ ID NO: 21490 - DNA, 150 bp, Glycine max
  Peptide Sequence Number=SeqID_113175
atggcaataaaagagagacaaagaaaggacatgagacaagatgcagtggtggcaagacaagatgcaacaaaaacaaaggacaagtggcaagatctgagatttcacctccagttcccgccattacgggagaggattcaggtcaactattga

SEQ ID NO: 21491 - DNA, 435 bp, Glycine max
  Peptide Sequence Number=SeqID_113176
atgggtactaatttcttaagattcttcactttgtccatcatttcaaaagcacaattctcaagcaagttctggccttccgtttgcccttacctccacatcctatgccttatacctctttgcatatctcactattctcctcatctcttagggactcaacctccagtacttgttgtcgatcatgatcctttttttcatcctcatgattttatctctagcaatgaattctacgatgccatcaacgttcagaaactaagccaaaaggaaggacaaaacggtgttttaatgaagacttcttaccctaaattcgcccaggctaacatccaactcatttgggctaaagatataatttcagtcctaagcaagaaactcgcctgggcgagctacggctcgcttgggccagtgaatgctttcaccattaagccacaatttgcctag

SEQ ID NO: 21492 - DNA, 333 bp, Glycine max
  Peptide Sequence Number=SeqID_113177
atgggatgggcaaaaaagggtgatatcaagattattgatgtccctagagactactatcaatatggaagtttgcaccatatttgtttcaattgtggtcgttatgggcatagggacaatgcctgtctagagaaaaaggctactaatgtagaagtgatcaaggagagacatgttgaagtggtggaagctatgaaggttcaaaaaatgatgaatgaggtggtgtcgacaccagaaataagtatggggaagatgacaattaatgagaatattgtaactcaagaatcaagggcgttagttagtattaaaagtaatgtttgccaaaatgagaatccatga

SEQ ID NO: 21493 - DNA, 189 bp, Glycine max
  Peptide Sequence Number=SeqID_113178
atggtggttctcgaagaagaggatcatcggtgtgagggaagagtcacgagttcgagaacaggatttcaagaactttcaggtggtagagaggatgatggtgataaagggaacacacaaatgttttggaagaaaatgagtcgcgagttcaagaacgagatttcggaaacttttaggtggaagagaggatga

SEQ ID NO: 21494 - DNA, 975 bp, Glycine max
  Peptide Sequence Number=SeqID_113179
atggtggcagttcgttttgttgaacttggaccttggatggtggtcgtcgtagttgctatgagtgagcggaccaagggggtggaccttgggttttgtagaagtgtaccagggacggaccttgggtttcagaggtatgagtaccaagggcggttatttgacctcttcttctgtctgcttcgcagttcctatgctgcttctctttatgtcttccgggtatcactcctacttggtgggtgtgtaacgctcatacctaggccctttggagagaggttggtgcttgtctggcttgtgcctcttgtacgacttgtgcaagttggccttggtgtttgcttctcacttgttgcgcttctgtctggcttgtcagacttcatttctgaatctgggcatttcttccatctggatgtagaccttggcttgctcacactgtctgcgaacttatcggggcataatgcgaggagcatagaatacaacgctaactcaagccaaggtcatgtagtgagacctactggtggtgtactgtgcactgaatttttcgacaagggtgtcgaagctgtctatggacctgggaaggcatctagatgcttgtctagatctattgtcccatcgtactactcgaggttgagtggttttcaccccaaggatatgtctacctccataatgcagtcgacaaaaggatgccgacggatggtctgcccaattggatggtgtatgtgggggagacttaagtcatttgcaacatggcctgtgtctcgggttggtcatggccaacctttagctttatcaactcctcctcatggaggtcttgtgtctgaggccaatcgagtgataaccatggatgaaagagagagaaagtttacaagaggtcgtgggttatgtggggtcccaaacttcacacatcaacttggaaaggtacctttgacaggaggagggacctacaaaacaaaggacttcaacactaaagcacttcatcactga

SEQ ID NO: 21495 - DNA, 618 bp, Glycine max
  Peptide Sequence Number=SeqID_113180
atgtcgaagaaggggagggtggtggttttggagaaggttagggtttgggtggagagcatggcgaagggtgggcccgtgaaggacgagctcgaagcgaagaaggttgcggtacctcacaacaaaaacaacactagtagtagtaatggtgataacaatgatttgaagaaggaagaggttaacaagagtgaggggaagaaggggtttaagttgattagtttgactgagaagtttaattgtagggcgagggatttgtttgagattctgatggatgagaataggtggaggggttttacgcagagcaatgcgaggattagtaaggaggttggaggagagtttagtattttcgacgggtcggtgacggggaagaatttggagttggaggaagggatgttgattgtgcagagatggaggtttgggagctggcctgatgggattgaatccatggtgaggattatgtttgaggagcctgaagatggagtcactgttgttaagctcacacatagtgatgtccctgaagaagacagatatggaaatgcaactgtggtggagaacacagagaggggttggcgggatctcattttccaaaggatacgaactgcgtttggttttggaatttga

SEQ ID NO: 21496 - DNA, 135 bp, Glycine max
  Peptide Sequence Number=SeqID_113181
atggtccgggtagagaccaaaggtcttgagcgaccgatctggcaaaacaactcaaaaggtgatccaaaggttcaatttcttgcagtgaatgattggtgccaattacagcgtagcctagggattattcaggggtga

SEQ ID NO: 21497 - DNA, 479 bp, Glycine max
  Peptide Sequence Number=SeqID_113182
atggcacgcggatcgcggaccacagcccgccgcggaacgtgtagggaaggaggaggtgtcgtcggagatcaccaacgacggcgaggaatcgtcgaggaatgtgagggggtgggtggtggcgggggagtaccagaggttgatgtaggggagatggcggggccaagaggtggaggaggaggccacggagaagaggaggtggcagatgaaggcagagtagatgaggccgggaactacgaacgcgaggcatacaaaggtgaggtattttcacgccgggaactacgaggtacaaagcttatcagtagagagcatgagttcaatagctacgggatgaattacgaaaatgccaaccacgaacattctaagacggttattaacgaccgtcttagtatatacgtcgtagaaagcaaatttccgcaacttaattacaagtttgccaccgcttcacattctaagacggtcgcagataaccgtcttaaaat

SEQ ID NO: 21498 - DNA, 183 bp, Glycine max
  Peptide Sequence Number=SeqID_113183
atgacgagttctagtagtggcacagcgtgtgttgtggcgatgcaaacaaagtggagaccgagaggcgagaatggacgggcgaagagaaagagagtggaggcacgagaggaagcaatgacatggagacagagaggcctcgcgagaggttgcagtgccagcggtgagggagttttagtgttgtga

SEQ ID NO: 21499 - DNA, 3329 bp, Glycine max
  Peptide Sequence Number=SeqID_113184
atgggttacttcttgaaggctttttgcagattgttacgtatgggaaatctttgcagcaagagggagcgggatgaaatgcaagatccaactgtccatccttggggtggtttgaccacaacgcgcgagggttcattgacacttttggactgctacttgtattcaaagtctctgaaaggactgcaaattgtatttgatggagcacgtgcaagggagcgggaaagagaattgctttatcctgatgcctgtggtgggggaggccgtggttggataagccaaggaattgtgagttatggtagagggcatgggacaagggaaacctgtgccttgcacactgccagactttcatgtgatacgctggtggatttttggtcggcactgggagacgagacaaggcaatctcttctaaggatgaaggaagaagattttattgagagactcatgtacaggtttgatagcaagagattttgtagagattgtagaagaaatgttattcgagaattcaaggaactaaaagaactgaagcgcatgagaagagaaccttgttgcaccagctggttttgtgttgctgatactgcctttcagtatgaggtatccgatgactcgattcaagctgattggcgccaaacgtttgcggatactgtgggattgtatgatcactttgagtgggctgtgggaacaactgaaggaaaatctgacattttggaatttgaaaatgttggaatgaatggatgtgtacaagtcagtggcctagatcttggtggtttgagtgcatgcttcatcaccctccgagcttggaagctagacggacgctgtactgaactttctgttaaagctcatgcattaaaaggtcaacgatgtgtacattgcaggctaattgtaggggatggttatgttacaattacaaaaggggaaagtatcagaagattctttgagcatgctgaagaggcagaagaagaagaggatgatgatttgatggatgaagagggaaatgagcttgatggagaatgctcccgtcctcaaaagcatgcaaagagtcctgaacttgctcgagaatttcttctagatgctgctaccatgaaacttcttgaagaagaagaaaaggaaaaacgtgaagaagaagaacggaaggagaggaaaaggacaaaagaaagggagaaaaaacttaggagaaaggaaagactaaaaggaaaggagaaagatacagaaagaaagtgttctgaatcaatggatgttcctggatctcctgaaatctcaaaggaagaattgtctcctgctgctgatgtagagaaaaataattctattagaggtaggagttcagtcattgtaacagagggtgattatcctaaaatacaagatgaagacttcactggagagggtagtaatttgagaacacaagactgctcttacgatgactgtgagggagtcattgcaaatgcgcatcaccacacttatgatgactgggatggagacattgcaaatgctcaagacatgaatggtacttctacagttgagcaatcaaaattttattgtcaaagacttagattcaggaaagactttcgactggatgcgcctacaaaatggtctgacagacaccataatgcagttgcttcagaaaatggtgtggctgttggaagatcagagccaatacaccattcagataattttggggtgtcttccaggggaatcaatgggttgaacaggcaatctcgaataaatgttgcaaaatccaatagtcgaaacattggtcataagtgcagcgagaggttttatggttccaacagctggatgaacgacagatatgatttccattcatgcaattgtagcccgaataatagaaccaatagagttagttgggagacaaaacctgctagtaagtctgaatccacagtagatacatctaagcaattttatcgtggtagcaagtataatcatgtagacttcatgcatgagagtaatggaagaaccaaaggcagagtcatctcagggaactattccagcagggatttgcctcaatcaaagaaagtttgggagcctatggagtcacacaagtatgctcgtagtaatttagactctgatgtgacattggggtccacaggtcatggatttcagttcaatacagtaaggttttctgttgatgaagttggcggttcaggtgaaattgatgagggtgatagtaatttgaaaagaagcggaatgggtgaaggctgtcagaatgatcttgatgcagaagttggaggatcttgcagctccacagaaattgcatctgaggctggaatgtgtgtgatgggtggctctgcattgaataattcttctgatcccaatcaaggtaacacttctagttctgataactgctcatcatgcctaagtgagggtgataataatacaacctcttcaaaccgtgaaaatacagaatcctcaacatcggattcagaagatactagtcaacaatctgaagtgagagatagttcaacctgcattgacaatggattatctggctctcatggagctgagatgaagaaaatccataatgcaaatgatgaaggtttgactagcaggtcaccatttggtccatccttggatgtggcaagaggggatgtatccgggaatcctgtggtgaaaattgcacataagtttgataatggtttttcctccattagtatgtgttctcaacctcaaagcatgcttcctccagtgccaaaccaaaatattcaatttccagtgtttcggacttcttcagcaatgggttattaccatcaaaatccagtttcattgccagctgctcccacaaatgggttgatgcctttcccacacacaaacccctacttatatgctggcccttttggatatagcttaaacgaggatccacgcttctgcttgcagtatggtggcttacagcaaccaacacccctatttaacccagttgcatttccagtttatcagccaatcgccagagctaaaggcttaaatacagaggaatcgactctaatgtccaagccaacatctatgctgccagagcatcttaatagatcttcagtagaaaaggtttctctaaccggagctaattcgcaaaaagcagcattgaatggggaagttggacatggtaattctgcaaagtcaaaagacagtggtttttccctgtttcattttggtggccctgtagacctttcaactggtcataaatcggcaactgcatcttcaaatggcgacaatgttggagattttaacttaaagagttcagtagatcaagttgacgatgatcatgaatgcaataaaaaagaggctactgtcattgaggagtacaacttgtttgcggcaagtaataccttgag

SEQ ID NO: 21500 - DNA, 144 bp, Glycine max
  Peptide Sequence Number=SeqID_113185
atgggtcctaggagggatggcaacgcgacactgttggaccatggtggtactgcggtgtgggatttagtgagtggggaaaagaggaatttcctaaggattggtagtgccaatagcattattggtagtgagaatagtaattcctaa

SEQ ID NO: 21501 - DNA, 462 bp, Glycine max
  Peptide Sequence Number=SeqID_113186
atgtcttccaaggttattttgatgatgccaaagaatcaagagttaagcaaagtttcaagcaaagattcaagaatcaagtttcaagattcaagactcaagaatcaaggtacatcctttgtggtacaagtagagggtacatctacttgggttgttgtaactgagaacaagagagggtacatttcttgtggatcagttcaagtggagggtacatccacttggttgttcaaagagaacaagggagggcacatcccttgtggatctttgcttgtaaaggtttttacaaggttgaaaagaaatctcaaggatcgtaggttgcttggggactggatatgtgaaaaagggaggtacaacaagcaaaaaggagaagaaataaagaaaaaaagaaggaaatcagaggaagcccaagtccagcaaggcgctcagcgcaggacgcgcccagcgcgcaagaagtcaaggcgctaa

SEQ ID NO: 21502 - DNA, 1659 bp, Glycine max
  Peptide Sequence Number=SeqID_113187
atggtttctctctcaggtgttgaaatagatcttccgaggataaaattgaacacagatgataatttctgtaggatacctattactgattatcatcgatgctgtccaagttgctcatatgatttgtgccttaattgctgtcgagatcttcgagaagccactgcagatcacaataaagaacctcaaacagaacaagcaaaaatttctgatcgaaatatattaagtaaatttctgcattggagatccaatgacaatggaagtattccatgtccccctaaggagtatggtggctgtggttattcttcattaaatttaagcccaattttcaagatgaactgggttgcaaagttggtaaaaaatgtagaggaaatggttagtggctgcagaattagtaatgttgatggtccactggaaactgggctgaatgatctcagactttgccaatactctcatagagaagccagtaatgataattatctttattgtccagcatttgacgatatcaaaactgatgggattggcagttttagaaagcattggaaaactagtgagcccattattgttaagcaagtatttgatgggtcatccattttaagctgggatccaatggtcatatggagagacattctagagacaacatatgggaaagcaaaagatgaaaacgggatggttaaggccatagattgcttagatgggtctgaggttgatattgagcttgctcagttcatgaaaggatacttcaaagggcatattcttgaaaatggttggccacagttattgaaattgaaagattggccttcacctagcgcttctgaagaatttctactgtaccaaagacccgagtttatcagcaaactacctttacttcagtatattcactccaagtggggccttttcaatgttgtagctaaatttcctcattactccttgcagaatgacgtaggacccaagatatatatatcttatgggattagtgatgaacttggtagaggtgattcagtgacaaatctccacttcaatatgcgtgacatggtgtaccttttggttcatacaaatgaagtaaagctgaagaactggcagataactaaaattgaaatgatgcaaaaagataaagctaataaggaatcagaggcaaaagaatcagggatcctcaaatatcttcaagggggagttcaccttattccttacttgactcttggggcattttcaaccccaacaaggaaatccagcactatgggaggtagattcggatcagcattacactgtcaagaaacatggtctgttttaagcatgagcagattgggcggtgcagcggcggtggcaccccttgttgccgagcataattggtttatatatcttgtttttggtatgcacaacaggaagaatgttgaggtgttctgctatgccttgagtgttaatgatggtactgaatggaggcaacgtattcagtctgaagcagagcactttgtggatgtatctgccatgtcattggatgcaatagcaaaaatgattaatgaggataagatacatatccttgtcaacctaaatggttatacaaaggtagggggttttgagacaacttgcacccaacttgtcaaaatatctggggaaaaaaaatttaagacgaaaaaaaaagaaaatctaagacggatattggcataa

SEQ ID NO: 21503 - DNA, 621 bp, Glycine max
  Peptide Sequence Number=SeqID_113188
atgcctagggctttgacaagccggtccacggtgagcctcacgttccgaaatgactatctttgtgcaatggagagaaagagaagaccaatgtttaactacatggatagagttcaacacatggttactgtaaacatgagaggaatctttatggattggttagtggaagttgttgtagagtacaagcttctctcaaaaacccttaatctctctatgtcatacattcataggtttttgtctgttaatcctatgagcaaatcgaggcttcagttgcttgatgtttcttccatgctcattgcttcgaagtatgaggaagttaatccacccggtgttgacaaattctatagcatcactaataacacttatgaaaaggcagaggaggctggcatccatgtgaagaggctacattcagctgaaggtgcagaaattttaccacgtcctgcagttgtaatagtgatggttttgggtagccacagctacggagctatcaaaaggcttaaactaggatggtatgtgatctttgtgacatcaactccaagcaaggtccacaaagctgttgatgcatgcaagaatgttcttagaagactgcatagcaagaaaattactgagagagagttggacagg

SEQ ID NO: 21504 - DNA, 402 bp, Glycine max
  Peptide Sequence Number=SeqID_113189
atgactagaatagtcgaacttctagtcatcaacaatggtgccttcaaaatgtgcaccttgactggagtagacgatcatggatctgacaaggaagggggaagtggtgctctgggtgctttggatggtccatggtatcgatgggcagcagcggcgaggaaatggatgagccctttcgctttttcaataattcagccatttgatgaaggttttgcagatttcaattggttgaatcaaaggaggattcaaaatgatgaagtttgggcttcgtgggacgtgatttggttgagaaacgagggagatatgaggattggaagtttttggagaaaggggacgccaaaactcgtgattttcatgactgcagcttctgaaacgtggctatttatagaagatggcgttatgtaa

SEQ ID NO: 21505 - DNA, 270 bp, Glycine max
  Peptide Sequence Number=SeqID_113190
aagatacagctgaataggcttgaggttcaatcaatcaatcaattcattcagctcaaactggatgcaagggataattcattcaaacacaagatggtggaaatgcctatggggtctgagctggagtggtctcctcctctgctgctgctggtgatggtgctggtggctcctcagtcacaggctcctaggcggcagaggccctacccattccagaggaagaaggctggtctcctggccaggccacctgtgcatcaaactcctccatgctcataa

SEQ ID NO: 21506 - DNA, 1806 bp, Glycine max
  Peptide Sequence Number=SeqID_113191
atgagcggagtgaaggggaagaagaaggcagcgagcttcgtgatcgattgcgcgaagctggtggaggataagattatggacattgtttctctggagaagttccttcaggataggattaaggttggtgacaaggccggtgcacttggcgattccattaccgtcaccagggacaagagcaagatcatcgtcacctccgacagcaacttctctaaacggtactctcttcgccatgctcctcttctacaagctttaggatttattgaaaccccgtatatcaatcttgataaccctttggccatggaattaatggaagtctatgagtccatgggcgacacattagcctttcaatatgggggttctgcagcacacaataagattcggatacgcgagatacctgttcttgataagttacagtatctccacgtgctgctgtcctcggtgcttccggtgataaagcagatccgccgtgaacagtgttttcaagtagaacttgaaaagaagttgcgtgatcttcaagaagcaactgcagatcacaataaagaacctcaaacagagcaagcaaaaacttttgatcgaaatatattaagtaaatttctgcattggagatccaatgacaacggaagtattccatgtccccctaaggagtatggtggctgtggttattctacattaaatttaagtccaattttcaagatgaatcgggttgcaaagttggtcaaaaatgtagaggaaatggttagtggctgtagaattagtaatgctgatggtccaccggaaactgggctaaatgatctcagactttgccaatattttcatagagaagccagtgatgataattatctttattgtccagcatctgacgatatcaaaactgatgggattggcagttttagaaagcattggaaaactagtgagcccattattgttaagcaagtatttgatgggttatccattttaagctgggatccaatggtcatatggagagggattctagagacaacatatgagaaagaaaaagatgaaaacgggatggttaaggccatagattgcttagatgggtctaagcttgctcatttcatgaaaggatacttcgaagggcatattcttgaaaatggttggccgcagttattgaaattgaaagattggcctacacctagcgcttctgaagaatttctactataccaaagacccgagtttatcagcaaactacctttacttcagtatattcactccaagtggggccttttcaatgttgtagctaaattgcctcattactccttgcggaatgacgtaggacccaagatatatatatcttatgggattagtgatgaacttcgtagaggtgattcagtgacaaatctccacttcaatatgcgtgacatgtttcatcgccgcgatgaactccttcgtctttggcttctcggcgaactccgccacaaagtcctccaccacgacggcactggcggcagcgctggcaacagcggtggagatggcgaggcgcttctccttgcggttgatcttgatggaccagtcgcagggcttcgggccgaaggtgacgcctccgccggggcggaggggagtgcggttggagccgcggtaggcgcggccggtttttttttgcgggaagggcttccggccgccgcctcggacctcgctgcgggtgagggtggaggcggtgccgcggtgcttgttctggaggatgatgtgaaggaaagagaggttgctgtcgttggtgtggagagagagagggaaagtgaagccattgttgtttcaagttctctcagagagttttgctcttttttttag

SEQ ID NO: 21507 - DNA, 300 bp, Glycine max
  Peptide Sequence Number=SeqID_113192
atgtaccctctcttgttctcagttacaacaacccaagtagatgtaccctctacttgtaccacaaaggatgtaccctccaatgtgttaagacaaagttctcagacgggaagaataaaaaaattctcagactgtgtcattttgaattctttgaaaagggagaagggaggcacaaaagaatttaggcagttagtccttcattcttttggaaaagggagaagggagacacaaaaagaattcaggtggttagtccttggcgaattctttttggcaaagggagaagagaatgaaaaagatgaatag

SEQ ID NO: 21508 - DNA, 453 bp, Glycine max
  Peptide Sequence Number=SeqID_113193
atgatgcagacgctaagcatcaatgagtttgatgagttcaaggaggaactcgagagacgcccctgggatgaggaattgactaatttcattgacggtaacattgatgttgccattgtaaaagaattctatgcaaactattatgaccccgaggataaatcacctaagcaggtgagggtgagaggtcatttgattaagtttgatgaggccactcttaacactttcttgaagacccctgttattgtggagggggaatcactctatgcttattctagatttgcactcctaaggcttgatcctcaggagttagatgccaagctctgtatcctagggagtggattcgagcttaatgttgatgggcagcccttgaagattctgaggagacatgactactctagctcagacatggacattttttccttcttgaacttgattcccacctcccacacttctgat

SEQ ID NO: 21509 - DNA, 559 bp, Glycine max
  Peptide Sequence Number=SeqID_113194
ggtacatcctttgtggtacaagtagagggtacatctacttgggtttgactgagaacaagagagggtacatctcttgtggatcagttctagtggagggtacatccattaggttcaaagagaacaagggagggtacatcccttgtggatcttttcttgtaaaaggtaaagtactacaagagcaaggaaaaaagattgaggatgatgaagatgcaccccttactcgctacgttaaggaaagactaggcatactcttcaagcatgaagtgattgcatttcaacagaaaagggatttgaatagtagggattggcaagctctacaagggttctcattcaatattaaactttcaaactccacattcatcttcactcatcaagtcaagccaatcattgaaaaggtgaattttgatgatgagacccttgttgctactgaagatttggccatagaagtttatgatggcccttctccatatcggaagtatactaagaccccaattaaggtttcctctgatgatgactctagagatgatttcttgcacaagatcgaggagcaagatgccaa

SEQ ID NO: 21510 - DNA, 216 bp, Glycine max
  Peptide Sequence Number=SeqID_113195
atgcaaaacgccagcatgattggcgcgtcctttgttgcggcgacacgtggtagtggcgccactgccactggtgacaccagtggtatcgccacctgcactggtgctttggccatgcagggtggactcgttggtcagcttggcgccaccagcctagggtcagctttttcaggcagcttccagctttttcagatgacagtgtaccatacaaggcgctga

SEQ ID NO: 21511 - DNA, 741 bp, Glycine max
  Peptide Sequence Number=SeqID_113196
atggctaacaacccctccagagctcaaaagaaggccaagtcctccaagaggaagcaagaaaagcttgacacgtggttcatagatgagaataagaagaacgatttcaagattatatacgcagtgaataatgcgagaatccctaagtttttggacttggagtggttttctcaacaagggtttaacttccctaatctactcgaagcacagggtctgtccaagtttatacagatgaaaggaactttctacccgaagctggtgaaggtcttctatacttgtgcccaagctgatttggaagcccgcaagtttgaagaatctgctgatggttacaacaagatgcaaacttacagaggtatgctccttggctcaacaaggaatctgaggaatcgcttagatgtaggtggtttaattgctaaagatagaatgcttgtgtatctcataacatacattctcacaccaatgtctagcaaccatgcacaggtgactgacaacgatttacaaatcgtgtatggtctaaaatcagcctctagattcattgattattttcatatcgatgtctttaatgagatagttgatttcaccagagcatctaatgagaaaaccaaaaggcatctcaagaagcttgggatgagatttgttgaacatgaatggattatggctggagagccaccaacagaaacaaacatggaccagatggaagaagaagcggaagatgaagctcaacaagagtttgcacaccaatga

SEQ ID NO: 21512 - DNA, 123 bp, Glycine max
  Peptide Sequence Number=SeqID_113197
atgacgttctggttggctgaggtaggtggcgggagtaaaagttggagtaatggaggttttgatgagatgaagatgaagaaatgtaacagattacacgcaacaaacacacaagtaattgattaa

SEQ ID NO: 21513 - DNA, 936 bp, Glycine max
  Peptide Sequence Number=SeqID_113198
atgaatgtctgcagaactctgaagagattggaggaaattttgggatacttggcggagattctgccaaaattactcactgttgaggggagagaagctgcagagaagagaagaagagactgtcgagtggaatcagtcagaaggaggaagcaacttgaaagtgtaggaagtaagagccctaacatggttatggttgtaagagaaggattaggcctttggattgatgtgaatcccccagccccccgctctttcggactcactcacaccaaagacttcgataaggaaccactagagaagatccttcgacacagcagaagactattcaacacagtagaggaccctttggcggaagggtctttgaaatgcaaagaaatcgttgcccttcagtacgagaacgcccacccccgagagacacacaggtcacgaaaacctagagttaacctgctggaaggaggagaggccaaatcaaccttgaaccccttcgtccctagcatcatggaggagattttttcttccaactggaagaacttgactatggagaagtatgatggtaccacagacctagacgaccatgtggatgtgtacattacccaggaatgtttcagaaaggttgcattgaacatccaaaaccttgacccagcagtggctatacaccatttgataacggtgttacgaccaagaccttttgccaaccgcctatacaagaaaccaacatctgatctcgacgaattgtggacaagagcaactaagtatatgcagatggaagagttagccaaggatcaagcctttgctgtcaacattttgatcatgcctaaaagagctaacaccccactcgacaaaggaatgcaatgccttgaaggacaagataaaagaactcatcaagcttgcctacctaaaggagttcgtccacaagccacagccgtacaggctcgagtctag

SEQ ID NO: 21514 - DNA, 615 bp, Glycine max
  Peptide Sequence Number=SeqID_113199
ggaacccttacagatgctcagagatttcctgtagcattcattaatggtaatcttgcatctaaatctccctactctgaattcatctctattgaacctgttgaaagggaaaccattagtgtccaagctcctacatggacgaagtatgactatgagcacacatcatctgaggcctttaaagctctaccaacagatgaagaatacttatctcttggaaatcttcatgcacaaatgtatgaaagagatcaagccactgcctacccttttggtctacacatctcaagggtcatcaatgtcaagataatagttgacaagaaccagatcctgtggacagacactaaaaaagcctccacttatggttatgatggaaggtataatgttgaggaccatgacgtcatgcaagtgttatgtcctgttaggaagtatcactatgatgatgcttatgtctgctttacaaaggacgctgacaataactcgttctttcaacgcatactccaacttcctaccattcaatatgaagggacttataatctaaagaagatgactaaagaacaaatgatagctcatgtgactcaactccataaagctcaacaaaataagaaggttgaagaagaataa

SEQ ID NO: 21515 - DNA, 579 bp, Glycine max
  Peptide Sequence Number=SeqID_113200
atggggtgggtacaaaggcggggacaaaacagggtgaggagtgacatacccaaatccgaaccaaaccatgctttcccaagtcgggcaaaatccgatcccgatcaaagcgagttttcaccatcaaaatcaaggcaaggtcggataggtacccatcagttcagtttttattgtcatgcccaagttagagcgacatgggtaaactccatacccaaagggatgcttttcataggaatcaagtcaaggacctccttgtggaacatccatgtacacactctcaagcctttcgggtttagcacgcttccactagattatgttgagattgagtggaaaaaatgtggtggtggtgattgtggggaaaggatgataaaggtggtggcgattgttggaggtgatggtggtggtgatggaggtgaagatggaggaggtggtgttgggcctaaggttagtggtggaggttcaaaagataacaacacaaaggttggagaactgagtggtgattgtattctgcatggagagcttgaattgctcattttctttacgttgtcgttcggcgaaggattccactatgataactgctaa

SEQ ID NO: 21516 - DNA, 66 bp, Glycine max
  Peptide Sequence Number=SeqID_113201
atgcagggtaaggaaattgctcgcagattttcgaattggcaagctcatcacaggttatgtgtttga

SEQ ID NO: 21517 - DNA, 417 bp, Glycine max
  Peptide Sequence Number=SeqID_113202
atgtgcaaagtaacatctttctccagaggtgcaagatccttttgcaaaattctcacacagcttggtcttgaagttgcttccaaggggcaaggggcaagggcaccaggaacacctggggtagattttggtggggcagacattgacacagtcaataatctgcttcgagttcacaccacccttccattgatagctctagcagatgaagcttctacaatgatcttggtggtagaaatggcaccaaaattaccagccaacgcgggaggaggctctaatcgaacaaccatacgacccccttgccggattatcatcatcatcatcgattggtggagcaataggtttgccaagttctcattcattcaccatgagcaaaaatggcacttgccaccaaatttgcatcctttggcaggatcgaactag

SEQ ID NO: 21518 - DNA, 384 bp, Glycine max
  Peptide Sequence Number=SeqID_113203
atgatgatgatgataatccggcaagggggtcgtatggttgttcgattagagcctcctcccgcgttggctggtaattttggtgccatttctaccaccaagatcattgtagaagcttcatctgctagagctatcaatggaagggtgggaacttttgaacagattaaggaagcaagtaacatggtaaaagatttactattgactgtgtcaatgtctgccccaccaaaatctaccccaggtgttcctggtgcccttgccccttgccccttggaagcaacttcaagaccaagctgtgtgagaattttgcaaaaggatcttgcacctctggagaaagatgttactttgcacatagagctgctgaattgcgcaagtcggcatttaaagtga

SEQ ID NO: 21519 - DNA, 345 bp, Glycine max
  Peptide Sequence Number=SeqID_113204
atgtattacgacgagaagtggaacataccacgtcaaggtgagtttttgggttactcctttactggaactaatccaataagatttggcattccttcgggatgtggcatggagaaactcaaggatttaatcaagcaagttgcacatacagggattccccctaatggaattcatgaatcacaattggttagacaattgttctttcgacaaccaggtcattctaagtattctgaaaatttgattgaatatgacataacagaattgaaaaatgatcaagacgtgctaaaggaagaagggaagtcggggtgccagaacccgacttccatgaaaagcatgaaagtggtgtag

SEQ ID NO: 21520 - DNA, 309 bp, Glycine max
  Peptide Sequence Number=SeqID_113205
atggatatctctgaagatattgacatccctgtaatcttgggaaggtcgttcatgttgactacaagctacatagttgacatgggaaagagaaagcaggagttaggttttgaagaccagaaaattgatttcaacttatttgtggaaaacaagcctgctccagaacacaatgtttgcttgcagccacgagttcgagcgcttagcgcaccaccctggcatctgaggttgattatttctgctaagctagccaaggtttggctaagccaaaatcaattcgagttgaattccgctaagccacagactgatcgctaa

SEQ ID NO: 21521 - DNA, 166 bp, Glycine max
  Peptide Sequence Number=SeqID_113206
atggcgtggaatgtcttgtctcacctttgtcctaggactgcgtgtcgcaacctacccttcggcggaagggcgacgcggggctcacgggtgggtcttccatgggaggagaacgcgcggagtcgccaccaacgtttattcaaggaaaacgtcggaaaaaccggaaaag

SEQ ID NO: 21522 - DNA, 270 bp, Glycine max
  Peptide Sequence Number=SeqID_113207
atggatgcccctgacttaccagaggatggtgaggacccgctccctgatgtagattctccagaggatattatgtcagcatctgaggcagactctacagaggagagtggccctggagggacaacgaatacgttgttacgcctgcaagtggcttcaatttccaagttgataggagctaaatctccaggtgcagttctaccttgcatacacaaaaacaagaactatcatgaaaattatggaagaaaagaatgcaaaagaaaaattgtaaaataa

SEQ ID NO: 21523 - DNA, 588 bp, Glycine max
  Peptide Sequence Number=SeqID_113208
atggttaccgaatcggggatgaggactttactgaggtgggcaattggggatggtgtacttatgcctgggcttgtagaaatgggatatttgttttgcgccatcgcccgattgccacctagtaccacatatgaaggagtggtacctgaggatatgtcgtgggggtcaggagaccttggggacgtcaggtggggtgctattgcccaaaaccaagcttggccaatcccgacccaacccgggcatagtcagccaatcgcgatggtagcacagttgatccatgattgcgtcgtgatggagtgcctagagggtgtttgggagaccctcgaaggcaatgagaggtgccaattccgtggcatagttcgactcactactacttcgctagtacatctggagcaacccgcacgcacacttcagcagcctgtggagtggatactacctacgcctactccatatcgactagttgagcctgttcaattgatagaggtgtcatcctctgaagaggatcttgaagaggacctagaggagttacctcctgaacctgctatggatgcccctgacttaccagaggatggtgaggacccgctccctgat

SEQ ID NO: 21524 - DNA, 387 bp, Glycine max
  Peptide Sequence Number=SeqID_113209
atggaaattaattcatcttctacatctcgtgatatcaaatgtttcaggtgtcaaggagttggacatattgcttctcaatgttcaaataaaggagccataatattgccggataaaggaggcatagagagtgcaagcttaagtgatgacgaaatgtcacctttggaggatcatagtgatgttgatgttgctgaacttgttagcctacaggtcaagtccagaagaagaaaaggagattcaaagcaagttgatgagttcttgcaagagggatttataagggaaagtgttagcccgtgttttgttcttgtgatcttggttccaaagaaagatgagacatgttatttgaagagtggatactatcaaatccgaatgaaagaagctgatgaatga

SEQ ID NO: 21525 - DNA, 681 bp, Glycine max
  Peptide Sequence Number=SeqID_113210
atggttgaaaggaagaggggaatccttggagggagtgttattctatttttggtccaatcagtcaaatctttatttggtaacaaattggtccaacctgctggattcaaattccaaagacaaggatgggatcctggagtcaagaaagatgctgcaactgttgatgaagaaactacaacaacactagaatcaattgagtcgttgaacaaagaggtgtttgtgaaggggggtggaattacccatggtagtggtcttgactacggtagtgacttgttgcaatgtttggagacagaaaacaaagttctagaaggagaatttgggttgctattgagggtggcaattggaaccaaagggggtgttccaaatctgattttgctattgagggtggcaattggaaccaaaagccatgttccaattctgattttgatagtggcaattggaaccaaagggggtgttccaaatctgagtttgcttttgagagtggcaattagaaccaaagggggtgttccaattctgattttgcttttgagagtggcaattggaaccatagggggtagaatggtgccaaagtataatgagagtaaagacattcagagttcagaacacatggaggatgaggaaatggctcagaagggggatttaatgatctttcagggtggagaggaccttacaataggtcaatag

SEQ ID NO: 21526 - DNA, 345 bp, Glycine max
  Peptide Sequence Number=SeqID_113211
atggtgcctaggaaactactaccagagagaaatgtagtagtatattacactgagtttgatgagttcaaggaggaactcgagagaagacactgggatgaggagctgactagttttgttgatggcagcatcgatgttgccattgtgaaggaattttatgcgaacctctatgaccctgaggataaatcacctaagaaggtgagggtgagagttgcaacaacccaagtagatgcaccctctacttgtaccacaaaggatgtaccctccaatgtgttaagacaaagttctcaggcggttagtcctttgaaactttgtaaaggggaaacaaaagatatctcaggcggttag

SEQ ID NO: 21527 - DNA, 348 bp, Glycine max
  Peptide Sequence Number=SeqID_113212
atggcgaataagggagcttgtaaaactactttaaatttgaaatatgccttgtacttatttttagattcaacctttagctctaaagttgaggcagggtctgttatggacgtggatgccgtcattgctgccggcgggagagcttgtaccgccattggcaacagcggcctcaatgcataccgtcattcttcctggcgggacatggtgactaggagagagatgggcacccatcctgccattcgtcctggcgggacatggctgacgaggagagagggagccatgccgccactggtactggcaggacatgccaacgtgggcagtcctgtcactgcctcctgcggaacacgttga

SEQ ID NO: 21528 - DNA, 1062 bp, Glycine max
  Peptide Sequence Number=SeqID_113213
atgcaacagaaagtggtgttgagcgagagcttcgagaactgcctacaaatgttcaagatgtgtctccaaggtggggctatagacgagaatattgtcgaagaaggctgcaacaaaccgacggatgaacgacttaaacaactgattcatggttgcttgaattgttgtcggtgcgttggaaagactgaagggaatcactttgtattcgtaatgtccctggtgagtgcagaatgcggtcttatggatgtcggtggatgccatggggatttgatggaagccttgacgaagttcgtcaatggttggcattggaaaacgatccttgatggtgatcgcgttcaatgccctgtaatcaacacaacacctccagctaccatccttcttcttgaccatcaacactggggaagaaaaggggttgtgacttacttggatcaacccggtttgaagcatattggatatttggcgttcgagctccgctttctggttgtgtgggtatcggtatgggtgaatattaacagggtggatggttcctggaagagatgggcatatcggtggaggatgggtaatatggcaggaggtgtattagagggggaagagttgatggtggttggatgcggggaggaggggaacatctgccgtgagctggactggggcgcccaaccaggtgaaggacatcgtccgagaggtgtagtcagaaactatgggccccaattcttgggtattagggtagaccttctggcatacgagtgtgccgccatcacctaccatgacacggaggggggcgatgtcggtggagggcagcgagaggaaatgggccaaccgagctttttgccatacattcgaaaatttgcgggggcaggcatgccggaaagggcgttaagactcaactgtggtgtgttcggtagtgagaccaagggttcgtcgccatctgagggaggtggcgaggtttgcagcgatgaccgacaacccatttttcgtcacactgataacagaggctgcggtctctgtgagaggctaactcttcaggtgagaagtaccgcacaaagagtttggtcagaggtggggtag

SEQ ID NO: 21529 - DNA, 294 bp, Glycine max
  Peptide Sequence Number=SeqID_113214
atgcagcgagtttggctgaaatatgagtcatctgtcaaggtttggctgggaaatggaggggctgaggggccacttagaatgaaagaagagtatgttgaaggggttttcgtgacaccaacaattattgaagagagagtaccagaacagcttaaaggggcacttgggcaggcagctaatgctttacaacaacttcctgcccctatacgcgatcctgttgctagtgggctgaaagttcctctaagtaagctactgctaattttctatactccacgtctcaacaagtcctctgactga

SEQ ID NO: 21530 - DNA, 696 bp, Glycine max
  Peptide Sequence Number=SeqID_113215
atggcaaatggcaaccacccatgccttactcacccacaacaatccaccatcgaaaacaaagagtggttcaaagattatagcggtgtggtgactaggttgcaacaaaggttggtgcacagtgatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttcctcctggcggctccctcgtgcgctctcctgttcctgcctttcggtttaccggtgtcattccgctgtatggccgcgttgtctcattccacgcctgacactcagttccgg

SEQ ID NO: 21531 - DNA, 126 bp, Glycine max
  Peptide Sequence Number=SeqID_113216
atggctaaagagagggtttcccccataagagatgttcgggctttggatgcccaaggtagcttaaaatccacacgacctcgtgctcaacgcactccttctggacttagcaaggtgatcacaagctga

SEQ ID NO: 21532 - DNA, 1482 bp, Glycine max
  Peptide Sequence Number=SeqID_113217
atggcagatggtgaggatatccaacctcttgtttgtgataatggaactggaatggtcaaggctggatttgctggagatgatgctccaagggccgtgttccctagcattgtgggtcgtccacgccacactggtgtgatggttggaatggggcaaaaggatgcatatgttggtgatgaggctcaatccaagaggggtattttgacattgaaatacccaattgagcatggcatagttaacaactgggatgacatggagaaaatctggcatcacactttctacaacgagctgcgtgtggccccggaagagcaccctgttctcctcacagaagcaccacttaatcctaaggccaaccgtgagaaaatgacacagattatgtttgagaccttcaacactccagctatgtatgttgccatccaagcagtgctttctctttatgctagtggccgtacaactggtattgttctggattctggtgatggtgtcagccacacagttccaatctatgaaggctatgccctgccacatgcaatccttcgtttggatcttgcggggcgtgacctcaccgatgccctcatgaagatcttaaccgagcgcggctactctttcaccaccactgctgagagagaaattgtgagagatgttaaggaaaaattggcctacattgctcttgactatgagcaagagctggaaacagcaaagacaagctcagctgttgagaagagctacgagctacctgatggacaggtgatcacgattggcgcggaacggttccgttgccctgaagtgctcttccagccatccatgattgggatggagtctcctggcatccatgagaccacatacaactccatcatgaagtgtgatgttgacatcaggaaggacctctatggtaacattgtgttgagtggtggctcaacaatgttccctggcattgctgataggatgagcaaggagatcacagcattagcaccaagcagcatgaaaattaaggtggtggcaccaccagagaggaagtacagtgtctggattggaggctccattttggcatccctcagcaccttccaacagcattccatttctgtggctgaaaaacatcctcgttatcgtcatagtcctcaagggtctcgttggtgtggtgtcggtgttagcgaggagggaatccctgttggaggccttgcgctcgatccagcacgggcaaaggacaacacgggtctagatgtggatgccctcaatggcgtcgacaaggaggagggcattgtcgctgagtcgggcaatggcggagacctcgttgcaaaagtcgatgtggtcgagggagtcgatgaggttcaccatatagcagaggaggatggaggagttcttcatcgtgatagtgcggcgttgctcctcatccaagtagtccatgaaccaaatgcaaccattgagcttcaggtggacgacgtcgccgcccgtggcaacgcaagcagttttattaatgaaatataa

SEQ ID NO: 21533 - DNA, 1070 bp, Glycine max
  Peptide Sequence Number=SeqID_113218
atggcttctagtgcacaaatgctcaaagatattgctcgatcacacgattcatcacttcagtttggccatctgtttgaggatgatacgctgatctcggttgaagacgaggctttgcggcatgccatgaatctttccagtgatttccatgaataccctggccactgtcatggcggtgtagtgctgtcgatgaaatccagggagagatcctcctatggtttcaacggaattgacaaagttttctcccaggcatgccagtgtttttgcaattcccatgtggccgccggtgggggtgctatggaattcagcgaggatcgtggatatggcttggaggcccttagggaggatgaagtcatgactaatggtatagtctgggtattcctgagggttggcttgaatgcaccgacgaaactcgaggaagttggtgttggcatctgccgccgcgttggatcttccgacgcgataatggatggtgcttcgatgatcagtcagaatcatgaaggaattgcccaagaggtattgtctccactttttaacaactgtggtgatggtggcgagcttccggacataggtggatgcatgcaggagcttggagcagaatggtttgctaaaaaatgctatcgggtgatttctatgagacaaaaccgctcccatgccgatgccggaagcgcatgtttggcctcaaagttccagtggaatgaatccttggcaagcagtgtcaatcccgacaagccctggaagcctcgcaatgctctggtagattggggagttggccaattttacaccgcttctatcttcgccggcacgggctctacgccacgacaagacacaatatggcccaagtattccacatatgatgtggcgaaggaacactttgaaagcttaaggaagaattggtggaggttaaggacctcaaaagctgttcgcagctattctaagtgctccgaaaaggggccagaaggttctgttcattggtacctgaaaggtcgatggggcattgcaaagcccaaacggaattacaagaaattcgtaatggtcatggtgagtgcagaaggcggtcttgccaatgtccg

SEQ ID NO: 21534 - DNA, 252 bp, Glycine max
  Peptide Sequence Number=SeqID_113219
atggttggagcattctcgcaaaacactgtgaccctgactggtctccctatgatattacctagtgagagtgacttgacttattattgtgtgcctcaagttgaagactgcagtgtctttgatgatcatgagaacttagttgagtatcatgtcttgggtttggagcaaacaccattgcctttaggatcagatgtttcaggtcttggaagaagttgtagtgtaccactatccaatgaagcaacatggaatttaagg

SEQ ID NO: 21535 - DNA, 300 bp, Glycine max
  Peptide Sequence Number=SeqID_113220
atgcagaccgagaagatgcactggcgacatcttggggatacccgtgcgaagacaagtgcagtggaatgtcttgatcagttacccaaaaaatattgggtacaatgcttcaatgatgatgagaaacattggggagatatgactacaaatttgtttgagttggtcaattccatgttcaaaagcacaagacatttgctggtgtcatcgttcgttgaggagatgtacattaagaccacaaaactctttgctactaaagggtcgacaaacccaagcaatgatcaactctggctcgcagtattatga

SEQ ID NO: 21536 - DNA, 219 bp, Glycine max
  Peptide Sequence Number=SeqID_113221
atgtttcacggacagtggtacttacctttgatggaaacttcactgatcaacttctccggcgttgcttcacagagattgaagacacaaaggcatagtgcaagattagtgaagtgtagatttcatgaactcgctaagccacttatcttcgggctaagcgcatcattcgctaagcgcccaatctggtggctaagcgcatggacaattctggaaggaggttga

SEQ ID NO: 21537 - DNA, 405 bp, Glycine max
  Peptide Sequence Number=SeqID_113222
atgggaaataagtggaaagagtcttcttggttggctaactttagttgtcgctgtagagcaacgacgctcgccgcagagctagcaacagtgggaggggacgaaggcgacccagcattgtggctacgcttattgcggggtgaaaccctaacatccccactgccattctttctcgctcccccaaaagcagaaggaggaaggatcatggtcactggaacgggttccccatccaaagaggtagcagaaggtcacgccctcctacggtggcaagaagcacctccgccaacacagcacaagtttgccaacctcttagagaaagtggactttctatcagaagctccatggtgtgtctcattcgaggaggagctactgattagaatgacctcccggtccaacaggggttactga

SEQ ID NO: 21538 - DNA, 663 bp, Glycine max
  Peptide Sequence Number=SeqID_113223
aacattcactcccagaacatccttccggagaggaacgtcgtcctatacgtcacagagtacaacgagttccgttgggagcttgagaggggcaccctggaagctcctgaggaaggacctcaccactttggcgttggtgatgaagatggatatggacttgggctcgctcatttctgggtagatctcttagatggcccagaccaactcctctcggcttggctttcctacactcatcacaaccttgcttctacttctgctccttcctcctcagctccagctccttctgctccaattccaccaccaccagcatcagccccaacaccttccggcacctccgctcagagcagagttatcagtgtcgatgttacaaagcctacaccatggcttatgcctagtgatgcagagtatccacgacttggctcagcattggcccatcatgagcatggaggcatttatggcctaggtgaggctcctacagcccaggagccgcatccagagtcgcagccacagccggaggtgacacctgaggccactccacagacttcacctgctgccacaccattagtggaggtttcagaggatgaggatggcactaaggacactgattatgcagctaatttggcagcggtgcagagcacttgggatccctggcccactacagcttag

SEQ ID NO: 21539 - DNA, 126 bp, Glycine max
  Peptide Sequence Number=SeqID_113224
atggataagagcttgaaggtaggagaagatgagtggagggagaaggagaggaacacaaaattttatgcctcaaatgagcccactaatccaagatcaagtccaagattctccactaagtgtgcttag

SEQ ID NO: 21540 - DNA, 294 bp, Glycine max
  Peptide Sequence Number=SeqID_113225
atgagacagttggtggcatgtgaggattaccctgtcttgcaaggatactccaactcatgggatcaacatgtgccacacgaagattctaaaccgaataaccccaaaaacaaagtcaatcttcaacttattcatgtcttcccagggggctttcaactgtcgcaacgtgcccttcgcgggcgagcgagggcgaggctcacaggtgcgttttccaaaggaggaaagatgcgcggagtcgccaccaacgtttatttgtggaaaacgtcggaaaaaccgaaggaaaccggtcaaaaataa

SEQ ID NO: 21541 - DNA, 519 bp, Glycine max
  Peptide Sequence Number=SeqID_113226
atgaaacttcaagaagcaaaggactccattgatgaagaagatccaaggcctacaagctctacaaggagccacatcaaatcttataacattcgacagaggaagacacgtccaaattataagaggattgtgtacgggctaggtactttgagcaaaaggtttagttgctcaaaattaggtccatctacttctattactcctgtggaagaccaaatagaggaaatgcgtgagacaattaataaattgaatgttgagcttttggcaaaggcaaataaggagaagatacttgaggaaaagatgttgcagctgatagagaatcatgaccaccaaagtcaggagatgcgacaacaaatgcaagaacaaaatgagcaaatttgtcaacaacatgagcaaatgcaacgtatattacaacacttgcatattctgtctatcatgttagctcttagtccatcgactaccatagcagatggaactgagcaccatgttaatgatgctcatgttgatcatcctcatgacatgtga

SEQ ID NO: 21542 - DNA, 492 bp, Glycine max
  Peptide Sequence Number=SeqID_113227
atgacaaaggccaatgtttctcacccaagaaccataaaatgggatgaggtaactcttcctgaaaaatgggtcatggacaaggccacgcaatcagtccccagacccactccaactatagaacaaattaagcaagataactccggtaaggtagaaataaccttcaataggagaaattctttttcatctagaatagaagccttaagatccgaatacgaatcggcaagaaaagaaaacatagattacctgtggaaacaagatatcataggtgatccaacaaccaatgtcattacaaattggcaaattaaagatgtgataacaactaagaagttgtacccacttcttgcaatgaacccaaaagacgttggtcttttgtgtccagtgatcaaccaagaagctaatcctgcttcttgcaatgaacccaaggaatgttggtcccttgtgttcagtgttcaaccaggaagaccttctcttgaaaacagtcaccaagagtag

SEQ ID NO: 21543 - DNA, 504 bp, Glycine max
  Peptide Sequence Number=SeqID_113228
atggtagccatgacataccaaacatcccatgagtgttcggaggaaacaatcatagatatcctagttgcaggattttccggccaattaaaaggatgtgcagtcaaaacggatctcaatgggaaaatcattacaaacaatgacaataaggagattcctgatgctgtcaatacccttatgtttacaatagctcaacattttatcggtgacccatcactctggaaagatagtgatgaggacacaactaagggcaaggaccatgaagcacttgaagggcccatgaccagaggcagacttaaacagacccaacatagatccgctccaactttagcagactttaggtggtacagagatatcttcctaactagagtttacacaagaaaagatagccaacaacctttctggaaagaaaaatttctagctggtcttccaagatcgttaggagataaggttagagatgaaatccgtagtcaatctatcaatggagatattccatatgagagttga

SEQ ID NO: 21544 - DNA, 328 bp, Glycine max
  Peptide Sequence Number=SeqID_113229
atggagattcctgagaaccgaaggtggatgtatcagagtcaagacatgtttcaaatgcaaggtgaacaaacaaggtgtccatgcaagaaatgcaaatgtaaagttttcaagtttatggatgatgtgaggagggatctttatgaggaagggttcatgcccaattattattggtgggcaaactacggtgaggagttaccacaatttcttccagtagtgttgcaaggttcatactatggaagtgatgggaaaagggaagaattgaatcctcatgagcaaatgatcatggatcatgttggaacattaattgggcaatacatagaacaagagg

SEQ ID NO: 21545 - DNA, 339 bp, Glycine max
  Peptide Sequence Number=SeqID_113230
atgatttcaagattgagtcaagaacaattcaagaatcaagagaaagattcaagaatcaagtttcaagttaagaatcaagaatcaagaataatcaagatcaagattcaagaatcaagaaaagactcattaaagataaagggtacatctacttgggttattgtgactgagaacaagagagggtacatctcttatggatcagttctagtggagggtacatccactaggttgttcaaagagaacaagggagggtacatcccttgtggatctttgcttgtaaaggattttacaaggttgaaaagaaatctcaaggaccgcaggtcacttgggggctggatgtag

SEQ ID NO: 21546 - DNA, 429 bp, Glycine max
  Peptide Sequence Number=SeqID_113231
atgtggcatgaaaggacccaaaccgccagaaccagtgacgagtttggtgtccttgagcaaatcgccagcaccaatggcgtttcgtgcatgcagagacgaaaccgccagtccaaatggcgatacggtttgcgctttgggaaccgccagtcaaattggcgagttccatggcctgaggctgcagggctacgtccctgccatggcagtgcagtgctgcagaagaagcttcgtgattgcactgcacttccttcttttgcttccattgctttgctattcttcttccttatttcctcttatttggttgttgttgccttcttcttatttggttgctgtcttttgtttttggggtgtgctttgtttcagtcttggtacgtgatttatctcctcttcatattacgtgagttctctgtgcttggtttagttggaatgtga

SEQ ID NO: 21547 - DNA, 288 bp, Glycine max
  Peptide Sequence Number=SeqID_113232
atggatggtaattgtggttatcgggcaatagctgcattattgggtatgggtgaagaatcgtggtcattggtgcgcaaccatctttataaaaacctgacaagctggtcagagaagactccatgtggagcttgtaggccttggatcttcttcatcaatggattcctttgcttcttgaatatcatgacagtggaatggagaaggaacaaagatgattggagatgccacttcaaggagaagatgagtcaagaagaagttcaccatgataggaaaccatggataagagcttga

SEQ ID NO: 21548 - DNA, 504 bp, Glycine max
  Peptide Sequence Number=SeqID_113233
atgcgttttccttccttggaagacgcacccgtgagccttcgcatcgccctcccgccgaaggatgttggtcgtggcaagttctttaaaccaaaggcaacttatgcaatgaccaaatcccagagactcgctgttcttaaatgggtcaaagaactaaagttaccaaatggctatgcctccaatttagctcccaattacaaggggaacatgtacgggcaaggtactttgagcaaaatgtttagttgctcaaaatcagctacatctacttctattgctcctgtggaagaccaaatagaggaaatgcgtgagacaattaataaattgaatgtcgagcttttggcaaaggaaaataaggagaagacacttgaggaaaagatgttgcaactaatggagactcatgaccaccaaagtcaagagatgcgacaacagattccatccactaccataacagatggaactgaggaccatgttaatgatgctcaggtttatcgtcctcatgacacgtga

SEQ ID NO: 21549 - DNA, 313 bp, Glycine max
  Peptide Sequence Number=SeqID_113234
tcctttcgctaagcgcaagcctcgcgctaagcgcatcttttgtcatgcgctagacacctattcactgaatatagctttaccaagtaacacaagttccctgagagttcgatactcggttcttaccgttttatactacttacgcgatccagtgcacttgacaggtgcagttgaaattaaaaatgaagttaccagcaaggtcttcaaagtgaacggtcgccaactcaagctttttcatgagagcccccaagtggaggaggaatttgttgcagacctctctttgatcttgccaattttatgtgatgatgtgccttga

SEQ ID NO: 21550 - DNA, 65 bp, Glycine max
  Peptide Sequence Number=SeqID_113235
atgaaaaacgaacgggtctgcgtatgggtcgggtttgacccgctaaaggttgaagatgatgaaca

SEQ ID NO: 21551 - DNA, 457 bp, Glycine max
  Peptide Sequence Number=SeqID_113236
atgggggataagcttcatcgtcgagagggaaacagcccggatcaccagctaaggcccctaaatgaccgctcagtgataaaggagggaaggacccgcgcgagcagtgctggacgaagcgaaagcgagaatgtcgggcttgaagtaacgcaaacgttggtgagaatccaatgcctcgaaaacccaagggttcctccgcaaggttcgtccacggagggtgagtcagggcctaagatcaggccgaaagggcgtagtcgatggacaacaggtgaatattcctgtactaccctttgttggtcccgagggacggaggaggctagggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacag

SEQ ID NO: 21552 - DNA, 297 bp, Glycine max
  Peptide Sequence Number=SeqID_113237
atggtttccgcaaaagtcataactcttccaatggtttctttgaccagacatgaagagtctataaaagcatggtacatccattgtggtacaagtagagcgtacatctacttgggttgtaatactgagaataagagagggtacatctcttgtggatcagttcaagtggagggtacatccacttggttgttcaaagagaacaaaggagggtatatcccttgtggatctttacttgtaaaggattttaacaaggttattggaaatctcaagaaccagtggttgcttggggactggatgtag

SEQ ID NO: 21553 - DNA, 861 bp, Glycine max
  Peptide Sequence Number=SeqID_113238
ggtggaccttgggtactagaacctgtcgcctttagaggactacacgtcctcacctttcgagggctacatgccctcgcctttagaggactacatgtcctcaccttcagaggactacacgtcctcgccttcagagggtcatgtaccttcaccttcagaagactacacgtcctcgcctccagaggactacatgtcctcgccttcagaggactacacgtcctcgccttcagaggaccacacgccctcgccttcataggactacacgtcctcaccttcagaggactacacgtcctcaccttcaaagggtcatgtaccttcgcctatgtagggctacacgccctcacgttcagaggactacacgtcctcatcttcagaggactacacgtcctcaccttcgtaagactacacgtcctccacttcagagggccaaacatcctcatcttcagaggactacacgtcctcaccttcatagggctacacgccctcacctttagagggctgcatgtcctcgccttcagaggactacacatccttcatttcagaggactacacgtcctcgccttcagagggctacacgctctcgccttcagagggctacacgctctcgcctttagagggctacacgctctcaccttcagtgggctccacatccgcaccttaagagaatttaaggggctagtagtttcctttatcaactttggggccacccttgatcctggaggagggccaactatgcaagtacaaccagaggaggaggctatcatgcagctactgtgcataccggggcaagatttcacccgtgccactgcaaagagacgagtatggatcatgcgcaccaacatgaccactcttacacagatataa

SEQ ID NO: 21554 - DNA, 396 bp, Glycine max
  Peptide Sequence Number=SeqID_113239
atgtcttccaaacacaaacccaagtacatatattttgttgtgccttcgtatagcgtatttttctattctgatttgcaggacccacctatgttattcgcattcggtatgacataccaatttaaggtcgtatttcatgttgataggaatatcattgaggtaccctctgtttatcataaacaatgggctccagattacctggattatgtggtgttggactacaatggaaagaagcaccatataagagttagaaaatttagtaaccgagtctacattgctgatggcctcaaacacttcaggagggatatgagaatatatgaaggtgtgatgatcacatttgttgcgccgaacaagaattggaagtttgatatccacttctcaccgccactgcatgcatag

SEQ ID NO: 21555 - DNA, 444 bp, Glycine max
  Peptide Sequence Number=SeqID_113240
atgggtgaagcagaggaggtgcaagagaagatgaaggccgacatggaggccatgaaagagcaaatggccacaatgatggaggccatgaaagagcaaatggccacaatgatggaggccatgaaagagcaaatggccacaatgatggaggccatgatgagcatgaagaagataatggaagccgatgcggttatagttgtcgcaactagcgctgtcgctaaggtgaacccgatgctcccatctggcctcaagcaaatgaatcatccaacctcaaatatggtaggcaaagatttgggaagtacggatgaccccatgatgtgcaaattaaaaacaagcacgccttcccgccgtatggcttgcctcccaaactatacaccacccaatgtggcatacactctcaatgaaaatctcaataactccactccgatactcattgagaaccaataa

SEQ ID NO: 21556 - DNA, 510 bp, Glycine max
  Peptide Sequence Number=SeqID_113241
atgcatgagaacgaatggcatggagcgtgtttgctctttgaccctatttgggaacctataggacaatatctaggggtctctaataactactccccaacaattcataactcacacggctgttttctagagtccccagtggagtcgccaactgtcgcaacatgcccttttgcgggcgagcgaaggcgaggctcacgggtgcgctttccaaaggaggaaagatgcgcggagtcgccaccaacgtttatttgtggaaacgtcggaaaaaccgaaggaaccggtcaaaatgaaattctaagttcgggagttgtatttacgtttgaggaaggtattaacacctctcacgtcgacaaaagcggggctcttgctcctacgtacccttcatcgaagaggaaatcagacctacatagttcttttttaagggtgaatcaagcgattcgttttacttggaaggtgatcattttaaggcgttggaccttaaaaatgatccatttacttggtaagaaaaactga

SEQ ID NO: 21557 - DNA, 828 bp, Glycine max
  Peptide Sequence Number=SeqID_113242
accatgtatgggggctgacgcctgcccagtgccggaaggtcaaggaagttggtgacctgatgacaggggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagtttcctcgggccagacggagattggccctcgagtgcaaaggcagaagggagcttgactgcaagacccacccgtcgagcagggacgaaagtcggccttagtgatcccgacggtgccgagtggaagggccgtcgctcaacggataaaagttactctagggataacaggctgatcttccccaagagctcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggtgtgggcgttagagcattgagaggacctttccctagtacgagaggaccgggaaggacgcacctctggtgtgccagttatcgtgcccacggtaaacgctgggtagccaaagcctccggtagcacagccgagacagcgatgggttctctgccccagcggggatggagcgaaagaagttttgagaattcaagagaag

SEQ ID NO: 21558 - DNA, 399 bp, Glycine max
  Peptide Sequence Number=SeqID_113243
atgtcgtcttatagctgtcctctatgtgaccatgaagaagaatcgatttatcatcttatgttcaactatgaaaagactaggagtctttggtgggagacaatgagatgggttaatagagtgggtcctcattccatagatccaaagaatcactttttacaattcacccagtggaatagcaaagctaggacaaacaaaagatgggaatttctgtggctaaccctgtccttctccatttggtatcatagaaatgccatgcttttcaagaaccagccgttcactcctgaaaaggtcatggatgatgccttgttccacacctggtcctggctaaaatgtgtggagaaggacttcaatatgcattttactttctggtcaaccaatctaaaggatgttttttcctag

SEQ ID NO: 21559 - DNA, 616 bp, Glycine max
  Peptide Sequence Number=SeqID_113244
atgaaggttatgcagaaatcctctttagcgggaagacaatcacaaaatctggagataggggacaacaacaaacactatcgccttaactggaggaacaatgccgacattacctccttttatttcacccatttccccgacgaagctaatgaagagttgctatggaggcacttcaaaaactggggtgacgtacgtgaagtatacatcgctaaaaggctcaacaaggatggcaggagatacgggttcatgcggttcaagggagtctcggatgcaaaaggattggagaaaaagaaccccattaggaggaagtacaccgacgaagcaagagacaaaagggcagacgaggcacaaacaccaactattctgatcaacccagatgaaggtggggaatattggtgtaacgaaacctgggtgggcatgctaaagaaggtgatggaggtggaaaccttagaggatcgtatcacttgggagttaggatataacgtccgcactaagttcctcggagacgacatggttcttctccctgggatgtccgatgacaaagctcaactcctcattcaatcagagacggaaagcgatgattctctcttttactcactggagaagtggacgccgaaat

SEQ ID NO: 21560 - DNA, 422 bp, Glycine max
  Peptide Sequence Number=SeqID_113245
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagttttctcccctttcttggaactccctcgtgcgctctcctgttccgaccctgccgcttaccggatacctgtccgcctttctcccttcgggaagcgtcgttcgctccaagctgggctgtgtgcacgaaccccccgttcagcccgaccgctgcgccttatccg

SEQ ID NO: 21561 - DNA, 470 bp, Glycine max
  Peptide Sequence Number=SeqID_113246
atgggtgaagtagaggagatacaagagaagatgaaggccgacatggaggccattaaagagaaaatggccacaatgatggaggccatgatgagcgtgaagaagataatggaagccaatgcggttgcaattgccgctaccagcgttgttgctaagacacatgaaattccccatcacaatctagccgacttcgagccttggctcggatatgccactgaagggcaagcagttggtggtatacccctacaaaaccctttggagggccctcagtatcacccacaactacacctcttgcattccatgacaagtaaaaaccctcatgctatggcagaaatgggaaagctagatcatctagaggaaaggctcagggccattgaaggaggtgaagattattcctttgctaacctagaagagttgttcccaatacccaatatcatcaccccttccaagttcaaggtgctggactttgacaa

SEQ ID NO: 21562 - DNA, 243 bp, Glycine max
  Peptide Sequence Number=SeqID_113247
atgaagaaagaatgtcccaaatatgctacatggcgtgtgaagaaagattctggtgctactactcacataagtatgactatgcagggttgcctgtggagccgaccgccaagtgatgatgaaaggttcatctttgtggatgatgacaagaaggttgcagtggaagctattggaacttttagattacagttaaaaactaaattttatttgagacttttgttgtaccgtcttttaaacggaatttga

SEQ ID NO: 21563 - DNA, 309 bp, Glycine max
  Peptide Sequence Number=SeqID_113248
atggcgtcaaccagaaaagattggtcaatcaaattggaagatgcactatgggcttacagaacttcatgcaagaccccaattggcttatctccttttcaactgctgaaatccaaatggtctggacctttcgtcatcaagaaagttcggccttatggtgcaatagagttgtatgatccacaatctcaggaccctgacagaacatgggtggtgaatggtcaaaggttgaaattgtaccatggtggagagtttgaaaaggtaaacaccatcttgcatatgatatcacccattgaggtatatgcatcaagctaa

SEQ ID NO: 21564 - DNA, 213 bp, Glycine max
  Peptide Sequence Number=SeqID_113249
atgtggtggaagtttaatggtgtcaagtatccaacacttcaagcaattgctaaggatatattagctattccggtatctaccgtagcttcagaatccatatttagcactggtggttctatgagctataaagttgttgttgaatgtgctactgtaatgaatgaaatggtttcagatgatgaaggtagaatgatggatgctggtggcactgattag

SEQ ID NO: 21565 - DNA, 435 bp, Glycine max
  Peptide Sequence Number=SeqID_113250
atggtgaggagcaggtttgaaaaagatcttagagtgtctagggtgtgccaggagggtctcttaatgccttcctttttcttctcatcggagttattcacaaagacttgccatggtaaagaagaagggggaacaagcacacttggagagcgcagtacaacggatagttgtgcgatgatttacttcacgggcgaggtctctgctcagttggtagagctccgctcttgcaattgggtcgttgcgattacgggttggatgtctaattgtccaggcggtaatgatagtatcttgtacctgaaccgatctagtatggatcgtacatggacggtagttggagtcggtggctctcctagggtttcctcatttgggatcctggggaagaggatcaagctggcccttgcgaacagcttgatgcactatctcccttcaaccctttga

SEQ ID NO: 21566 - DNA, 159 bp, Glycine max
  Peptide Sequence Number=SeqID_113251
atggattcctatgaagcattcaggaacaagaagattcaatcggacgacgaattcttacgtggtccaaggaaatcaataaaagttcaatcggtcagagcaccgccctgtcaaggcggaagctgcgggttcgagccccgtcagtcccgacctaggatctga

SEQ ID NO: 21567 - DNA, 183 bp, Glycine max
  Peptide Sequence Number=SeqID_113252
atgggggtggtcttcgtcattggaagtgcggtagacagctttgtggttgatttagggatggcctttgtggataactgggtggtgggtaaggaggtggaatggcagtcacagcatgggtttctccctcatcctcaccctctttatttgccccagttttctcattcgtctaagcaggatgattaa

SEQ ID NO: 21568 - DNA, 187 bp, Glycine max
  Peptide Sequence Number=SeqID_113253
cacacacaaaacagcaacggtggcatcatccaaccaggcccaatgtcaatgggcccgtttggacaagcattccataattgcaacacgctctaaccaccgcaccattgcatcgatgcctcaaagctggtctagcatggtcgagttgaaagccatttcggtaagcaagtgtcgcaaagtgtgccactaa

SEQ ID NO: 21569 - DNA, 421 bp, Glycine max
  Peptide Sequence Number=SeqID_113254
gagttcacgggcgagggtagctcctcgccatccatgttggtgagcaccagagcccccccagaaaaagcccttttgacaatgaaaggtccttcgcgcccatggctcatggccgtcaaacgcttaccttcaataagggacctctacctcaaatgggagtactggcttccatcccataaaccaaggagtacggcgtttccccacctccacagccccgttcatcttcggccgatagggggtggagttatgatgctggatcttgaaatcctcgcacatttcctgcatcattttgttattcagattggtgccattgtcagtaatgattttcctagggagtccgtatcgacaaatcagttccctctttatgaatctgaccaccacactcctcgtgacattggtataggaagccgcttcgacccatttg

SEQ ID NO: 21570 - DNA, 294 bp, Glycine max
  Peptide Sequence Number=SeqID_113255
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcctgacacctcagttccgg

SEQ ID NO: 21571 - DNA, 529 bp, Glycine max
  Peptide Sequence Number=SeqID_113256
atggggacaaatcaaactggcaaaaggttttatcaagtcaaggttaaaggcctagatgttaccagcattaaggaattggggcggttgatgggacctctccaaatgcaagccttccgcaagacttacggaaagatcttagatttgaccatagcagaggtatccgtagaagccattgcatcactcacccaatactacgaccagcctttgagatgcttcacgttcggagacttccaattggtaccgaccattgaagaatttgaggagattctgggatgtcctcttggggggagaaaaccatatcttttttccgggtttctcctctccttgagcagaattgcaactgtggtcaaggactcagcaagaggtttggaccgcgtaaaacaaactcaaaacggcatagcgggcctaccacagaagtacctagaagacaaggcgagggatatggaaaatcaagaagagtgggtcccatttatggatgtgttagcattgctaatctttgggggtcgtcctctttccaaacggaggatgg

SEQ ID NO: 21572 - DNA, 621 bp, Glycine max
  Peptide Sequence Number=SeqID_113257
atggcggctaaggtaccccttttgtgtggagacaagtttgtatccaagcatgtagatgataaaaaggaaaagaaattgaaaaaggtggaagacaaaatgcttggatgggttcatggatttgctacaggattttggtggcctcgtggttctctattcctcaacaagacatggatttgttgcaggattttggtggcctcgtggtttgcaatagatgacttaaaagttgacatgagatgggagaagctacaaaaaggaattggattagagatagttaaacagttagcttcagttggaatcaagatggtgctcacaacaagaaatgaagagagggatctccaagcacatgaaacactcaaagcctcaggtctttctcaccttgtactgtttcatcaggtggatgtggctgactcaacaaggaaagagtatcattttttctgcttgacaatctccttgtattctaaatcatctacagatgttgaggatgcgggatttgatgatgtcattattgaggatcaaactgataagacacgaggtgcagagctcaatgagcttgatgtggaagaggaagacgcgacggaggaagaaggtttcaggtcctcgtctccactaaggaacgatgag

SEQ ID NO: 21573 - DNA, 870 bp, Glycine max
  Peptide Sequence Number=SeqID_113258
atgaggtgtaagaaacacttaccggacctcaccagcaccatcggcgtgtgcgcttcgtgcctccgcgaacgcctccagcctctcctcgcagcccaggcccaagcccaggcccaatcagaacgttccaccaccaattccaacgtggataataatcatcgtcgaagaaagcccaagcccaagcccgaagaaaaccctccgccgctcaatttcccgcgctcggtgtctccctacgtgactcaccggaaatccgactacgaccgcctccgggataggctgttctacagcacgccgcaggtgagcggcgccgcctgcgacggcggaactgctttggagaagcggaggcacggcggaaggttctggatcctctcgaacttattccgagccagatcgaacaagaccgaatcttcgcacgaaccgcgtgaggatccgacgggtcctcatccgccacagtcatggttttcgacaatcctctatgcgcgccggcaccacgacgtgcggtccccgcgcgcggatcgaggattatcgccatcaacagcggaaaatttcacccaattctccgctgactcagcgcaagaccgatcggactcgggaaattcgtcggaaacttcgccggcgaaacagaatccgacgccggtgacggggcaccggcgatcgcggatgggacccacaggaaaaggattcacgagcatggcgttttgtctgaatccgttggttcgggcgggtccgaaccggcattggagccatcataataaagggttggcgcaggaacagggcgggggtggggcccaccacatatccaatgcggcgtcgttttgcgcgaaccggtcgcggaagcttgcggatttcggaaggggcgcgcacaaccgttga

SEQ ID NO: 21574 - DNA, 384 bp, Glycine max
  Peptide Sequence Number=SeqID_113259
atggcttccatgatgaaggccatgttaggaatgagacaactcatggagaaaaacgtggccaccgctgccgctgttagttcggttgccgaagcagacccaactctcctagctaccgcgcaccatcctcccccaaacgcggtaggacgagaaaggaacacattggggcacaacagcaacccccatttgggatacaaccgggtggcatacccttatggattaccgcctaattacacgccgccagtcatgcatgatgatgcgggtcatgtctcttcccccatccttgaaggggagcctcctcgacaacccgatgaggtctatgaagatcatcgagagtatgcccaaggggatgtcgatttctaccccccgatccccgttgaggggccg

SEQ ID NO: 21575 - DNA, 222 bp, Glycine max
  Peptide Sequence Number=SeqID_113260
atgatgataacaaaagatgatgacaaaggtgaagacaaaaagctcaaagatcaatcaaagaacaactcaagtgaatcaagaacaattcaagagttcaagataagaatcaagaagaattcaagattcaagaggaaagttgaattcaagaatcaagaatcaagaatcaagattcaagagatcaagattcaagactcaagattcaagaatcaagagaaggcttaa

SEQ ID NO: 21576 - DNA, 439 bp, Glycine max
  Peptide Sequence Number=SeqID_113261
atggaggcaaattgggaccgactcttagcaagcaaagaaggagtgggttgcattaattacaatcccgtcctcgccataagacaacttggttaccctatgagaagggcgccatcagaggaaggcctcacaccttttattgctggagaggataatcactcaggaggatcgagagatgaggccacatcaagaagagacaggactcgtagacttaggtaccagcagtggaaagaaggaagtaaaagtagccacggatctgacgatgagtcccgcgaaggtacttataccgggtacccggccgtcgatttcgagcaagaagcaagttggacggaggatgaagaggacaaggatgtagggctttccccagagctggagaggataatcactcaggaggatctagagatgaggccacatcaagaagagacaggactcgtagacttag

SEQ ID NO: 21577 - DNA, 510 bp, Glycine max
  Peptide Sequence Number=SeqID_113262
atgaccggaaggcttcttgtcggatcattggcttttgaaagccgcatcctccattaccttattgttcgcattttgcttcctagatcttcaaaccttgcccaggtttctgaagaagatctcattgtcatgtggacctttcataaaggtttacaaattgattgggcacaccttgttagatatcgcatgcataaggcattgcgattaaatgcccctttgccttatcctcatcttattacccttttccttcaacacttcaacatccctcttgattctgaaccctatgttccaatcaagagatcattccttataggcgcttcaatcatagcatcctttggttatattaaggagcatgatggctcttgggtaaagaagggtgctagaaatgttggtggagaaggacatgaagattcatctcttctttcaagattttggaaaggtttgatggtcttcaaacctttgttggtgagaggtttgatactttggaattgcaagtggatatgtgcttcatga

SEQ ID NO: 21578 - DNA, 219 bp, Glycine max
  Peptide Sequence Number=SeqID_113263
atgacaaaagcatgtcaaaagggggtacggaaagtaaatgaaacgaaaataaaagtacgcgaaacaaatggggaccaccaagggaaaataggggaggagcttgccacccagctcgcccaggcgagccaggttgcttcctctagaagcaaccgccttctagaggaacatcttggaaagcccaagtgggcctggttgctatttgccccccctttttactaa

SEQ ID NO: 21579 - DNA, 300 bp, Glycine max
  Peptide Sequence Number=SeqID_113264
atggtagtcataagcctaacaaagattcctcaacctccatttcctcgaggatacaacttgtcgcaacctaccctttggcaggagggcgacgcgagactcatgggtgcatcttccaaggaaggaaaacgcgcggagtcgccaccaacgtttattcgaggaaaacgttggaaaaaccggaaaaggcgtagtctacgaactttaagtgtgaaaggttcgggagttgtatttatgcacggggaagggtgtttcccttgctcctacgtattcctcaattgtgataaggaaatcagacctacgtag

SEQ ID NO: 21580 - DNA, 345 bp, Glycine max
  Peptide Sequence Number=SeqID_113265
atgatttcacacccattcatgagtccggcacaaccaagggatcttcctagagttcgactagttcagcaatatgacacatttgttgaaccagatgtccatcagcaaccgatggcggcagtagcacctgatgaggcaggcgctgatgtgcatcatcttggacatgcagtggttgcttttggggaaattattgataagttagagaggctattgaacctaaggatcttgaccgaaggaacaaaagcctatattgttgttgaagaatgtgtgggcattgcaagaagattcattcaccaaccagttgtaggtcacagatccaggcgtaggcggcatatggacgatcattga

SEQ ID NO: 21581 - DNA, 225 bp, Glycine max
  Peptide Sequence Number=SeqID_113266
atgtctggcgcggcaatgatggtggcttgtgtgatgttagggcacgactatgagcttggaatgggcttgggaaagaataatgatggcatggccagcttagtggacatcaaggaaaattgtggaaagtttgggcttagctataagcccacgcagactaatagtatatgcatatatgttcttggtagaagtaggagtagtgggggcaagatacgcgggttaggctaa

SEQ ID NO: 21582 - DNA, 588 bp, Glycine max
  Peptide Sequence Number=SeqID_113267
atggacaagaaaatccgcggtattgtgagtagcattttgaaagacgcctctgttcctgaagctgatgaagatgtcacaacatcttccaccccgaatgtttctgtgcctgatgttgagaaagatgttccaacatcttccggcccaaatgctgaagtgctctcttcccccagcaaagagagatcaacagaggaagatgatcaagccgcagaggagactcctacaccacaggcaccagaacctgctccaggtgacctcattgacttagaagaagtcgaatccgatgaagaacccattgccaacaggttggcacctggcattgcggaaagacttcaaaacagaaagggaaaaacccctcttaagaggtctggacgaatcaagactatggcacagaagaagagtactccaatcactcctgccacatccagaagaagcaaggttgctatcccctccaagaaaaggaaagaaatttcctcatccgattctgatgatgatgtcgaactagatgtctcgacatctaagagggccaagaaatctggaagaaaggtgcctgacttgccttggaaagagaactgggaagagctgccatag

SEQ ID NO: 21583 - DNA, 315 bp, Glycine max
  Peptide Sequence Number=SeqID_113268
atggacgaagaacagtggatgtatgataatatcatgtctgaagaagttgatatgaatattgaaaatgaggaagatgctggcgtgaaagtagaacacgttgattgctctgatgcctttaatacttctcatttgtttgctacccgtgatgaagttttacattgggctcgattggtggctcatgaaattggatttgttgccatgataatgaggtcagacacaaatattggtgttaaaggaaggatctcatttctgttaatagctttcgaaaggagtgatgagtacaggcctaagaagaatgatttggttagaacatga

SEQ ID NO: 21584 - DNA, 106 bp, Glycine max
  Peptide Sequence Number=SeqID_113269
atggtgattttcaaccatagagatgcagcggaaggaaaaggagaagaggagaggggaggcaccatccacttgggaatagccgtggaaggagctaaatcaccagaat

SEQ ID NO: 21585 - DNA, 480 bp, Glycine max
  Peptide Sequence Number=SeqID_113270
atggtggtgggtgtcaacgtgcccgagggtaacaatatcttccgcccgacttcatcgcgctacgcctatctggccgccgttgacgttctggcgacgcttgctgcttatcaccaccggcaaagatcgatggtgacgttgcgtcacatcaagcagcagctcggtgatatcgggcgggcgattgccgcggcgctttctgaaagccatgcgaaggtggtgctggttgatatcgatgctgaagccctttccaatgcgctttctctgctttccggatccggtttcgttgcaaaaacctgcgatgtcaccgatcctgcagatctttcgaggctggcggctgacgtcgcggagctgggcgatgtcgcgacactcgtcaacaatgccggtgccgcgaggctgtcagtctgcacgacacgaccgccgaaatatggcggcaggacaatgcccttaatctcgaagcaccgtttctctgcttcgcgcttttga

SEQ ID NO: 21586 - DNA, 237 bp, Glycine max
  Peptide Sequence Number=SeqID_113271
atggttggagcattctcgcaaaacatcgtgaccctgactggtctccctatgatcttacttagtgagagtgacctgacaaacccattgtgtggtgtgtctcgttatgtactcctaagcgtcccagggtggtttttcactgacatgctagctaggaatgtgataactcactccctgtgtgttgttgtgtttggatcctgtgatgatcttgaacttgtgttcgggggagcagatgaatag

SEQ ID NO: 21587 - DNA, 483 bp, Glycine max
  Peptide Sequence Number=SeqID_113272
atgaataggtggatgactatgaagaacctcatgctagaggacacgggaacaccacgctctgataggattatatatgtgaggggtagagggtgtcacaataatcccacaggctcatatagactgtatgatcctaatgcacatcaaattgtgtacagcagagatgtctatgtggatgaacaaagatcatggaaggattatactgaaaatttcagtgtttcaagaagacaagtgcagctcagttgggataactctgaggtgattaatgatcctacaaggttcaatcatgatgcatccccagcaggagtcagaggaagaccagtaagaaatagacaacaaccagtgagactgcaagattatgagttgtttcctgataatgcagtgactaatgatggtgatttgatccatttagcactccaatctgacatagagtcagacagctttgatgaagccatcacagtgaggtatggaggaaagctatgctga

SEQ ID NO: 21588 - DNA, 339 bp, Glycine max
  Peptide Sequence Number=SeqID_113273
atggtctctgagggatgggtcactggtaatcgattaccagatgaacctgcacggacgcttcagcgcactgtggagtggatactacccacgcctacaccatatcgtctagtggagcccgttcaagtgatcgaggtaacgtcatccgaggaagaccctgaggaggacctggaggagctacctcctgagcctgctgtggatgcccttgactttctagagggtgatgaggatccacttcttgaggtggattctcccgaggaagtcatgtcggcatctgaggcagactctacggaggatagtggcccgagggagatggcgatcagcggaggctcttcatcctag

SEQ ID NO: 21589 - DNA, 420 bp, Glycine max
  Peptide Sequence Number=SeqID_113274
atggttaaggaggagtgtaaggaggcaagtgtctcctctaagaggacacttgttagcactatcaaacctcttgagcttgaggttattcctcaagtaaaggagttattggatgagggcttggttcgaaagagcttaaaccctcgtgctttgttggtgcctaaaataggtattattaaacaccaaatccctaagataggtgttatgaagaatgtgttgagtggtgcaaccctcttttgtaaaatcacacatacacccaacatcttcatgattcgcgtacataggagctcattaggtagtcatcaaggggtttccacgaaccctaagagaataaagcaccactcattaagttggctaggaaccatgttccctcgtaagaaaatgcccaggaaaggggatttttcagaccttaccctactctaa

SEQ ID NO: 21590 - DNA, 345 bp, Glycine max
  Peptide Sequence Number=SeqID_113275
atggcgatgcgcctgatgggcgagcagttcgtgaccggcgaaaccattgccgaagcgctggcgaacgcccgcaagctggaagacaaaggtttccgctactcgtatgacatgctcggtgaagcggccctgactgccgccgacgcgcaggcctacatggtctcttatcagcaggcgatccacgccatcggtaaagcctctaacggccgcggtatttatgaaggtccgggtatctctatcaaactgtccgccctgcacccgcgctacagccgcgcgcagtacgaccgcgtggatggaggagctttacccgcgcctgaagtccctgaccctgctggcgcgccagtatga

SEQ ID NO: 21591 - DNA, 411 bp, Glycine max
  Peptide Sequence Number=SeqID_113276
ggtgttacaacttcaccttcctctagtgcaagtgaagaagaaaaagggaaagaatctagtgaagaaatctactcccaagaagaaggacaacctttaatggttaagggggagtgtaaggagacacttgttagcactgccacacctcttgggcttgaggttattcctcaagtaaagaagttgttggatgggggtttggttcgtaagagcttaaatctttgtgctttgttggtgcccaaaatagaagaatcaaacaaggttgcttcaaaggataaacattgcttcaagattaatacaagattgcttcaacaaacaaagtcttgcttcaagatttctttaagatcaagccttgcctcaaaacaaagtgtttccaagacatgcaaggctctggtaatcgattaccagacagtgtaa

SEQ ID NO: 21592 - DNA, 249 bp, Glycine max
  Peptide Sequence Number=SeqID_113277
gtttgtggcatagaaagcttttattttgatgataagtttagatatcctgtgaattctgctcctggtcaactcccaagaacagtggatgctcttgaaggaaaaggtagtgtgaatggagtatttaggactgttctcatagccaacaatgtttctcttctcaacaaagaggataatgcaccaatctacagtgttgaagatgtcaaaaacattaaagagatagctgcagagatgatgcatttgatctgctaa

SEQ ID NO: 21593 - DNA, 336 bp, Glycine max
  Peptide Sequence Number=SeqID_113278
atggctccaaagaagcttctctctaagagggcaaggaaggatgccgtgagagaaggattcagtgcggcaccacaagtggatatagcatttgacggacactggtttcgaaatgccatcaataagttatttgggcatccgttggtcctggaagaggagcaaccttgcgagttcagtgagaggaggatccaagcttcagaatttgatgaaaaggccataggccagctgctgtgtgttccgaggcaggacttcgcccgaagtgtgatgggaagacgggtgcggatcaagcgctttagcatgaccactctgacacagatctggatgacactgcttccctag

SEQ ID NO: 21594 - DNA, 582 bp, Glycine max
  Peptide Sequence Number=SeqID_113279
atgggatggatagatttcgctctcactctgaatgggagtcaagagcttccaaggctgttagccagggccaaggaaaaggcggatgtatactcaactcccgaggaagctcatgggctttttgattatcgtcaacatatggaagtgcaagagcagatgaaggccgacatggaggccatgaaggaccaaatgaccttcatgatggaggccatgttgagtatgagaaggatgatggaggacaacacgaccgcagttgccaccaccagtgtcgctattgaggcggatctgactcacccatctagcataaaccaaacaagtcgtccagccccagacatggtaggtcaaggaggagaagtgttaggcagtatgggcggtccccatgcgaatgccaaccactccattcccgttctccttaagggccagcaaccccagttggaaaatgcaccatttgcccaacctatgggtgaagcccgtgaaaagcctcgggatcacgctctgggcgagtttgaacctcaccctacatatgtcgttgagggaccaacattttgtggcatgcctcaacccaatgccgcgagagccccttaa

SEQ ID NO: 21595 - DNA, 294 bp, Glycine max
  Peptide Sequence Number=SeqID_113280
atgcgacgacttcaacagacacttctatcatggccaaatctcagattctcccatatgctttgcggaaggcttgacgttgagcttggtccatccactgccctaactctcatattaccatggtgcccaatgcatgcaattgaaaaagtgatgcagaccttccagctccccatgacaaagaagacaagacaaatgcgatgcatgagtgatgacacgagtgacttagtgatcaaagaatacttgggtgttcttaatctcaaagaaggtttaagggtaagccagaagtggcttaaataa

SEQ ID NO: 21596 - DNA, 297 bp, Glycine max
  Peptide Sequence Number=SeqID_113281
atgtatctacatgaaggaggtcaaatcaccttgaagtgtttggctactcagattcaaactatgctagatgcgtgggctcaaggaagtctacatttgggtacatcttttttttttggaggagtggtatcatggagaagtgcaaaacaatccatgtttgtcacttctaccatggaggttgactttgaggccacaattcaagcattgtggttgtggaactttacttcaaggtttggaattgctaacaatattgccgaattgcttaggatttattgtgataactctgcaactatcttctag

SEQ ID NO: 21597 - DNA, 408 bp, Glycine max
  Peptide Sequence Number=SeqID_113282
atgaaaagagaaaaacatgcctcctatagaagtcataactcttgcaaaagcctaagtgaagaacttcgtgactattacgaaggaaggcataggtcacatcttagacctcactcccatagaagagaaaaggaaagaaagcctcaagaggctaacattaaactctcatacttccatgggaaggacaatgtagaggctaacatagattgggaaataagggtagagcaacaacttaaaaagatgacacattacttctcatgccccaccacaaaaaccatgattatgagggccaagacatttatagtagccaagatgaggctactacttcacctttcttctagtgaaagtgaaaaagaaaaaggggaagatctagtgaagaaatctacccccaagaagaaggacaaccattag

SEQ ID NO: 21598 - DNA, 435 bp, Glycine max
  Peptide Sequence Number=SeqID_113283
atggctatgttcgatccggagatagtcatggagttttatgctaacacctggcctatagaagaaggagtaacagacatgcgctcctgggtgaggggccagtggattccctttgatgagcatgtcattaatcagtttctggggcatccattggttttggaagaaggccagcattgcgagttctcccagaggaggagtcagggctccaacttcgatgaggaggccatcagtcagttggcatgcgttccggggcaagactttgcctggagcgtagcatggagacaggtgcggatcatgcgcaccagcatgaccaccatcatgcagatctggatgatgttgttgcttagcaacattttccctagcaaccatatctcggacctcgccttgccgaaggattacgcctacaagacacccagtggacccggagaagtccaatag

SEQ ID NO: 21599 - DNA, 435 bp, Glycine max
  Peptide Sequence Number=SeqID_113284
atgtcgatttcccccattacttcccgccgagtaccatcaaaggcttgcaccaccatcgagctcggctttaaatgtgacgcactaaaaggaagcttttccaaagtggtcttcggcattacatttaaactcgatccattgtcgataagtacctttgcaacaacgtggtccatacatctcaccgacacatgtagagccttgttgtgtcctctcccctcaacgggaatctcttcttccacaaacgcgataccttctttttttttcggctcctcttgccacgagaggatctacttccttcgagggggtggctatgtctgtgggctcttggaccatgggcgccttccctttagagggcaaatccgtcgggtgaggggaagcgaacacccaaccactgcgggttacgccactgaggccggtgatgttggttaccttagctga

SEQ ID NO: 21600 - DNA, 249 bp, Glycine max
  Peptide Sequence Number=SeqID_113285
atgcagtgcaggccacagctgaatgggatatccttcagtaacattggccagcagcaaaatcagatgttggcactacttggaaaatggaggtgggatatgcttcagcaaagtaacaagttatggtccaagatactgcattccaagtatggtggatggagatcattggtggaaggcggtagaaggaataatgagtcagatgaattctatcctccaagatggcactacttggagggtgggatgcggggataa

SEQ ID NO: 21601 - DNA, 353 bp, Glycine max
  Peptide Sequence Number=SeqID_113286
atgacaggtggatgtatttcgcggaccacgtactagctgtgggtgagctttgtctagtgcctgggcaggtaggtgaccatcccagagatgcacctgccgcagaccctaaggagtacatgcagccgcccatcccccaggttctagtggcatttgacccccctccacatgcagtggatgattatgacggctatgaggcgatcgcacagaggttggagcgtgtgctcaaccttaggatggtcactgcaggcatagagttatatgatattatgcaggattgtctcacgatcgccagaggaggtgccagtgcagatggaagtgtcagggctcgacagagacggtgcaaagagcattga

SEQ ID NO: 21602 - DNA, 114 bp, Glycine max
  Peptide Sequence Number=SeqID_113287
atggaagctaaggaagtggcctacaaagtgggggctataaacaccaagccagatggcttaattgttagagataggggaagcaacaacatggagcaacctaaggttaaagcttga

SEQ ID NO: 21603 - DNA, 363 bp, Glycine max
  Peptide Sequence Number=SeqID_113288
atgccaatctccccctgcagatggatcgcacccacaagacgcccaatggacctgaagaagtccaacagggccctggggtttccagctctggaatcgcacccacaaggacacctcagtggacccggagaagtccacagggccttagggtttccaactctggttacgggcctctgtagtcctacagggtgcccgtttcccccggcaaggtcacgtcatcatgacatagggatcgcgcctgcaagacacccggtggacccgaagaagtccaacagggtcttggagttgtcaagctctaattacgggtctctgtcaattctacggagtgcctgtcacctccagctagggcatcagcccccctactaa

SEQ ID NO: 21604 - DNA, 513 bp, Glycine max
  Peptide Sequence Number=SeqID_113289
gctcaatgaagtgacgaaccgtataaatgcagttgctttctctgctccgcttgtcgggaaactgtccgggtgtatactgcttaatgtctatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 21605 - DNA, 576 bp, Glycine max
  Peptide Sequence Number=SeqID_113290
atgaataactctaggtggggacaggagttaagcccttacaatcaatatgaagaagagagaactcctaatcttaaaagtgtgtttgaagaattcatggcatatcatgctaactctaaagccaatcaaaactcagtgcaaaatcaagaaattcaatttggaaagagctattccatggaaaattatcgagggggacaagagttacaaccctacaatcaaaatgaagaagaaagagaggttgaagctcaagaggaaagcttggtaaaagagcatgattcaagagaaaaagatgaagaggaatttgaggaggaagcacaacaacgggagaagtactcgacaatagaaaatcaacaagaaagtattctccaactcaagacctctcctcatcaactaattgtaaaggaagaaaggcatggagaacatgataaagccttaagtgtcattctttccttgatcactagcacctctcttgcaatgatttggaagatatttccaaaatacatgagtttcatagagtttctagcaaaaaggcgaaaatgcaaggaagacgtgttctatgtgacctttatgccaccttga

SEQ ID NO: 21606 - DNA, 285 bp, Glycine max
  Peptide Sequence Number=SeqID_113291
atgtcaatccttaccctcggaagcaaaaaacaaggaaaggaaatttccaatcaaagagaaagaaaaaaagaggaaaggaaattcccaatcaaagagtgggagaaagcgaaaagaaaagagaaaattcctaaccaaagaatgggagaaagtaaaaaggaaggaaagaaagttcctgatcaaagaagcagaagaaatgtgcagaaaggtcttttgaccagacaatatctgaacaatacagaattgtcaccaaatgaacaaaaggaaggaaaggaaaccatgacctaa

SEQ ID NO: 21607 - DNA, 443 bp, Glycine max
  Peptide Sequence Number=SeqID_113292
gcaccatcgggtttcataaattcttcaccctgctcaaagaaggcctgctgctgttcgacgatgcagcggctgacgcgcagcagggtatcgttacggctctcaaggctcttaatcagccagcgggcttcttgcaggttgctgcggataaactggctgtcggcgtcgttgcgcgcattattgcccatcgccgcgtattgctgattaatcttcagccgcggaatgctgtcggaattgagctcgacgacccagcggccgttaaccttgcgcaccagtacatccgggatcacgtattccggctcgctggtttgaatggactgacccgggcgcggatccagcgactggatcaggcaaaccgcctctttcagaacgtcttctttcaagcgagtgacgcgcatcaggctacggaaatcgtggttggccagggagatcaagatgctcgctga

SEQ ID NO: 21608 - DNA, 153 bp, Glycine max
  Peptide Sequence Number=SeqID_113293
atggtgggttacacatttcaagctttgcggatttggtcttcgccaacgaaaggatcaaagtgggtctggaaagagcctaacaatgtcattactcagccaatatcaacccttctcattacccaccacctagtcatccacaaaggccatccctaa

SEQ ID NO: 21609 - DNA, 271 bp, Glycine max
  Peptide Sequence Number=SeqID_113294
atgaaaccaacaatctcacttctgattctcgctcttggctccctcaccaccgtcgccagttactgtgtcaacaacaacggctgccgtgcggcccacgccgagctatacgcacgaaaccagctcccactgtcgaatgaattcagtaaaaagatagaaattggcaagcgggaatgctgtgacccgagttcagatggatgcatcaaggggtcaaaggatgatttgctgctttggattgactgcgataccgacgctcgggataagaagggattcg

SEQ ID NO: 21610 - DNA, 111 bp, Glycine max
  Peptide Sequence Number=SeqID_113295
caaggattcttgctcctaggtatcctcccaatgaggaactcagatccttgttcaagggggagggaatgatgcaatcctactccgcaagggcatgggatagaaaaactccaa

SEQ ID NO: 21611 - DNA, 117 bp, Glycine max
  Peptide Sequence Number=SeqID_113296
atgtggaccaccacgggggacgagcttgccacccagctcgcccagacgagcaaggttgcttcctccagaagcaatagccttctggaggaagaatctggaaggcccaggtgggcctga

SEQ ID NO: 21612 - DNA, 618 bp, Glycine max
  Peptide Sequence Number=SeqID_113297
atgaagcaaactcgcaacggcgtcgtaggcctgccacggaaatacttggaaggcaaggcaagggatatggcgagccaagagaagtggggcccgtttgcggatatactagttttgttgatttttggggttgtcatctttccgaacgtggacggtttggtggacttagccgcgattgatgctttcctcgcatatcaccatagcaaggagagtccagtggtggctatcttggtggatttgtttgacacctttgaccggaggtgtgagaaaaatagtgcacggattgtctgttgtttacccgctctctgtgtgtggttggtttcacacctatttcaacaagacacaagacacccgtgtccgcttcaaagttatcacttatacgccaaaaaaggaagagtcgattgggaccaacatttggtagggatagggggtagcgcaatcaattggtttcctcgatggaaggaaggcaaggagggagtccttttctcatgtggggactaccctaatgttccgttggtagggacaaggggttgcattaactataatcccgcacttgccataagacagttagggtaccccataaggggagcgccaacagaggagagtctctcgcctctccgt

SEQ ID NO: 21613 - DNA, 252 bp, Glycine max
  Peptide Sequence Number=SeqID_113298
atggcagccagtgaccatgccatccttcgtgatcaagcctacacacctacaacgaagagtcttctcgagctcacatcacaagacacactactagcctggcacaaactcctacccaagcaactagaaaccctcacagagatgctgagcaagcttcctcaacagttgcaggcagtgcaacttgcccattcttcagtcatgcatattgggggatgcaacatctgtggtagggcccatgagttagccatgtgcatg

SEQ ID NO: 21614 - DNA, 227 bp, Glycine max
  Peptide Sequence Number=SeqID_113299
caccatcttccttatcacccttctcaaccccttcttatgctcgtgctccttctcctctctcacttcagggtgtgaaccatcacgcgtgtaccgtgtgacgtcttatggtgcagatccaatgggtaattcggatagcactgaggcactccttgcagccatagaagggtggaagttacttgatcatccggtcactgaagttgctggtggccggggtggggaaccttatg

SEQ ID NO: 21615 - DNA, 252 bp, Glycine max
  Peptide Sequence Number=SeqID_113300
atgggttccaagtacctcgaagtggtcaaacgaggatcgcatcccaacaacggatggtccccgggcgaaattaggcgtgcatccatcgctaagtgcagcttcagcgcgcttagcacgatagaagaatctagcagagcatcaatatcaaggatgcgcgctaagtgcgagatcagtttgctaagcatgatggttgtctttagccaggctcagcgcatgactagcgctaagctcaaatccacttactcgcgctaa

SEQ ID NO: 21616 - DNA, 309 bp, Glycine max
  Peptide Sequence Number=SeqID_113301
atgagattcatgaaacaggccaaatacagtctaaaggcccaagtggagaaggacgaaggcccaagtggagaaggacaaagcccccgagtggagaaggatgaaggcccaagtaatccttgtggcgtctacccagacttatcttccttaaccggaagtggcgtctacccagacttatcttccttaaccggaagtggcgtctaccctgacttatcttccttcaccggaagtggcgtcatccaaatcttcgtagcctgtatcaaacgatccgctcctactcaggttcacatcacagtttatggtaaattttaa

SEQ ID NO: 21617 - DNA, 90 bp, Glycine max
  Peptide Sequence Number=SeqID_113302
atggagaaatcactagtgagtctgaaatcaatgaagaggagtggaagaagagagtatgaggaggaagctatgctgggtgatatgttgatg

SEQ ID NO: 21618 - DNA, 261 bp, Glycine max
  Peptide Sequence Number=SeqID_113303
atggatctcattgaaaatatggctgcaagcgacactgctattttgagagatagagctcatattcctaccaaaaggagtttattggagttaacctcccaaggtgcattgttggcacaaaacaaattgctgtctaagcaactggaagccttgactgaaatactaagtgcaggatgtaccatttgtgggggagctcatgaatctggatgttgtattcctattgaagaaaaccccactcatgaagtcaattacatgggaaattag

SEQ ID NO: 21619 - DNA, 165 bp, Glycine max
  Peptide Sequence Number=SeqID_113304
atggcaactgcaattgtgaccaaaatgacagctatactggtagctagagtgacgtttttcaaaaacccattttttcctttaaacaatggtgccctcaaaaggtgcaccttgacaggtagaagacctttacaagttcaggataatgtagcaattttaaggacatga

SEQ ID NO: 21620 - DNA, 429 bp, Glycine max
  Peptide Sequence Number=SeqID_113305
atgtacaaagagaattggacccaaacttggcccatgggctcagaaatctaccctgaggttcatgagaaccctagggtcttcttcagcagctttagcccaatcctcttggagcctcttgctcatggctctagtgactggtcccttcctagggaggattgcatcacttccattgtgtgtgtgtttgtgggatgtgaaatgtggttaactactgggccaaagatggggatagctgatgctatcttggacattgtaagtaatgggaccacactgagagaaaacaacttgaaggaaatcaaaggaggagttgttttggaaagccaggttgtgtttattgcaagcaggaaatcgatgatccaacaaaaaggagtacttgaaacaacacaagagatgcttgagaggttggaagcacatctgagggccattgggtaa

SEQ ID NO: 21621 - DNA, 306 bp, Glycine max
  Peptide Sequence Number=SeqID_113306
atgattaaagttgagcaagacccaagtgtgcatatgcaaagcataaattcattggaggtagttgtcgcaacatgccagtttgcgggcgagcgagggcgaggctcacgggtgcgctttccaaaggaggaaagatgtgcaaagtcgccaccaacgtttatttgtggaaaacgtcgggaaaaccgaaggaaaccggtcaaaatgaaaattctaagttcgggagttgtatttacgcttgaggaaggtcgacaaaagcggggctcttgctcctacgtaccctctatcaaagaggaaatcagacctacgtag

SEQ ID NO: 21622 - DNA, 441 bp, Glycine max
  Peptide Sequence Number=SeqID_113307
ggaatgcagcccaaggtaactgctatttctgaaagcaaagatctttcctctatgtctcttgccaccttgtttggcaaattgcaggaacatgaaatggaacttcaacgtctcaatcaaaatgaagagaccaacaaaaggaaaagaagcatagcactcaaagcctcctcctcaatacaagaagaagaagaagcagaagaagaagaatctaatgatgaagaagacttctcactcttttgtaatcaacctggtcacataaaggcaaactgtccctcaaatgagtcatggccagagaagaatgagaagaaaagctttaaagaaagaagatccaagaaggcgtatattgcttgggatgacaatgactcatccgatcgttcggagaaggagatcaatcttctatccaaagactatgaaagcgatgaaaatatctctcaagaagattaa

SEQ ID NO: 21623 - DNA, 231 bp, Glycine max
  Peptide Sequence Number=SeqID_113308
atggctactccacctgcctcacctcttcctcctcctccttctcctcctccacttgcagtagcatcagagtctccgtctaccttgaagcggacacgtaaagccacaagcttacaatccttggccactagaccacctggggcagagagaccggtggtccatgtcaatcccatgaccgggaaagccgacggtccccacaagaggaaatcaagtacatattttggatatcgctag

SEQ ID NO: 21624 - DNA, 210 bp, Glycine max
  Peptide Sequence Number=SeqID_113309
atggctaattacgcgaagattttcaaccgttcttcgacattcatcgttcgttcttcattgttcttcggtcttcaaccagtaagtacccctaatcgagcttttcaattcattctatgtacccgtggtggtccccatttgcttcgtgtatttttattctcgtttcatttactttccgtacccccttttgacgtgcttcagtcatttatttaa

SEQ ID NO: 21625 - DNA, 407 bp, Glycine max
  Peptide Sequence Number=SeqID_113310
ctttacccgatagactcgcccgcgggctccagctatctgagggaaacttcggagggaaccagctactagacggttcgattagtctttcgcccctatacccaagtcagacgaacgattgcacgtcagtatcgctgcgggcctccaccagagtttcctctggcttcgccccgctcaggcatagttcaccatctttcgggtcccgacagggggatcccaccaatcagcttccttgcgccttacgggtttactcgcccgttgactcgcacacatgtcagactccttggtccgtgtttcaagacgggccgaatggggagcccacaggccgacgccaggagcgcgcaggtgccgaggcacgccaagggcgcgcgctgccatccacaatcgcgatgatgacgtctctgaattga

SEQ ID NO: 21626 - DNA, 621 bp, Glycine max
  Peptide Sequence Number=SeqID_113311
atgtcgatggcctcttccttccttttgcttggaggttcatacctccacgggactgcgtggccgtttcggtatggaaacagaataggtttaactatcgagggctcgtcgggatgcatcaaacaggaatcttcccccatgcccaccgcagggaattacgccccccccttttgtagggccctcgtagataaacctcctgggggtcgtcacgtccttcaaaggcttggacctgcgcggcctacccgactcgacggcattaactgctccccctccatgattggcgagcgggtttgttttcacgttgggccggtcctcctgaaacgtcagccatctggcacctatcaaatgttggaccttgtatttaagggccagacagcgttcggtggagtggcccggggttttcccatgatcttcccgggagatatcatagccatctggttagcgatgagggacggcaagaggtcttcgtacatcattgggatcagggtgaattctggagttggcctcgggggaaagttctttatcgcattggaaccggcgccaaagtgggcattaccggccaggcgagtcggggttggagccggagcttggggtcctccctctggatgggtgtgggcgccctag

SEQ ID NO: 21627 - DNA, 462 bp, Glycine max
  Peptide Sequence Number=SeqID_113312
atggcttgcctcccaaactatacaccacccaatgtggcgtacattcccaatgaggatgtcaataactccactcccatactcattaagagccaacaacctcaatctgatcatgcacatgtctctcgacccatggaggagacacatggaatgccccaccacaatctagccgacttcgagccttgcctcggatatgccactgaacggcaagcagttggtgaggaaaggctcagggccattgaaggaggtaaagattatgcctttgctaacctagaagagttgttcctagtacccaatatcatcacccctcccaagttcaaggtgctggactttgacaagtacaaggggactacttgccccaagaaccatccaaagatgtattgtcggaagataagggcatacgcaaagatgaggaatgctaatacatttcttccagaaagtcttactggggtagttgttacctag

SEQ ID NO: 21628 - DNA, 564 bp, Glycine max
  Peptide Sequence Number=SeqID_113313
aggactacacatcctcgccttcagaggactgcacgtcctcgccttcagaggactgcacgtcctcgccttcagaggactgcacgtcctcgccttttgaggactacatgtcctcaccttcagaggactacgcgactatacgtcctccccttcagaaggctgcacgccctcacctttagaggactatttgtcctccccttcagaggactacatgtcctcgtcttcagaggactacacgtcctccacttcagaggactacacgtcctcgccttcagaggactacacggcctccacttcagaggagtacacgtcctccccttcagaggagtacatgtcctcgccttcagagggctacacgtcctcgccttcagaggactacacgttctcgccttcagaggactacacgtcctcaccttcagagtgctacatgtcttccccttcagaggacaacacgtcctcaccttcagagggctacgcgccctcgcctttagaggactaaacatcctcaccttcagagggctgcacgccctcatcttcgtagggctgcacgcccttgccttcatatga

SEQ ID NO: 21629 - DNA, 528 bp, Glycine max
  Peptide Sequence Number=SeqID_113314
atgctaggtgcacccagcattattgctggtgcacccagcaatttattggaaggtcaagtttgcccttcattaaaaaattttaaaagactccctcttttctcccggattcactttgtgcttttgcttttgtttcttttctttcctcttccgggagcattctcttccaccgcgagcccagctgctgcttctttcgcctggacgccattgccgttcgagaaccatagggtagaagacgagagcaggaggtgccggaaaaaatggggaaagggggctgacggcgagacttccggaagacccgttaggggttcttccggaacttccggaagaacattttccggaaactttccggaagaagtgttcttccggaagaaaccaaacgttttccggaagaaccctgcttccggaaactttccggaaaaaggtttcttccggaaacttttgggatttccggaagaagtttccggaagaagtgttcttccgaaattattccggaagaacacttcttccggaaaattttatgaaaaatga

SEQ ID NO: 21630 - DNA, 354 bp, Glycine max
  Peptide Sequence Number=SeqID_113315
atggcgactgtcaggttcgccggttcgccaaggtgcatagtggcgccaggcttctgccggagtcaggcaaatggcgtgaagcggccggtgccaccaattgggttcaccaggtggggggagtttgtcgggaccgtggtccatgaagtgacggagatattcccatacttcggcgacatgcttgacgctggcttcggtgggttcgttgctgtcgacccagaggcagtccttttggtgaaggctgccgtcttcccggcgaggggcgaaggcgagggcatagctggtgctgaaggaggagccgccaaactcggtacgcttgaaaataccacctccgatgttagaccattcaaaaactaa

SEQ ID NO: 21631 - DNA, 603 bp, Glycine max
  Peptide Sequence Number=SeqID_113316
agggctcacgacctcgcctttagaggactacacgtcctcgccttagagggctgcacgccatcaccttcagaggactacacgtcctcgccttcagagggttgcacgccctcaccttccaacgactacaccctcgccttcagaggactacacgtcctcgccttcagaggactacacgtcctcaccttcagaggactacacgtcctcgccttcagaggactacacgtcctcgcattcagaggactacacgtcctcgcctttagagggcaacgcgccctcgcctttagagggctacacatcctcacattcagagggctacacgccctcactttcagaggactacacgtcctcaccttcagagggctacccgccttcaccttcatagggctgcacgccctcgccttcagaggactacacgtcctccccttcagaggactacacgtctcgccttcagagggctacatgccctcgccttcagaggactacatgtcctcgccatcagagggctgcacgctctcaccttcggaggagtacaagacctcaccttcagaggcctacacgtcctcatctacagagggctggacgccctcacctttagaggactag

SEQ ID NO: 21632 - DNA, 216 bp, Glycine max
  Peptide Sequence Number=SeqID_113317
atgtatttcaagaccgcacaactctttgctattagagatcgacaaactcagacagtgatcaactccggctcacagtattctgaagttgtctctgatgcaatgaataacggtcaacaagaatctaatacacatattgtaaatgaattcgacagacacaatcacacttttattataacagagactcaatccccacttcaaacacccagaccaccttga

SEQ ID NO: 21633 - DNA, 1017 bp, Glycine max
  Peptide Sequence Number=SeqID_113318
atgagttcctgtgaaaaactgatcgaagtagaactgccttccaatcagattgcttcagatcaggtatttgtagatgtacagacagcggatgctgccctggctggattatattcaggactacgtgacaattcgccctttgcaggcgatcagtctggcaggttattagggctttacacggatgatctggacttttattccactacggcaaccaacggactaccggagatagcccaaaaccttcagaacgattccaacgccagtatttatacggactggtcaacttcgtataagcagatttatgtggccaatgccatactggaaggtattgaaaagtcaaagtccatttcccaggcagaccgcaaccgaatcaaaggagaggcattaatggtcagatccatgctgctgttataccttcagcaggtatatggagatattccttattcgacaactaccgattatcaggttaatcagtcgatttcaaaaactgataaggcacaggtgcttatacagctgagtgaagatcttaaagaatccatcagcctgcttcaggacaactacagaaatacggagaggattttccctaaccgtaaaatggcggaactgctattggctaaagtctatctgctagagggaagatgggtagaggctgagttactgttaaagggcattattcaaagtccgctgtacgagtttcagaatgatattaccaaggtctttatcaaatccggctcgcatattctatggcagctgaaacctgaaaattccggtgacggcaccaaagaatccggaatctattattttaacaactcagcaccttcgatgaccgctctcagtactggccttgtcaatgcattttatcccgcagatctcagaaaacaatactggatggcaccggtaacttttaacggaacaacctggtacagggctgagaaatacaaatacaggacagcgaatacaacggagtattcaatcattgccaggctggaagaagtgtatctccttttagcagcgactttg

SEQ ID NO: 21634 - DNA, 1041 bp, Glycine max
  Peptide Sequence Number=SeqID_113319
atgtcgggtgcggagattgtcaaagcggtcacagattcagggttacgtggtcgtggcggtgctgcgttcccgactggcattaaatggaatacggtgctcaatgttcctgcggaacagaaatatgttgtttgcaatgcagacgaaggagattctggtacctattctgaccgcatggtcatggaagatgatccttttgtcctcattgaagggatgacgattgccgggattgcggttggcgcaacacaaggctatatctatttgcgtagtgaatatccgcatgccttaaaaacgctgaatgaagccatccgcaaagccaatctggcaggctatttaggtgaaaatattcttggttccggtcacacctttcatctggaggtgcgtcgtgcagctggcgcttatgtctgcggtgaagaaacttcattgctcgaaagccttgaaggtaaacgcggactggtacgtttcaagccgccgctgccggccattgaagggttatttggtcagccgaccatcgtcaataacgtgatttcgctggcgaccgtacctatcattctggataagggtgcccagtattatgccgattacggcatgggtcgttcacgtggcaccttgcctattcaactggccggtaatttaaaacaaaccggcttggtcgagctggcttttggcgcgaccttgcgtgaattgctgtatgactacggcggtggttccgcttcggggcgtcctatccgggccgtgcaagtaggcggtccactgggcgcttacttgccggaaagccaattcgatacaccgctggattatgaagaatttaccaagatttgggctgtgttagggcatggcgggattgtcgcttttgatgacagtgtcgatatggccaagatggcgcgctatgctttcgagttttgtgctgaagaaagttgcggtaagtgtacgccttgccgcataggctctacgcgcggtgttgaagtcatggataagattgtgtcgggcaaacagcatccgcaaatgtgcaattgttgcgggatttgtctgacactatgctga

SEQ ID NO: 21635 - DNA, 294 bp, Glycine max
  Peptide Sequence Number=SeqID_113320
atggtctgcaatgacaatgctgacatgaccgacaaattgcttgctgggctagcagttggtgtctcgctaaacgaggcttgtgcgcttagcgagaatcacacgctaagcgaggcactcagcccgcttaatgagttgggagaatctagagaagaatttgagaagcatctgcgcgttcagcgcgtcatcagctcgctcagtgagacatttgtctcttcccacgttaagtatctctgttgggaaattctggcgaaacttgatgctaagttcaatgagacatctgagaatgaggtttaa

SEQ ID NO: 21636 - DNA, 225 bp, Glycine max
  Peptide Sequence Number=SeqID_113321
atggcaccccgaagcatgaaagtggacagtctaattgatcgggctcggccattgaagattgagggaagatatgctttgaacctagacagagttgttcaacaactaccaacatggcattcccgaagctttcaaggtgccggactttggcaagtacaaggggactactcgctccaagaaccatctaaagatgtactatcggaagatgggggcatacgcaaaagatga

SEQ ID NO: 21637 - DNA, 425 bp, Glycine max
  Peptide Sequence Number=SeqID_113322
cactggggccagatggtaagccctcccgtatcgtagtaatctacacgacggggagtcaggcaactatggatgaacgaaatagacagatcgctgagataggccaccacttcaagaactctgtagcaccgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagtga

SEQ ID NO: 21638 - DNA, 303 bp, Glycine max
  Peptide Sequence Number=SeqID_113323
atgtttatacggataaccactcgggtatttccgcccgtcagcgtgactcaaaagtcagcttatcgactgcaattgacgaagggcgcagaagacgacgttagtctctgcatgctatcaggcttttcgtcttacagacagcaaaaaagaatgtttatatggataaccactcgggtatttctcgcccgtcagcgtgactcaaaagtcagtatgacagatcttgtgaagggcgacggaaaagcgaggctcttgctccgcgtgtacggtatcggccgcaatgacggaagggctcaggacctacgttag

SEQ ID NO: 21639 - DNA, 393 bp, Glycine max
  Peptide Sequence Number=SeqID_113324
atgtcgtcgcaaaggaagggacggtcccgcccatatacccccggactagcacccaagccgacaccatttgcatatcaaagcaataaggtcgttccgtggaagtatactgctcccgcttttgaagaaagagttgcaaccgaagttgactccctgtcagccaaggtgaccaacatcaccggcctcagtggcataacccgcagtggccgggtgtttgctccccctcactcggcggaattgccccccaaagggaaagcgcccttggtccaagagcccacagacgtagccaccccctcaaaagaagtggatcctttggtggtaaaaggggctgaaaagaaagaagtgactttggaagagctcatgagttccttcgctcatccaacaaagcgagtttaa

SEQ ID NO: 21640 - DNA, 141 bp, Glycine max
  Peptide Sequence Number=SeqID_113325
atggagagtaaaggaaataagctcttaaggtggttggccccttgcttcttgactcaaattcttcaagatatggcaccaatcctcctttccaattccctatatggcaactcacaagcaaggaaacaaagagacaagcaataa

SEQ ID NO: 21641 - DNA, 446 bp, Glycine max
  Peptide Sequence Number=SeqID_113326
gaagccttcttaacaacaaagagaagaacaagatgaaagattgcaaaaatacatgtggtgaggatgtctccttcacctctaggatctcacaatcactcacaaactcatctcaagcactcaatccggcttctacttcaagctctggtggccttgttcgtgctcgtgcgcttagcgcacttatggaccgcttagcgcacgttagtgatttttggcttagtgcacctttctcgctgtcgcaacatgcccttcgcgggcgagtgagggcaaggctcatgggtgcgctttccaaaggaggaaagatgcgcggagtcgccaccaatgaaggtattagcacctctcacgtcgacaaaagcggggcttttgctcctacgcaccctcctttggagaggaaatcagacctacgtagttctttcttaggcgtgaatcaagcgattctttttacttga

SEQ ID NO: 21642 - DNA, 189 bp, Glycine max
  Peptide Sequence Number=SeqID_113327
atggataagagcttgaaggtaggagaacatgagtggaggaagaggaagagggagagagagagggagagggagagaaggggcacgaaatttatgcctcaaatgagctatggttcagcccacttaatccaagatcaagtccaagattctccactaagtgtgcctaggtgtcatgaggcatgtaaagcatga

SEQ ID NO: 21643 - DNA, 432 bp, Glycine max
  Peptide Sequence Number=SeqID_113328
atgaaaaagagtttacatcaactacttagtaagaatccccaactgagggttttagcctttcatggccaggaagctccttttacactaaagaagaggaataaagagaaattgcttgcttacaaaggagtagggatgtctcctccacctttaggaatctcacaatctctcaaaaacttactaatctccctaaaagatgaaaacttggccccttgctctgctctatgctctctgaaattcacactcttcatgcctctctcctctgtaaagttctttttttggctccccctttattctgtgcaaattaggcttaaaaagggcttcctgatcttgacatcgtgcttagcgccattctcgcgcttagcgcgagtaagtgaatttgagcttagcgccaatctcgcgctaagcctggaaagcgaaagacgacttgcttag

SEQ ID NO: 21644 - DNA, 111 bp, Glycine max
  Peptide Sequence Number=SeqID_113329
atggaggagacgaatgtgcacaaaacaacatgggggacccctaagggaaaatgggcacttggggcaaaggcagctcgcccaggtgagttggagctcgcccaggcgagctga

SEQ ID NO: 21645 - DNA, 444 bp, Glycine max
  Peptide Sequence Number=SeqID_113330
atggccagaacacgaggtttaggtcgtgccataggtagatttgtaggcagagatagagctgctgacgaggatgctggcgatgttcccgagaggcgtaggcctactgcctcagcccgtaggctacgcgttcatcagatgactacggagggacgtgatatggctgaggacgtcgctgacatgactgatgatgtccctgagcagcctacggaggcacctgagatgcgtgcggacgcacagggtgctgatagtggtgaggggtcagatggtgatgatgctgcagagggattccctggtggtccacgtgacccatcagtgctcacatcatttgccgagcatgttgcacatgccgtgtggagtggacaggaacgtcctgatttgaagttagtgtcacatgggaggaagctgacactgattgggaggccagtgcctgagattgaaggcctg

SEQ ID NO: 21646 - DNA, 955 bp, Glycine max
  Peptide Sequence Number=SeqID_113331
ggctgcatgccctcactccagaggactacatgtcctcgccttgagagggctacacgccctcaccttgggtactagttaccctcaccgtcagaggactacacgtcctcgccttgagaggactacacgtcctcaccatcagagggctgcacgccctcaccttggaggactacacgtcctcgccttcaaagggtcatgtaccttcaacttcagaggactacacatcctcgccgtcaaagggtcatgtgccttcccctttgtagggctacacgccctcaccttcagaggactacacgactacatgttccccattttcaaaggggggcatgccctcacctttagaggattgcacgtccttgccatcataggactacactccctcgccttcgaaaggcgacacgtcctgaactttagagggctacacgctctcgcctttagaggactacgcgtcctcactttcaggaccaatagtttccttttaacggttcctgggccaactgtgcaagcacaaccagagagggaggctatcacacagctactatgcatactggggcaagatttcacccgtgccgctgcaaagagaagaggatcgcacccacaagacacccagtggacccggaaaagtccaacagggccctggggtttccagctctggttacgggcctctatcagtcctacagggtgcccgtaccccccccggcaaggtcacgtcatcatagggatcgcgactgcaagacacccagtggacccgaagaagtccaacagggtcttggagttgtcaagctctaattacggacaagcgcagggcgaaacaccacagcagcattgggatggtcggcaacgggaaacagacgcaccgccatcacctctagagttcacctctgctcatccacaaaaaggtttgagtattgcctacacaacatggccgacccataggcgaccaagtccaaagccaaag

SEQ ID NO: 21647 - DNA, 899 bp, Glycine max
  Peptide Sequence Number=SeqID_113332
atggctacctcaccaaaagaaacttccgcttctggttcacccgctgtacgatcatctccgcaccaggaacaaccggaattcaacatccaacccatacaaataattcctggtcaagcttctgtccctgagaaactggttcccagaagacaacagggagtgaagattgctgaaaaccctagccttgcaacaagtcctagggaagtagacacggagatggacaagaaaatccgcggtattgtgagtagcattctgaaagatgcttctgtgcctgatgctgagaaagatgttccaacatcttccaccccagatgtttctgtgcctgatgtcaataaagatgttccaacatcctccgctccaaatgctgaagccctcccttcacccaaaaggttacaaggcagaaagggaaaaaccccccttaagaggtctggacgaatcaagactatggcacagaagaagagtactccaatcactcctgccacatccagaagaagcaaggttgctatcccctccaagaagaggaaagaaatttcctcatccgattctgatgaggatgtcgaactagatgtctcgacatctaagagggccaagaaatctgggaagaaggtgcctgaaaaggttcctgatgcaccattggacaacatctctttccactccattggcaatgttgaaaagtggaaatatgtgtatcaacgcagacttgcggttgaaagagaactgggaagaactgccttggattgcaaggagatcatggaccttatcaaggctgctggactactgaagacagtcaccaagttgggagactgttatgaaggcctagtcagggaattcattgtcaacattccctctgacatatcaaacagaaaaagtgatgattatcaaagagtgtttgtcagaggaaa

SEQ ID NO: 21648 - DNA, 868 bp, Glycine max
  Peptide Sequence Number=SeqID_113333
aggagtgcatgaggtagctacaaacccatctgcatcatctgaaactaagaagcttgaaggcaaactggatgcgttggtcaacttggtaacccagctggccttgaatcagaaatttgtacctgtcgcaagggtttgtggtttgtgctcctctgctgaccaccatacagacctttgcccttccatgcagcaacctggagcaattgagcaacctgaagtttatgctgcaaatatttacaatagacctcctcaacctcagcagcaaaatcaaccacaacagagcaattatgacctttccagcaacagatacaaccctggatggaggaatcaccctaacctcagatggtccagccctcagcaacaacaacagcagcctgctccttccttccaaaatgatgctggcccaagcacaccatacattcctccaccaatccaacaacagcaacaaccccagaaacagccaatagttgaggcccctccacaaccttccctcgaagaacttgtgaggcaaatgactatgcagaacatgcagtttcagcaagagaccagagcctccattcagagcttaaccaatcagatgggacaattagctacccaattgaatcaacaacagtcgggaaagcagtgtcaaggacctcaacccgtaacaccttcctcatctgcaaatgaacctgcccaacttcactctaacccagaaaaaggtaatgacaaaaatttacctaacaatttctgtgcaggtgaatcttccactggtaattctgatttgcagaagcagcacatccctcctcttccattccctccaagagcagtttccaacaaaaaaatggaagaggcagagaaagagatcttggaaacattcagaaaagtagag

SEQ ID NO: 21649 - DNA, 309 bp, Glycine max
  Peptide Sequence Number=SeqID_113334
atggcctactctctaaaacagtccccagtggagtctccaactgtcgcaacctacccttcggcgggagggcgacgcgtgactcgcgggatgcgtgttccacgaaaggaatacgcgcggagtcgccaccaacgtttatttgaggaaaacgtcagaaaaaccggaaaagacgcgatctacgaacttttaagtgaaaggttcgggagttgtatttacgcacggggaagtattattttacctctttttgatttccaacgtggttatggcatgaccgaacggtcggaattcattttaaccgaagttaatggataa

SEQ ID NO: 21650 - DNA, 210 bp, Glycine max
  Peptide Sequence Number=SeqID_113335
atggcacatcaaaatcccccatacttagccttttgcactcctgggcaaaatgatacaaagaacaaaatccaaggatatcaaagagagacaaacaaaaacattcacatatttctcaatgaacatcaaggaatgaaaggaatgggaagcatcaacaagaatcaagccaaggctattgtgcaagcaatcaatggggcaaaacacaccaaatga

SEQ ID NO: 21651 - DNA, 277 bp, Glycine max
  Peptide Sequence Number=SeqID_113336
tgatcttccgtcaccaggtatttattcggcgcaaagtgcgtcggctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 21652 - DNA, 558 bp, Glycine max
  Peptide Sequence Number=SeqID_113337
atgaccggtagattgctggccgggtcattaacatttgataatcacatcatgcactatataattgttagaattttgcttccccggtcttcaaatttggcacaagcctctgaggaggatttgattctgatgtgggctttccttaccgttcgtcagatcgactgggttcacttggttcggtaccgaatgcataagacattacggaccaatgcacctctcccttaccctcaattgataactttgtttctgcgtcattttcaaattccgcttgatgatgaaccatttgttcaagtcaagcgttcctttgcaattggtgctggtgcagtgacttcctttggataccgtaaggatcagaatggtcaatggctgaagaaagacgcactccctcctcaagatgagtttctttctgaattacggggtcttcgttcttatattggtgaacgtttcgactcactggatactcgttttgccggaatggatattcgcctcacacagcttgaagaggatatgggttacattcgtcagagtttcgatcttccaccaccacctccaccttcttag

SEQ ID NO: 21653 - DNA, 416 bp, Glycine max
  Peptide Sequence Number=SeqID_113338
tcggagacgtcggcggggcccggaaagagtatcttttctgtttaacagcctgcccacctggaaacggctcagccggagcctctggtcgatggaacaatgtaggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactgtgctctgaatgtcaaagtgaagaaattcaaccaagcgcgggtaaacggcgggagtaactatgactctcttaaggtagccaaatgcctcgtcatctaa

SEQ ID NO: 21654 - DNA, 723 bp, Glycine max
  Peptide Sequence Number=SeqID_113339
atggccaccccgcgagccaaagtgggagagcgcgccaaaacacatctgctgatattactctgcgcgatttggctctgcgtagggcttattggtcactcaccttggaaaccatttgagtcacagtccgccagcatcatccagaacttgatcgaccacccttttctttcttccagtagctggattcatggcgactggattgcacccacatccgccggcaatccaaccctggaaacacctccattattctactggacggcaactggctttgcccacttgctgtcaccactgcttcctacacacgatgcagctcggctaagttggtcagcgctacacaccatgatgccagccatcgccgcactcagtcgagtatcagctatggcattttacgccttagcgctaatcatgcgtaaacctgtgcgggccatgtggttactactgtacaggcttattagtggctatcatgtctggtggtgtcgtaccggctttaaccattatattatcagtcacctgcctgttaaccctacccgcgattcgtcaacagaaacacgtataccgtgccatgatcgccggcacgttgcttgccttaccggcaatgggcaccaggactatggcaatcctggtggcaagcacaatggcaattccagctaccagccttaccattcgccttatgggggatctggcgtttcaggcactccgtcctcaatacttaccgcttccagttag

SEQ ID NO: 21655 - DNA, 1766 bp, Glycine max
  Peptide Sequence Number=SeqID_113340
tcgttgcgcgcgtcctcgccattgctgccggtcttgtcgccaacgcgccagcgcttgccgaggcccgcgcgcaggcaggcgtcgccggtctcgttgtcgatcagccagtcggccagctgctgccgcgatgccggctgcagcactttccccagcaccacacgctgcagcgaaccagccatcgccgccggtgtggtggtgtcgcgcaggtcgccttcggcgaagctgttcatttccggctccagccggtcgctgcggctgaccgcatcaccgctggcgcgcaggaacgcggtcaccgccggcgggccaccgaccacgccgaacaacaggttggcggcggtgttgtcgctggtgatgatcgtggcccggcacaggtcgcgcacggtcatatccttgccggcatgacggcgggtgaccggtgcgtgcgagagcaggtcggcctcgcgcaccggtacgcgccggtcgagcagcgcgggtgcgcgctcggcctggctgagcacggttgcggccagcatgctcttgaaggtgctgcacatcgggaagcgctcgtcctggcgatggccgacgcggcgactgcttgcggtatcgagcagggtcacgcccaagcgtcctgcgcaggccttttccagcgcggcgaaatcaccggcggcgttgatggcggtgtctgtgggtgcgttggcggcggccttgcccgctgcacgtgccagcaacggcagggcaagcgaagaagcaacagcggcaccactgaactgcaggaatcggcgacgggcgagcatgcgggggttctcctggggaccgttcgattattggaacccacggccaggacgaccagcgcgaaaattcagcaccagccattagatttattgatgtctattgcatcaattcctgcgattagcggccttccctgcccaggcgttaggatcagccatcatccaggctcacgactcgacgatgctgcatcccaccctgccactgaacgcgctgcgcgccttcgaggccgccgcccgtcaccagaacttcacccgcgccgcgctggagctgaccggctcggcatccgcctgttccaccgactgcctcgcggcgtggcgctcaccgacgaaggcgcggcgctgtatccggtgctcaacgaatcgttcgagcgcatctccgccagcattgcgcgctataccggcgggccggcccgtgaagtgctgacgctgggcgtggtcggcaccttcgccaccggctggctgctgccacggctggccgcattcgaggccgcgcacccggacatcgagctgcgcctgcagacccacaacaaccgcatcgacctggccggcgaaggcctggacctggccatccggtttggtgatggcgattggcagggccaggcctgcacggcgatcctcgacgcgccgttcgcgccgctgtgcgcgccggcactggcgcggcggctgaaacagccgcgcgacctgggcacgctgccgctgctgcgctcctaccgcagcgacgaatggccgcgctggttgcaggcggcaggagtgagtggcgtggaagcccgcgggccggtgtttgattcgtcattgacagtggcgatggccgcggtcggcggcgccggcgtggcgctgctgccgctgcgcatgttcgagcaggagctggccgaaggtcgcctgctgcagccgttcagcaccacgctggagctggggcgctactggctgacacgattgcgctcgcgcgccgagcgtgaaccggcgaagcgattccgcgaatggctgcaggcgcagggatga

SEQ ID NO: 21656 - DNA, 222 bp, Glycine max
  Peptide Sequence Number=SeqID_113341
atgacggcgacagcaacgaagtctatttcgttgaagcctttgggaagagacggcaccgtaaggcgccatttggtggaggagattccgattgtggtgcctaggtacgtcgtcaagcctctggcgacggtagctgaaggcgccgtcggcaacaggcatgtcgacgacaaactcagtgtagcagaaagcggagaggagggtgcagaagccggtagtggcaattaa

SEQ ID NO: 21657 - DNA, 561 bp, Glycine max
  Peptide Sequence Number=SeqID_113342
cagagacaaaatttggtcattctgcacccttgtatcatccagaggcggcgggcccgatgatacgcggagataccttacggttatccgcacccttttgtcatccagaggcggtgggcccgatgacaagcagagcccaaatttggtcattctgcacccttgtatcatccagagagaccaaatttggtcattctgcacccttgtatcatccagaggcggcgggcccgatgatacgcggagataccttacggttatccgcacccttttgtcatccagaggcggcgggcccgatgacaagcagagaccaagtttggtcattctgcacccttgtatcatccagaggcggcgggcccgatgatacgcggagataccttactggttatccgcaccctttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagaccaa

SEQ ID NO: 21658 - DNA, 148 bp, Glycine max
  Peptide Sequence Number=SeqID_113343
gaaaaggaaggagaagcttgccacccagctcgcctgcccagctcgcccaggcgagctaggttgcttcctccagaaggtaccgccttctggagaacttcctggaaggcccaaatgggtttggttgctatttgcaccccctttttactaa

SEQ ID NO: 21659 - DNA, 414 bp, Glycine max
  Peptide Sequence Number=SeqID_113344
atgaccggccctctcaatgagtcaatctcatgctttctcataagggtggacccttgggtactagtaccctcaccttcagaggactacacgtcctcaccttcagaagactacacatcctcaccttcagaagactacacgtcctcaccttcagaggacaacacgtcctcaccttcagaggacaacacgtcctcaccttcagaggactacacgtactcaccttcaaagggctacatgccctcaccttcagaggactacatgtcctcacctttaaaggactacacatccttgccatcagaggactacacgtcttcgccttcagagggctacacgtcctcacctttagaggactacacgtcctcacctttagagggttgcacgtccttgccttcagagggctgcaaaccctcgccttta

SEQ ID NO: 21660 - DNA, 198 bp, Glycine max
  Peptide Sequence Number=SeqID_113345
atgtttgcttatagtcctttcgctaagctcaggcctcgcgctaagcacataactgttcatgcgctaagccttgagtctcaagcgcttagcgctcaacctttgcatcttaagatgattcattccactaagctagccaaggttgagctgagccaaatccaattcgatctggatttggctaagcaaaagcctaaccgctaa

SEQ ID NO: 21661 - DNA, 195 bp, Glycine max
  Peptide Sequence Number=SeqID_113346
atggctgtcgtcagctcgtgcctttggaaccctgagcagactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 21662 - DNA, 393 bp, Glycine max
  Peptide Sequence Number=SeqID_113347
atgccaatctcccctgcagatgtatcggttggtctgtgtcgtcatgacatagggatcgcgcccataagacacccagtggacccgaagaagtccaacagggccctggggtttccagctctggttacgggcctctatcagtcctatagggtgcacgttcacccagcgaggtcatgccatcgtgacataggaatcacacccacaaagacacctagtggacccggagaagtccaacagggccctggggtttccaactctagaatcgcgcccgcaagacacccagtggacccgaagaagtccaacagggtcttggagttgccaagctataattacgggcctctgtcagttctacggagtgcctgtcgcccccagcaaggtcatcaggccccctactaa

SEQ ID NO: 21663 - DNA, 339 bp, Glycine max
  Peptide Sequence Number=SeqID_113348
atggctaagtttgacccagatatagttctagagttttatgctaatgcttggcccacggaggaggacatgcggtcatgggtaaggggccagtggattccttttgatgcagacaccctcagcctattcctgggtgacccgctggtgttagaggagggccaggagtgcgagtttagtcagataaggaaccgggccgatgaatttgacgaggaggccattgcccaactgttatgcataccgggtcaggattttgcccggaccgctgccgggagacgggtgcggatcttgtggcatggagcggtatttacaacacttggttcaccagcaggcgcccaaccatag

SEQ ID NO: 21664 - DNA, 834 bp, Glycine max
  Peptide Sequence Number=SeqID_113349
atgatcaacgtctatggtacaactctcaattttcttctaggatcatctgagaccctaaagtacctagacacaaatttctttaatgatgagacatttgactgttatcaagtgtttcaaaactctggattggttgattttaggtccttaaaattgccttactatcctgaacttgttaaagtcttttacaacaatttaaaaattcaggatgatattatttcttctgaggtgcacggtatttctatgatcattgatcaatctctgttcttttcattgactaaattacccagtcaaggtgcaccttttgagggcaccattgttgatgactggaagattgattattctagtcatgatgctcgccatatggtttgtaatgaccaggctaaaatgaccggtagattgctggccggatcattaaccattgattgtcgcatcattcactatattattgttagaattttgcttccccgttcttctaatttggctcaagcctctgaggaggacttgattttgatgtgggcttttctttccggttgtcagatcgactgggctcacttggttaggtaccgaatgcataaggcattacgggccaatgcacctctcccttatcctcaattgcataatgattcctcagcccttctgactaaagttctttcagagttacggggcctccgcacctatgttggtgaacgattcgattctttggatggtcgctttgaaggcatggatacccgcatcacccagcttgaagaggacgtgaattatattcgtcagagcttcgatcttccaccaccaccaccaccaccttctcagtttttagattattattattgttga

SEQ ID NO: 21665 - DNA, 204 bp, Glycine max
  Peptide Sequence Number=SeqID_113350
atggatgggagttcctcaaggactatgattttggtctttcctaccatcccggtaaggctaatggtagtagccgatgtgctaagtcggaagtccttacatgttgtgactatgatgagtttagagcagagattgacagaggagttccgagatctgaatctagcaatcgagatgcgacccaagagcttatttgtgggagcattgtag

SEQ ID NO: 21666 - DNA, 315 bp, Glycine max
  Peptide Sequence Number=SeqID_113351
atgacaatgcaaaagaacgaagactccaatgcatcctacaacatacctaggtggttgaaagcccacatgcaagatttggattggctcccaagtttgagaactactaaaggggtggaagttgaggctccggaggaagacgaagaggtgcaggcccttagggcagaactcaagcaagcccaatcagtcaaagaaaggttcaaattagcagctcttaagatccaaaaggagaatgccgaactgagagatgtaaataaagctaccaccgaggccttggaacgagagaccaaaagggctcgtagagaggaatacggctag

SEQ ID NO: 21667 - DNA, 384 bp, Glycine max
  Peptide Sequence Number=SeqID_113352
atgactatcatagatcatgggttcgatacagatcgagacttacaaataaagcccgaggattggcatccatgctgtcattttatatcaccaggaggactattagctagtgtatatcaccttacgagactagagtatggtatagatcaacccgaagaggtctgcataaaaatatttgtcgcaagaaaaaatcccagaattccttccattttctgggtttggaaaagtgcggattttcaagaaaaggaatcttatgatatgttgggaatctcttatgataatcatccgcgtctgagacgtattttaatgcccgaaagttggataggatggcctttgcgtaaagattatatcgccccaaatttttatgaaatacaagatgctcactaa

SEQ ID NO: 21668 - DNA, 291 bp, Glycine max
  Peptide Sequence Number=SeqID_113353
atggcagatgtgcttgccactttagcgtccatgttccagctaccaccgcacggtgacctaccgtacattgaattctggtgtcgtggcagacccgcacattgttgtcaggtggaagaggaacgggatggtaagcccgatggtatttcgaaagcgatccttgaaatgcaaagaacccttaccgagttctatatgcgggtgaatgttggggaaaacatgacgagtccgggagccagagggcctctatacttgagtaagaagttcatgctaatgggaactacgtcccatggttag

SEQ ID NO: 21669 - DNA, 177 bp, Glycine max
  Peptide Sequence Number=SeqID_113354
gatgtttatgatgagattgttgagaggttggagcgccatctaagtctaggggtggtcacgccaggctcatcgacacatgaggtgatcgaagaatgcctcaggatgaccaggagtatgacacaggaccatctagtatatgttaggtctagacgcaggcggcacatggatcaggcgtag

SEQ ID NO: 21670 - DNA, 303 bp, Glycine max
  Peptide Sequence Number=SeqID_113355
atgtggagccctctgaaagtgaggatgcgtagccctctaaaggcgagggcgtgcagtcctctgaaggtgaaggcgtgcagccccttgatggtgagggcatgcagccctctgatggcgaggacgacgaggacgtgtagtcctctaaaggtgagggcgtgcatccctctaaaggtgaggacgtgtagtcctctaatggcgaggacgtgtagtcctctaaaggtgagggcgtgcagccctttgaaggcaagggcgtgcaaccctctaaaggtgagggtactagtacccaagggtccactcttatga

SEQ ID NO: 21671 - DNA, 123 bp, Glycine max
  Peptide Sequence Number=SeqID_113356
atggtcagaacacgaggttttggtcgtgccataggtagagttgtaggcagagataaacctgctgacgaggatgctgccgatgttcccgagaggcgtaggcctactatctcagctcttgtttaa

SEQ ID NO: 21672 - DNA, 645 bp, Glycine max
  Peptide Sequence Number=SeqID_113357
atcatgggttctccacctgcctccactcctcctcctcctcctcctcctcctcctcctacttcggacgcatcggcttcgacaccacctggtgttgagagaccagtggtgcatgttgatcctgctatagggaaggccgacggtccccacaagaagaaattgagaacatatttggggattgtggcacgtgataaggtggacatcacctacgagaactggaaggaggttgctactgctcagaaggacctgatttgggaggatattcagtttaaatcagacctcacgaggaaatgggcccttgcagccgatcaagacggtgtcgaggacactgtctgtgagaaatacggcatcagcaaggaaaaatgggcccagttttgccagactcgcagagacccttcttgggaggccatccagaagcagaatactgccccccacgttttgtctcgtgggggttatgattatttggagcagaagctcctggctgagaagaccaagaagaagatgcaggaagttgcacaatcaggaagcgttgatggcgtcatcgaccctccatccccggtcagacgccacgtgaagtggaagatggcccgcatgaagaagacaggggagatgacgactgaggccgcaaaggaaatcgctgagaagatt

SEQ ID NO: 21673 - DNA, 333 bp, Glycine max
  Peptide Sequence Number=SeqID_113358
atgcggactacctgcacctggacagaaagaccctatgaagcttcactgtttcctgggattggctttgggcttttcctgcgcagcttaggtggagggcaaagaaggcctccttctgggggggcagagccatcagcctcccaaaaggtaacggaggcgtgcaaaggtttcctcgggccagacggagattggccctcgagtgcaaaggcagaagggagcttgactgcaagacccacccgtcgagcagggacgaaagtcggccttagtgatccgacggtgccgagtggaagggccgtcgctcaacggataaaagttactctagggataacaggctga

SEQ ID NO: 21674 - DNA, 370 bp, Glycine max
  Peptide Sequence Number=SeqID_113359
atgaaaataaaaaaacatgtctcctatagtagtcatgactcttgcaaaagtttaagtgaagaacttagcgactattatagagggtgccatagttcacatactgaacatcactcccaaagaagagaaaaggaaagaaagcctcaagaggctaacattaacctcccatactttcatgggaaggacaatgtagaggctaacttagattgggaaataagggtggagcaacaacttaaaaggaaatctacttcaaaatcttatggctctcactcttatccaaagaaagaccaaggtcaaggcatcttaggggtgacaccttctaagcctaaagatgataaggggaagacaatagaaaagcaaccccttaaggcta

SEQ ID NO: 21675 - DNA, 375 bp, Glycine max
  Peptide Sequence Number=SeqID_113360
atggaaagtgagggaaggttgaacaactctttgcttgccatcatattaggaagaactagagagctagttccatttggctactatgaatggagcaacaacttaaaagaaatccttcttcgaaggtatgcctatattggtggacttcctcttatcaggaaggataacccgaaggattatggggtatccttagtaaagtattggaatgatcttaagatggagaatatggaacaaaggggtgaagagtctagtgaggaagtctaccctcatgaagaaggtgacctcctaatgcacaagattagtttccaagttgacctcatatcattccccaaccaaaaccttataaacttcaatggctcaatgagcaaggggaaatga

SEQ ID NO: 21676 - DNA, 516 bp, Glycine max
  Peptide Sequence Number=SeqID_113361
atgatcgtcacagttcgaccgaagagggtggtacgccagttcggttacatccaaagcatccctccgccgcctgttagtgcacgattgtcacacgatcagatagatgacaggtggatggagtttgcggatcacttactacctgcgggtcagctttgtctagtgcctgggcaggtatctgcggattacattgagtggtttttccgcatatctcaccctttcatgaaaccgacccaggcagctgaccagcagagggatgcaccagctgcagaccctgaggactacatacagccgcccagcccccaggttccagtggcatttgacccccctccacatgtggatgattacgagggatatgaggcgattgcacagaggttggagcgtgtgctcaaccttaggatagtcactgcaggcacagagttatatgacattatgcaggactgtttgacgatcgcgagagggggacccagtgctgatgggacggtcagggctcgtcagagacgccgcacggaccattga

SEQ ID NO: 21677 - DNA, 316 bp, Glycine max
  Peptide Sequence Number=SeqID_113362
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggcattagaagtgttgggagtgtcagaccaaagtgtcagggagaaagggagagagaaaggagtaaaagacagggaggagggcgcgacgggtagcgctgctgcagcaggcgcgtcgggtcgtgttgggtacccaggcgcgacgggtcgcgctggggacccaggcgcgacccagttgggtc

SEQ ID NO: 21678 - DNA, 198 bp, Glycine max
  Peptide Sequence Number=SeqID_113363
atggcgactccactggggatcgaactcctaagtggagtgagtttcggatgtggcacatgtgataaccccgctcaatggagggatcttgggagtattactattgcggtggctaatcagagtagtcttgaattggttgatacgcgatactacactcaaacgaggctttcctatggacgttgttggaccgggagtagtccc

SEQ ID NO: 21679 - DNA, 224 bp, Glycine max
  Peptide Sequence Number=SeqID_113364
gattggaagaggaaattggtgcattgtttgaaggaagatttttgagtcttggaggggtgtatggggagtctccaagataccacctgtcgcaacgtgcccttcgcgggcgagcgaaggagaggctcacgggtgcactttccaaaggaggaaaggtgcgcggagtcaccaccaacgttttatttgtggaaaacgtcggaaaaaccgaaggaaaccggtcaaaatga

SEQ ID NO: 21680 - DNA, 311 bp, Glycine max
  Peptide Sequence Number=SeqID_113365
atgacggaggcccgtatgttgagcgtgattgttgacggactgtggcgcgagggggacaagagcctcgccgtcaggctggtggctgaaaacggcgaagcgctgccggcatggcagcccggggcgcacatcgacgtgcatctgccctgcggagttattcgccagtactccctgaccggggcgtgcggcgatgaggggtatctaatctgcgtggggcgggaagccgcctcccgcggtgggtcgcgctacgttcacgaaacgctacgtccggggcagaagctgctgatttcggccccgcgcaatctgttccgctg

SEQ ID NO: 21681 - DNA, 231 bp, Glycine max
  Peptide Sequence Number=SeqID_113366
atgaagtcaggtgacatgcaggggtatagtatagttatctgcacctttcatcaaccaggggcaaacgagcccgttgatgcgcagagactaacatcatcttctgcaccttttgtcatccagggacagcgagtcaggtggcaggcgaagataccttatggtcatccgcacctttcgtcaaccgaggcgaacaaattcgacgatatcaggatgatgttggtcgttcgattctga

SEQ ID NO: 21682 - DNA, 135 bp, Glycine max
  Peptide Sequence Number=SeqID_113367
atggtttacaatgatggcataaacttgaaaatcctgatgagtcataacaacagcttccagaattgccccatgtatggtgttgcttgtcaatgtggtcttcgtcattggaagtgcggtagacagactttgtggtga

SEQ ID NO: 21683 - DNA, 267 bp, Glycine max
  Peptide Sequence Number=SeqID_113368
tgtcaaggacctcaaccagtagcaccttcctcgtccgcaaatgaacctgcccaacctcactctactccagaaaaagatgatgacaaaaatttaaagacgtatccctcttccattccctccaagagaaatttccaacaaaaaatggaagaagcagagaaggagatcttggaaacatttagaaaagtagaggttaacaatacctctgctggatgcaataaagcaaattccaagatatgctataattctggaaggagctttgtgcactaa

SEQ ID NO: 21684 - DNA, 234 bp, Glycine max
  Peptide Sequence Number=SeqID_113369
atgcaacagcagcaacaacaaagacaacaagcaactgaggccccttctcaaccttccttaaaggagttagtgaggcaaatgaccatccagaatatgcaatttcagcaaagacaacaaagacattcttgccagtgggtgagtctagtccaagtggttcctaagaagacaggtctcacagtgatcaagaatgagagggatgagcttatccccacaagagtgcagaacagctggcaa

SEQ ID NO: 21685 - DNA, 699 bp, Glycine max
  Peptide Sequence Number=SeqID_113370
atggtatcaaggtatgctttaaatcaaattgctgttaagtttgagcgtgtacattatgctgacaaaaacacttctcattgtggatgtgtgatgagaactactcacagtcttccatatgcatatgagctatccaaatatgttgttggtaccataccacttgagacaatccatataagtttttcagaccaagggttatctgagccccaagtgagcataaccaaagagatggaaaccatatccaatgattcttcagtcaaaggtagtgcatcatcatttgagcaaccgattcaaagaaggaccatgccgatgttggatcaatttcatccatgcattcatgattccattgtaaacattgttgatgtcaaagatgatggtaactatggatatcatgcaattgccggtctattaggtatgggtgaagattcatggtcattgttacgcaaccatttgcttaaagaacttaccaaatggtctgatgagtatatgaacttggctggtggcttagaacgatttgaggaattaaagaggtccctacttgttgatggattatccatggttaccatggacaagtggataaatataactgacatgggatatgtcatatgtcattgcatcaaggtatttttaagagaccgttgtctgctaccgctagtagcattgttatggtctacacattgtcatcatcaggcaaaacaatga

SEQ ID NO: 21686 - DNA, 444 bp, Glycine max
  Peptide Sequence Number=SeqID_113371
atgaatatacttatctcattcaagaagcttcattatttgttgcatttcagtatcactgcctcttatggaagaacgtgggttgagttcaaattgtctaaggtcgtgttcaaatccatagaattggaggtaaataactcgaggacactgctacgtgcacccagcaaaattactggtacacccagcaattttgcaattttcccattttgcccttcgatgaaaggatacggatcaactaatccgtatgaggcttacggattagctaatcatataagcccaatccgttcggtagatatatctggttcgttgtttttgaatcgtagagaggatgagggcttgggtggagaagacactaggcctagtcgtgctactcttgtggctttgttctcatgtggtgggttcaaagtgcaagcaattggatgtcataggttcatagtcggtgtttga

SEQ ID NO: 21687 - DNA, 240 bp, Glycine max
  Peptide Sequence Number=SeqID_113372
atgcgaacaaacttggaaatcgaagcaacttgtagaaggaacagagcagaaaggcatagaaattttttgcaagatatagaagcagcaacaattcttgaggaacctcagtcttcagagtcatcttctagttttccagagtcaagggaatcagatacaacattgcttgtagccaacataatggctgatgagaaacctagacgagtaacccttgaagactactcaagtacaagtgtgccataa

SEQ ID NO: 21688 - DNA, 330 bp, Glycine max
  Peptide Sequence Number=SeqID_113373
atgatgataacaaaagatgatgacaaaggtgatgacaaaaagctcaaaggtcaatcaaaggatgagttcaagatgttcaagaaggaatcaagaacaattcaagattcaagaggaaagttgaattcaagaatcaagattcaaggatcaagcttcaagatcaagattcaagattcaaggttcaagaactcaagagaagacttaatcaagataagtatgaaaaggatttttcaaaaactgagtagcacatggatttttctcaaaacatgtttaccaaagagtttttactctctggtaatcgattaccagattgttgtaatcgattaccagtag

SEQ ID NO: 21689 - DNA, 168 bp, Glycine max
  Peptide Sequence Number=SeqID_113374
atggatcattttaaggtcgaacgccttaaaggaccaccttccaagtctgatttccttatcacaattgaggaatacgtaggagcaaggttgtcgtcccttgtgacggacgtgtggggtgctaataccttccccatgcgtaaatacaactcccgaacctttcacacttaa

SEQ ID NO: 21690 - DNA, 369 bp, Glycine max
  Peptide Sequence Number=SeqID_113375
ggaacaaaagctggtaccgggccccccctcgaggtcgacggtatcgataagcttgatccaactggcgatgtcccaccccacataaacgaagaggaaaagaccgaaacacccagcttcctctccaaaaacactaccctcgagaaaatcctattgatccgtgatcgtagcggccgccaccgcgggggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 21691 - DNA, 375 bp, Glycine max
  Peptide Sequence Number=SeqID_113376
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctaacacttgccagcgctga

SEQ ID NO: 21692 - DNA, 1049 bp, Glycine max
  Peptide Sequence Number=SeqID_113377
atggtgatgcataaggctaaaaccgcgcgcctggcgctggctatcgcggggatgatggtgggtggcagtgcagcggcacagtcattaacgctggagcagcgtctggcccagctggaagagaaaatcgcgcgcgatgagcagcagcaaaaggaggcgagtgccggaacaaccaacacgtttcgtttttccggctacgcccgttccggcctgctgattaatgataaagggcgcggcggacgtgccggacctgctatttcgcctgccagttcgatcggcggcgatgcgcatattggccggttaggtaatgaaaaagatcactacatcgagctgggctttcataaccaaacccggttcagtaatggttcgtgggccaatttcaaagcgctgctggcagatggctcatccagtccggacccgtgggtgcagaataacgacaacaatctgaatatccgccaggtgtatgtcgaaatgggggatttccccagcttcagcggtgctgcccggcatgcctcactgtgggcgggcaaacgctttgacggtgacaattttgatctgcacttcactgataccgatatcgtctttcttggcggcaccggcggcggcatcagcaacctgcaatggaacgagcaatggcgcagcgatttctccatttatggccgcagttttggcgacctgggcagcagccgctacgacgataacaacgtgcaaaacctgctgctgacctcgaaccagttttacggtaactggcagtggatgctgaccggcatgagcgcaaacggcaacgacgagctgaaagggcgcgcatcgaccactggcagctatgcgctgcgcagtgacgatacggcaaaacacggcgtgtttaccatgctggcctggcacgacaaaaaccgcttttacggactggcaccgggcagcagcactcacgccattcaatgggggaaaggcctgggcgcagaaacccggcagatcggtggcgacggcgacttaacgcgcaacgccagcgcgctgcgacttgccacttttggcgtgatgccattgagcgatcgctg

SEQ ID NO: 21693 - DNA, 246 bp, Glycine max
  Peptide Sequence Number=SeqID_113378
atgaattcatcttcatcaggtgagactaagaagcttgaagactttgtggtttatgctcctctcgaccacacagctttggagcattataattttgagcattctgattctgagcattctgattttgcacattctgagaacatggcacaacctccaccccgtgagaggactctaagggaaatggctgcacctaatttcactacgaaagcttgtgcatccatacttgatgagatgtcccatatgttctaa

SEQ ID NO: 21694 - DNA, 699 bp, Glycine max
  Peptide Sequence Number=SeqID_113379
atgaaacccccagatgtccaagaggatcacatatttctgaaggcttttcctcattcattagagggagtggcaaaggagtggttgtattaccttgctccaaggtccatcacgagctgggatgaccttaagagagtattcttagaaaaaaatttcccttcttctaggaccacagccatcaggaaggatatctcagtcattagaggagtgcatgaggtagctacaaacccatctgcatcatctgaaactaagaagcttgaaggcaaactggatgcattggttaacctggtaacccaactggccttgaatcagaaatctgtacctgtcgcaagggtttgtggtttgtgctcctctgctgaccaccatacagacctttgcccttccatgcaacaacctggagcaattgagcagcctgaagcttatgctgcaaatatttacatagacctcctcaacctcagcagcaaaatcaaccacagcagacattatgactctccagcaacagatataaccctggatggaggaatcaccctaacctcagatggtccagccctcagcaacaacaacagcagcctgctccttccttccaaaatgctgctggcccaagcagaccatacattcctccaccaatccaacaacagcaacaaccccagaaacagccaacagttgaggcccctccacaaccttccctcgaagaacttgtga

SEQ ID NO: 21695 - DNA, 438 bp, Glycine max
  Peptide Sequence Number=SeqID_113380
atgccctctgggaggaaggaaatcgtatctttctcaggcttctatccctccttggctagaatctccaaaatagtcaaaatctcgacacaggaattggaccgaggaaagcaagtcgaaaatggggtggttggagtaccaaggaaatgtttggaagcaaaggcaagaaccttggcaagtcaagacgaatgggccccgttcatggatgtcctggcgctcttgatatttggagtggtcctctttccaaatgtggataggttggtggacctggcaatgattgatgcttttctcgcctttcacgaccgcaaggaaagcccggttgtcgctatcttagctgacctatatgacacattcgaccgaagatgtgagaagaacagtgcaaggattgtttgttgtacaccggccctctacgtatggttggtttcacaccttttccgctaa

SEQ ID NO: 21696 - DNA, 418 bp, Glycine max
  Peptide Sequence Number=SeqID_113381
cgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatcgcacccgtgagcctcgcctttgctcgcccgcgaagggcacgttgcgacacccgtggtggtccctattcgtttcat

SEQ ID NO: 21697 - DNA, 447 bp, Glycine max
  Peptide Sequence Number=SeqID_113382
atgaagtgctttaaatgtcttggaagaggacacattacttctcaatgccccaccaagaaaaccatgattataaggggccaagacatttatagtagccaagatgaggctactacttcaccttcctctaataaaagtgaagaagcaaaaagggaagaatctagtgaagagatctacccccaagaagaaggacaacctttaatggttaaggaggagtgtaaggagacacttgttcgcattgccacacctcttaggcttgagtttattcctcaagtaaaggagttgttggatgagggtttggttcgcaagagcttaaatccttgtgctttgttggtgcccaaaataggggttcccatgaaccctaagagaataaaggtcattcctgagtggcccgctccaccaagtgtgttgaggaaaaaaacccagagtttcaagaacctcgggatttga

SEQ ID NO: 21698 - DNA, 285 bp, Glycine max
  Peptide Sequence Number=SeqID_113383
atggcggaaccatcaaagaagtgcaagggttctttgagtagaagccaacgacactctgaggctcaggatactccgattccttcctccatttcctcctccttgttgttctcatcggaagaacaacgtacgcgatacacaaatctcttctcctctcgttctattattgaccctaagttcattgatatggatttcttttctgatgagagttttgaatgcattcaagcatttcagaacttaaatctcattcctttattgtctttaaaactgcttgtgtattctgaattg

SEQ ID NO: 21699 - DNA, 392 bp, Glycine max
  Peptide Sequence Number=SeqID_113384
aggtgaactctaaaggtgatggcggtgcgtctattgcccactaccgaccatccccaggctgctgtggtgtttcgccctgcacctgcctggagacacagtacttcttgatgaaagctcgattagtagggggcctgatgcccttgctggaggtgacaggactgatagaggcccgtaaccagagctggaaaccccagggccctgttggacttttccgggtccactgggtgtcttgtggagtggtcatgttggtgcgcatgatccgcactcgtctctttgcagcgacacaggtgaaatcttgccccggtatgcatagtagctgtgtgatagcctccctctctggttgtgctcgcacagttggccctcctccaatatcagggggggtggcccagtaa

SEQ ID NO: 21700 - DNA, 269 bp, Glycine max
  Peptide Sequence Number=SeqID_113385
cttctcaaactgttagtttttctgatattcaatgtgatgttcccgaacacaaaggagataactataagatatggaaggagagaattcttctgcaactagggtggatggacatagactgtgctataaggaaagatgaatcacatgcaatcactgataaaagtagcccagatgttgttgcactatatgagcagtgggagcgatccaaccaactcaacgtgatgttcattaagatcgaaatctcggttgggatatgtggttctatcaactag

SEQ ID NO: 21701 - DNA, 252 bp, Glycine max
  misc_feature (249)..(249): n is a, c, g, or t
  Peptide Sequence Number=SeqID_113386
atgacaccaattgaaggtattcgtcacaggcataagtgccttgagcatctgaatgaacgaaatagagaggtcgagatcctgagacatcgaaaccgcttccatgagcttcaagatgcaaatgagaatgtacgccagggaggaacagaacaccatgtggatcatggtgagagagattgggtagggccagctatacatcttgcgatacttgttgtactcgatgaccgtgaagctgaggaagatccatatcgncac

SEQ ID NO: 21702 - DNA, 543 bp, Glycine max
  Peptide Sequence Number=SeqID_113387
atggatatctatcacacagagctggatgaattcaaaggcgagctagagaggcgtaactttcacaagcacctcaccaacttagctgatagtagcattgaccttgcgttggtgaaggagttctacgccaacctctacagtctcgagggaccttcacctaaacaagtcagaattcggggccacttaataaggattgatgcagacagcctcaatgcttttctagaaacacctgtggtgcttgctgagggtcacccggggaagatcctcaaaaaagatctaaccacccttgctcaggtctggagtgttctatcctactccaacctggctccgacctcccacacatcagatctgactgtggatcgagctaggttaatctttggcctagttactcaactggacatgaatgtcaaagccctcatttctgggcagattacttctatggcccagtctaactcctctagactcagatttcctattcttatcacagctttatgtaggaccagaggagttgccttcgatagtcttatctttgcttgtttgagcccg

SEQ ID NO: 21703 - DNA, 114 bp, Glycine max
  Peptide Sequence Number=SeqID_113388
gataggtttcaaggacttcaacccccaagctctcaatgtatatgttttgtgctgcttgagctcccatcgtcgaccggattcaaggacttcacaccccaaactctcaacgaataa

SEQ ID NO: 21704 - DNA, 231 bp, Glycine max
  Peptide Sequence Number=SeqID_113389
atgaagtcaggtgacatgcgggggtaccgtatggttatccgcacctttcatcaactaggggcaaacgagcccgttgacgcgcagagactaacattgtcttctgcaccttttgtcatccagggacagcgagtcaggtggcaggcggagataccttatggtcatccacacctttcgtcaaccgaggcgaacgaattcgacggtatcaggatgatgttggtcgttcgattctga

SEQ ID NO: 21705 - DNA, 381 bp, Glycine max
  Peptide Sequence Number=SeqID_113390
atggatggtacaattcgctctgaggtgcatggtatttctatgatcattgatcaatctctgttctttttattaactaaattacccagtcaaggtgcaccttttgagggcaccattgttgatgactggaagtttgactattctagtcatgatgctcgccgtatggtatgtaatgaccaagctgatatgaccggtagattgctagccgaatcattaacctttgattgttgcatcatgcactatatcatagttagaattttgcttctctgttcttctaatctggctcaagtctctaaggaggacttgattttgatgtgggctttccttaccggtcgtcagaacgactgggctcactttcttaggtatcgaatgataaggcattag

SEQ ID NO: 21706 - DNA, 375 bp, Glycine max
  Peptide Sequence Number=SeqID_113391
atgggaacaaatcaaaccgaaacaagattctatcaagtcaagattaagggcctagatgtcaccagccttaaggagttggggcggttgatgggacctctccaaatgcaagccttccgcaaggcgtacggaaagattttagatttgaccatagcggagatattcatagaggccgttgtatcactcacccaatactatgaccagcctttgagatgcttcacgtttggagacttccaattagtaccgactattgaagaatttgaggagattctaggatgtcctcttgggggaagaaaaccgtatcttttctctgggtttcttccctccttgagcaagattgcagttgtggtcagggattcggcaagagagttggatcgt

SEQ ID NO: 21707 - DNA, 520 bp, Glycine max
  Peptide Sequence Number=SeqID_113392
atggcttccatgatggaggccatgttaggaatgaggcaactcatagagaaaaacatggtcaccgctgccgctgttagtttggctgccgaagcagacccaactctcctagctaccgtgcaccatcctccctcaaatgccgtaggacggggatggagcacactggggcacaacagcaacccccatttgggatacaaccgggtggcttacccttatggattgccgcctaattacacgccgctagtcatgcaagatgatgcgggtcatgtctcttcccccatccttgaaggggagcctcctcgaaagcccgacgaggtccacgaagatcatcaagagtatgcccaaggggatgtcgatttctaccccccgatccccatcgaggggccgacacccaacacattgcctcagcccaacctcacagcacaaccaatattcttgtctagagaagggccacccccggcggccgaagaaaggaggaaactcgatctcctcgaggagagattaagagttgttgaaggctttg

SEQ ID NO: 21708 - DNA, 864 bp, Glycine max
  Peptide Sequence Number=SeqID_113393
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggccacacctttttatgaaaaagtgagattttcatgcatatgggataatgtgcctggtatcacagtacaccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctgggaagatgccaggaagatacttaacagggaa

SEQ ID NO: 21709 - DNA, 859 bp, Glycine max
  Peptide Sequence Number=SeqID_113394
gtcgactctagaggatcccccgccttcagaggacttcacgtcctcacctttagaggactacacgtcctcaacttcagaggactacacgtcctcgccgtcaaagggtcatgtaccttcacctttgtagggcgacatgtcctcaccttcagaggactgcatgtcctcaccttcgtagggctacacgccctcgccatcagaggactacatgtcctcaccttcagagggctacacgccctcgccatcagaggactgcatgtcctcaccttcagagggctacacgccctcgccatcagaggactgcatgtccccaccttcagaggaccacacgtcctcaccttcagagggctacacgccctcgccatcagaggactacatgtcctcacattcagagggctacacgccctcgccatcagaggattgcatgtcctcaccttcagagggctacacgccctcgccatcagaggacagcatgtcctcaccttcgtagggctacacgccctcacctttagaggactacacgtcctcgccaacatagggctgcatgccctcaccttagaggactacacgactgcacgtcctcgccaacagagggctgcacgccctcaccttgaaggactacacgtccttgccaacagagggctgcacgccctcaccttgaagaggactacacttcctcgccatcagagggctgcacgccctcaccttctagaggactgcacgtcctcgccaatagagggctgcatgccctcaccttttagagggctacgtgtcctcattttcagtgtgctctacatccacaccttaagagaattgaggggtgggggggcccttaaatgcttaaccgagactcgcgctcccg

SEQ ID NO: 21710 - DNA, 396 bp, Glycine max
  Peptide Sequence Number=SeqID_113395
atgttggtgcgcatgatccgcactcgtctctttgcagcggcacaggtgaaatcttgccccggtatgcatagtagctgtgtgatagcctccctctctggttgtgctcgcacagttggccctcctccaatatcaaggggtggcccaggaaccgtgtggatatggagcccactgaaagtgaggacgcgtagtcctctaaaggcgagggcgtgtagccctctgaagttcaggacgtgtcgcctttcgaaggcgagggactgtagtcctatgatggcaaggacgtgcaatcctctgaaggtgaggacgtgtagtcctctgaaggtgagggcatgtagccctacaaaggtgaaggcacatgaccctttgacggcgaggacgtgtagtcctctgaagttgaag

SEQ ID NO: 21711 - DNA, 1053 bp, Glycine max
  Peptide Sequence Number=SeqID_113396
cattccataactggtgaatctgtgcattctgttattggtgattttgaacatcctgatcttgagcattataattctgagcattctgattctgagcattctgattttgcacattctgagaacatggcacaacctccacctcgtgagaggactctaagggaaatggctgcacctgatttcacctacgaaagcttgtgcatccaataccctgatgaggatgtcccatatgttcttaagactggactgattcatttgcttccaaagtttcatggccttgcagagggagtggcaaaggactggctgtattaccttgctccaaggtccatcacgagctgggatgaccttaagagagtattcttagaaaaagttttccctgcttctaggaccacaaccatcaggaggatatctcaggtattagacaactcagtggagagagcctatgctgccagtggtggagcccttggagacatgactcctgctgaagccagaaatttaatcgagaagatggcctccaactcccagcagtttagtgccagaaatgatgccatagtcattagaggagtgcatgaggtagctacaaacccatctgcatcatctgaaactaagaagcttgaaggcaaactggatgcgttggtcaacttgctaacccagctggccttgaatcaaaaatctgtacctgtcgcaagggtttgtggtttgtgctcctctgctgaccaccatacagacctttgcccttccatgcagcaacctggagcaattgagcagcctgaagcttatgctgcaaatatttacaatagacctcctcaacctcagcagcaaaatcaaccacagcagagcaattatgacctttccagcaacagatacaaccctggatggaggaatcaccctaacctcagatggtccagccctcagcaacaacaacagcagcctgctccttccttccaaaatgctgctggcccaagcagaccatacattcctccaccaatccaacaacagcaacaaccccagaaacagccaacagttgaggcccctccacaaccttccctcgaagaactt

SEQ ID NO: 21712 - DNA, 219 bp, Glycine max
  Peptide Sequence Number=SeqID_113397
atgccaagcttgatctccgctcaaacagatcaagctcgcttcagcgcttggaccgaagcaggcctaaccgcctgtttgaggcttgctcagcaagcgcctttcaccgcgcttggaccgaagctgacccctatttcttatttaacgctttgctaccgcactatcgggccgatagcggccgccgccgcttgcaggctatctctaggcggcctatcggcgtag

SEQ ID NO: 21713 - DNA, 219 bp, Glycine max
  Peptide Sequence Number=SeqID_113398
atgtcgcggggatcaggagaccttggggacgtcaggcgagctcctggcagtcaacagataaaaggaactaagaccacaaagcaaggaggcttatgtggtggctggccagctgtgaatcttggtgggcaatcgattacaaggcttaaaactgaagacaggaggctaagatggtctctggtaatcgattaccaagggggtgtaatcgattaccaggcttga

SEQ ID NO: 21714 - DNA, 276 bp, Glycine max
  Peptide Sequence Number=SeqID_113399
atgctttctcataagggtggacccttgggtactagtaccctcaccttcggaggactacacgtcctcccctccagaggactacgtgtcctcgcctttagaggactacgtgtcctcgcctttagaggactatacgtcctcgccttcatagggctacatgccctcaccttcagaggactacacgtcctcactttcagagggctacacgccttcgcctttagaggactacgcgtcctcgccttcaaaggactacacgtcctccctttcagagggctacac

SEQ ID NO: 21715 - DNA, 78 bp, Glycine max
  Peptide Sequence Number=SeqID_113400
atgacggctctttgcaaatccagaagaaggaaatcgagacattttcagaaggatccagaaggattgcctaaagcgtaa

SEQ ID NO: 21716 - DNA, 330 bp, Glycine max
  Peptide Sequence Number=SeqID_113401
atgtggtttggaatctcgaggcattacaattacattaagtgtaatgttgaggccatgcgaaatgttgagaacaaagctaatgcggttatcatacgcatgtgggtgaatagtgtgcacgaaaatgtcattggttcacgtgcattagaatctcgatgcgtcacagtaccacaattgatgttaacgtgctttggaatctcgaggccttgcaacaagacaatttataaatgtgctttggattctcgagacattacaattaccttaagtgtaatgttaaagacatgcgaattattgagaaccaagttaatgtggttaacgtacgcatgcgggtga

SEQ ID NO: 21717 - DNA, 78 bp, Glycine max
  Peptide Sequence Number=SeqID_113402
ttgtagctagatttgtgaatcaaataagtcttaagcttctcttgaattgtgttattcaagaaattgagcataagcaag

SEQ ID NO: 21718 - DNA, 239 bp, Glycine max
  Peptide Sequence Number=SeqID_113403
tcattaagaatctggaagtccaggtgggacaactggcaaaacaactggcagatcgtccgtcaagcagctttggagcgaacaccgagaagaatccgaaggaggagtgcaaggctgtaatgactagaagcaaattggccaccatgaatgaagcaattgatccagtggtagaacccctgagtgagtatgaggaagaaatagaggtagaagatgagcagaagaaggagacaacaataaattag

SEQ ID NO: 21719 - DNA, 447 bp, Glycine max
  Peptide Sequence Number=SeqID_113404
atggctgaatcttcaaagaagcgaaagggatcatcctccaccaccgttgctactgcccattgtcgccacgaaccatctaaagcacctacagcaccaatccatccttccttatcatctccaagatcatctaatctattttcttcagatgatcaacgtctgcggtacctttctcaattttattctaggatcattctagaccctaagtacctagacatagatttctttaatgatgagacatttgactgttatcaagtgtttcaaaactctggattgattgatttcatgtctttaaaattgtcttactatcctgaacttgttaaagtcttttacatcaatttaaaaattctggatggtattatttcttctgaggtgcatggtgcaccttttgagggcaccattgttgatgactggaaattcgattattctagtcatgatgctcgccgtatg

SEQ ID NO: 21720 - DNA, 225 bp, Glycine max
  Peptide Sequence Number=SeqID_113405
atgccgaggtcacctagcatgaatgatgtggctaaaagacgaaacaaaactcttaaggatatgcaaattcagaacctctacaagattttgttagtgaatctctcgctcaagataatttggtcgttcgtgaagaacaaactcaagatcctcaagaacctatgcttcatgagccaatacctttgtgggagatctataagagaaaggagaattggtattttcaaatga

SEQ ID NO: 21721 - DNA, 826 bp, Glycine max
  Peptide Sequence Number=SeqID_113406
atggggtttttatcgattaaaaccctgccgatttcgcagtttcctgaaattgctcctccacgtgtcatcgtgacgctggctttccctggctccagtgccgatgtgttggtcaaatcctcactgatttccatcgagcgggccatcaacggtgtaccgggcatgaagtacattgtgtctgacgccaccagtgccggtgaagcgaccatccaggtgatttttgacctgggcgtggacccgaacgcagccatggtactggttaaaaccaggctggaccaggtgatgagcaaactccctcccttggtgcagttagagggggtcatcgtcaataccgtacagccgagcatgctgatgtatgtgaacctgtacagtaaagataaaaacgccgacgagaaattcctgtttaactatgtaaacgtcagcgtgattcctgaaatccagcgtgtacacgggattgcccaagcgcaaaacctgggtagccgccagttcgcgatgcgtatctggctcaaccctgagcgtatgcgtgcctacaaggtatcgactaaagaagtcatggatgcgatcagcagccagagtgtgattggtcgccctggccgcctgggccaaagctcggggatttacgcccagtccaaggaatatgtcctggtgtataagggccggtataacaagcctgaagagtatggcgacatcattatccgcgccgattccaacggcgagatcctgcacctgaaagacctggccaaagtcgaacttggcagtgaattctttgacatttactccaacaaggatggctacccatccgccgcgattgtgctcaagcagaactatg

SEQ ID NO: 21722 - DNA, 687 bp, Glycine max
  Peptide Sequence Number=SeqID_113407
gtggtcgtaggactcgataagcctccatcaaagtctgttggagagccgaacaggttaacatctgtggccacagatgacccactgggagaattggttaagaagtcatatgtggtttacacaaagccaatggagttggcatgggacggggcgaaatttgggttacctaatgcctcaaatggttttttcatcacacatgtagatgtgactgaaataattttaggtgacaaatgtttaaacatatctgtactgcaactgtggatgatgtttatgaatgattggagtacaagcattggtttttctccagtgtacggtttccttgagccccagtctatacgctgcacaaaggacacgcgtgaagaatgtcaaaagtacatagaaacgtgggtcaaggtgtcacatcgagaaatctacttaggaccttacttcaatcaggcacattggcaacttcttgtgttgtgtccacgagagaacattatagtatggttctattctatacgaagaaagcctgatgttcacattaagtttgcagtgaacaatgcaatgaaggaaatatgcagtaatctccaaggcaaggacaatgcacctccacctccacctcaatggattgaggctaagcatttattgagcgcttatattgcatgtagagccatgtacaacaaggaccatatgagtgtggatattatgtga

SEQ ID NO: 21723 - DNA, 381 bp, Glycine max
  Peptide Sequence Number=SeqID_113408
gacaagttttggtgactgcgctcctccaagccagttacctcggttcaaagagttggtagctcagagaaccttcgaaaaaccgccctgcaaggcggttttttcgtttatcaagcttatcgataccgtcgacctcgaggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 21724 - DNA, 603 bp, Glycine max
  Peptide Sequence Number=SeqID_113409
atggggacaaatcaaaacagaaaaagattctatcaagtcatgattaagagcctagatgtcaccagccttaaggagttgggacggttgatgggacccctccaaaagcaagccttccacaaagtgtacggaaagattttagatttgaccacaaccgaggtatttacggaagccattgtatccctcgcccaatactatgaccagccgttgagatgcttcacgtttggggacttccaaatagtatcaactgttgaagaatttgaggagattttaggatgccctcttgggggaagaaaaccgtatctttcctccgactttcttccctccttgagcaagattgtagttgtggtcggagattcggcgagagagttagatcgtatgaagcaaactcgaaacggcgtagtgggcataccgcgaaaatacttggaaggcaaggcaagggatatggcgaatcaagaggagtgggtcccgtttgcggatatactagcttttctgatctttggggttgtcctctttccaaacctggacggtttggtggacctagccgcaattgatgctttccttgcatatcaccatagcaaggagagcacggtggtagctgtcttg

SEQ ID NO: 21725 - DNA, 698 bp, Glycine max
  Peptide Sequence Number=SeqID_113410
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacctgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 21726 - DNA, 272 bp, Glycine max
  Peptide Sequence Number=SeqID_113411
gattcctgaacacaagggaagggttgtccctgtgtggttcagactttgtaaaaggagttttacaaaaagagtggaaaatctcaagtgggttgcttgtggactggacgtaggcatgggaagtggccgaaccagtgggaaagctgcatctggtgatggagacaatggatccaccactggagatggtggctcagctggattgattgttttctggctctggcttctgctgctgaaggcctgggctatagagcttccattatccctcacaaaagaag

SEQ ID NO: 21727 - DNA, 565 bp, Glycine max
  Peptide Sequence Number=SeqID_113412
aggactacacgtcctcacctttagagggctgcacgccctcgcctttagaggactagacgtcctcgccttcaaaggactagacgtcctcgccttcagagggtacacaccctcaccttcagagggctgcacgccctcgcatttagagggctacgcatcctcactttcagagggctccatagccacaccttcagagaactcaagtagtttccttttatcagttcctgggccaccccctgatattgaaaggcgaccaactgtgcgagcacaaccagagagggaggctatcacgcaactactatgcatactggggcaagatttcacccgtgccactgcaaagagacgatgccgatctccccctgcggaagtatcagttggtctgtgccgtcccgacataggggttttgcccacaagacgcccagcggacccggagaagtccaacaaggccttggggtttctagctctggttacggggattgtgcccacaagacacccagtggacccggaggagcccaacaaggccctggggtttccaactctggttacgggcctctgtcagtcctacagg

SEQ ID NO: 21728 - DNA, 351 bp, Glycine max
  Peptide Sequence Number=SeqID_113413
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtacgccaggttttcccagtcacgacgttgtaaacgacggccagtgccaagcttgcatgcctgcagtcgactctagaggatccccaattttgcttagtaatttgatttag

SEQ ID NO: 21729 - DNA, 513 bp, Glycine max
  Peptide Sequence Number=SeqID_113414
gttgcctgcgcggaagatgacgcaaatctccatgtgtcaacgggcttgttggccgcgattgacaaaggtcttagagatagcaaaagaaagtttgcgcgttaccgtcgggtgtctctgcatgccaccggactcttgggtcacggtaacaaaggtggggtggtcgacaaaagcaaggcttttgctcctacgcgcggattggaaggtcgggccaccatcattgccatatctgcggaggcaatgcttactacctcaaaagattggaaggccgtttccaatgactcctccgcggcttccacatatggcatagaggacgggcaacttaccaagatggaacgactcccaccgagtggatccacgggtgtcccaaaggcagctgtaagccgggttaatatccatcacttggaacgtaacttgacaggtatgaggccttatctgtacagggaggtcgatctctcccctcacctctcggtggctgccgttgaaagcatggactaccatggaacttggctttag

SEQ ID NO: 21730 - DNA, 471 bp, Glycine max
  Peptide Sequence Number=SeqID_113415
atgaagcacttcactgacaccctcatcagtgccaacatagtaagcccagtatacactccgctagcgcccaatacgcaaaccgcctctccccgcgcgttggccgattcattaatgcagctggcacgacaggtttcccgactggaaagcgggcacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtgggtggttacgcgcagcgtgaccgctacacttgccagcgctga

SEQ ID NO: 21731 - DNA, 219 bp, Glycine max
  Peptide Sequence Number=SeqID_113416
atgcccgggttgggtcgggattggtcaagcttggtttgggaaatagcaccccacctaacgtccccaaggtctcctgacccctgcgacatatctccaggattatggggtacctgtcatatgtgggtactaggtggcgatcggacgatggtgcaagtcgactctccacatccacaaatcacacataaatccatcatccccaggtgcccacctttcaactga

SEQ ID NO: 21732 - DNA, 238 bp, Glycine max
  Peptide Sequence Number=SeqID_113417
gaaccacgggacccctactagtaaagggaaaacggaagtgcgcgttagcgcaccagctgaaaaagccctttccccttactctaacaaattgggttgctggatacgggatcctcgtagtaggctggaccaacatccagccgagagagggcagcctttagaagcaacaagcgagaaatggcttgatgaaccgttccgttcgccacgcaccggccccattcacttgcttatcgtagaggct

SEQ ID NO: 21733 - DNA, 429 bp, Glycine max
  Peptide Sequence Number=SeqID_113418
atggttaaggagaagtgtaaggaggtaagtgtctcctctaagaggttagctaagatggaaagtcattttgaaataaagacaaatgttaaagaaacttcccctcttagacaacctccacatcttctcctttgtaaaaagacacttgttagcactgtcacacctcttgggcttaagattattcctcaagtaaaggagttgttggatgagggtttagttcgtaagagcttaattccttgtgctttgttggtgtccaaagtaggtgtcaagggaaggagcctagagtatgaagaacctcgggatttgaggtcaaatcctttccaaggtggaggggatgatgcaatcctacccccaagggtattggatagaagactccaagaggattggtctagagttactaaagaaggccctaggattctcatgaacctaagg

SEQ ID NO: 21734 - DNA, 243 bp, Glycine max
  Peptide Sequence Number=SeqID_113419
atgaagggacatttttggcattcttttcaaatacgtgagaaagcttctatcagggttcctgttgaaccaaattttgacttatcaaggttgattccttgtggcgtcaccttgacttatcttccatctctggaagtggcgtccctcttcgttaacaatcctgtgtcaaacgttctgccccgttcctgcacatacatcataaggcaaaagagaggaagtagagttgccaccacttccaactattaa

SEQ ID NO: 21735 - DNA, 276 bp, Glycine max
  Peptide Sequence Number=SeqID_113420
atgaagctttgcttctacacccaacaaaacactcactatcctaaggaaaaattgcctaaaattattacacaaaaatggaagtttggtaacctattggaggctcccaacacacttccaatgaaaggcctttttgttataaaacttgaaagcaatgaagctcttaaggtggttggcccatttcttcttgactcaaattcttcaagggatggcaccaatcctccttccaattccctatatgacaacccacaaacaaggaaacaaagagacaagcaataa

SEQ ID NO: 21736 - DNA, 480 bp, Glycine max
  Peptide Sequence Number=SeqID_113421
atgacaagcagagacaaaatttggtcattctgcacccttgtgtcatccagaggcggcgggcccgatgacacgcggagataccttacggttatccgcacccttgtgtcatccagaggcggcgggcccgatgatacgcggaaataccttacggttatccgcacccttttgtcatccagaggcggcgggcccgatgacacgcggagataccttacggttatccgcacccttgtgtcatccagaggcggcgggcccgatgacacgcggagataccttacggttatccgcaccccttggtgtcatccagaggcagcgggcccgatgacacgcagagatacctttgcggcacccaggcccacttgggccctccagaatattcctccagaaggctgttgcttctggaggaagcaacctggctcgcctgggcgagctgagctcgcctgggcgagctgggcggcaaccacctcccctattttgctataa

SEQ ID NO: 21737 - DNA, 117 bp, Glycine max
  Peptide Sequence Number=SeqID_113422
atgtcatttcctgctttcagggttagttcgcctgggcgagcaccccctgcacgaaatggtttaaaaagagaaggggggtgcaatttttcacccaaggaacttctccccttcacttaa

SEQ ID NO: 21738 - DNA, 318 bp, Glycine max
  Peptide Sequence Number=SeqID_113423
atgatacgcggagataccttacggttatccgcacccttttgtcatccagaggcggcgggcccgatgacaagcagagaccaaatttggtcattctgcacccttgtgtcatccagaggcggcgggcccgatgattcgcggaaatacccaagtggttatccgtataaacattcttttgctatctcacccaggcccacttgggccctccagaatattcctccagaaggctgttgcttctggaggaagcaacctggctcacctgggcgagctgagctcgcctgggcgagctgggcggcaaccacctcccctattttgctataa

SEQ ID NO: 21739 - DNA, 120 bp, Glycine max
  Peptide Sequence Number=SeqID_113424
atgtggaaattctcatcgttcttcgtcgttcttcactgtcttcatccgttctttgttcgttcttcgttcttcaacggttttcttttcttcccttttgacgtgcttaagccatttatttaa

SEQ ID NO: 21740 - DNA, 165 bp, Glycine max
  Peptide Sequence Number=SeqID_113425
atggctgaatctcctcaggagcaggtgcaaaggatgactcaagtatctgatctgtggaggtaccctcctcttgagccatgtgtaggaggaataactggagctgaggaaggtactggagctatggaagaagaaggagttggcgtctcagtggtgctgaaatggtag

SEQ ID NO: 21741 - DNA, 169 bp, Glycine max
  Peptide Sequence Number=SeqID_113426
ggaaacatcccttagcaccgccatacctcttaagcttgaggttattcctcaagtaaaggagttgttggatgagggtttggtattagacattagagaaactatccctaagatagttccaaaggatagcaacataaatgcttcaatgtcttgggagaggtcacatttttga

SEQ ID NO: 21742 - DNA, 492 bp, Glycine max
  Peptide Sequence Number=SeqID_113427
atgactacaggatcatcggtctactctacctcaattcaccatttcgaactttatacagaaggtttttccgtaccagctccttctacctataccgctgttgaagcacctaaaggagaatttggtgtctttctggtcagtaatggaagcaatcgtccctaccgtcgtaaaataagagcacctggctctgcccattcacaaggactcgattctatgtccaaacatcacatgccagcagatgtggtcaccatcatagtggatgagatcggtcgagtggtctccgttggagatgggattgcacgtgtttatggattgaacgagattcaagctggggaaatggttgaatttgccagcggtgtgaaaggaatagcgttgaatcttgagaatgagaatgtcggaattgttgtctttggtagtgataccgctataaagaaggagatcttgtcaaacgaactggatctattgtggatgttcctgcgggaaaggctatgctag

SEQ ID NO: 21743 - DNA, 192 bp, Glycine max
  Peptide Sequence Number=SeqID_113428
atggatcctcgtaaaggattagatgtactcattccaataccagactcaatgagcccggattgggtaattgcgcgcctgctgccttccttggatgtggtagccgtttctcaggctccctctccggaatcgaaccctaattctccgtcacccgtcaccaccatggtaggccactatcctaccatcgaaagttga

SEQ ID NO: 21744 - DNA, 528 bp, Glycine max
  Peptide Sequence Number=SeqID_113429
atggcctccaggaagcgtaagagcattggggcaaggccaactgctcagtatgacactagacggttccattcgcttgatgcttggaaccgttatacagataacgtcttaggaaggagcagtttgccagagaggaaggttgagatataccacacagtgtttgatgacttcaagacagagttggagagacgtaatcttcacaaacgcctcaccaacttggctgatgggactattgatgttgctttggtgaaagaattttatgctaatctctacaactctgaggatccttcaccaaagcaagccagagttagaggccacttggtaaagataaacgtcgacagcctcaacatatttctagagactcctgtagtcttagaggagggggagacattacccacctactctaggtactgcaggccatccagggaggattctcaggaaggatctgactaccttggcccaggtgtggagtgttctttcttactccaacctagcccctacatctcatacattagaccttattgtagatag

SEQ ID NO: 21745 - DNA, 288 bp, Glycine max
  Peptide Sequence Number=SeqID_113430
atggagtacacgccggaaaccggcacgggagcaatggggccgacgacgggaggagcagggatttgcacggagggggcgacaacgagaattgcgagtgcgaagctgaggaggaagacgatggtgtcatcatggaattggaatagatcacaacgcgaggcagagtttgatgttgagatcaaagatagtagtggtgtagaaaacatggtggtcaatcatttgagtaagattgagggacctgttgatcccctccctattagggataacttccttgatgagcatttgatgtag

SEQ ID NO: 21746 - DNA, 342 bp, Glycine max
  Peptide Sequence Number=SeqID_113431
atgtctcctccacctctagaacctcacaatcactcacaaactcatctcaagctctcaggatggcttcctcttcaagctcgattctttgtaggtggctttgttcgtgcttgcgcgcttagcgcaactctagaccgcttgacgctcattagtggatttcggcttagcgcgtgcttttctcgcttagtggatggactgaagcagtgcgcttcactggatgacccttcgctcagcgaacatgcacaactcatccttcttccagattcttactcgcgctcagctgaaggagtggtgcgctcagcagatgccttgctaagccagcagattggcttagcgagagactga

SEQ ID NO: 21747 - DNA, 264 bp, Glycine max
  Peptide Sequence Number=SeqID_113432
atgaatgtgttgagtggtgcaacaatctttggtaaaatcactcatgcacccaacatcttcacgatttgtgtacatagggactcattaggtagtgatcaagggcttcccatggaccttaagagaataaaggtcattcctgagtggcctactccaccaagtgttgaggaaagaattcatgagtttcatgaacctctggatttgaggtcaaatccgtttcaagggggatggaatgatgcaatcctaccccccaagggcattcgatag

SEQ ID NO: 21748 - DNA, 288 bp, Glycine max
  Peptide Sequence Number=SeqID_113433
atgttggtgcgcatgatccgcactcgtctctttgcagcggcacgggtgaaatcttgccctggtatgcatagtagctgtgtgatagcctccctctctggttgtgctcgcacagttggccgtcctccaatatccgggggtggcccaggaaccatgtcgagcacactgaaaatgaggacacgtagccctctaaaggtgagggcgtgcagccctctcaaggtgaggaggtgtagtcctctggaggtgagggcgtgcagccctctgctggcgaggacgtgtagtcctttcaag

SEQ ID NO: 21749 - DNA, 551 bp, Glycine max
  Peptide Sequence Number=SeqID_113434
tggtatgatggtggtttttgaaggtggttccaggtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggagcgaacactgagatttatttcctaggtctttggaagaagtccagtttagtcataggcccagaagagtgtagaagccaccatcaagcttatcgataccgtcgacctcgagggggggcccggtaccagcttttgttccctttagtgagggttaatttcgagcttggcgtaatcatgtcggggaaacctgtcgtgccagctgcattaatgaatcggccaacgcgcggggagaggcggtttgcgtatttggccgctagcggagtgtattctggtctttctatgttggcactggaggagggtg

SEQ ID NO: 21750 - DNA, 786 bp, Glycine max
  Peptide Sequence Number=SeqID_113435
atgcccgaaccgactcccgtggagcgcgagacggtgtatcccgagctggcgcgggccgcgggcgctggtgaggtgccgggctcatctgcgggtggcgagcagcccaaattctgcacctacaccgaacgcggacatgtgctggtgaaattcaccgcagcagatgacaacccagtcagtgaacgctggcgcgatctgctgatggctgaacatctggccctgaaagtgctgggtgttgagaccgacgtgtttgatattaaagggcagcgcttcctcgaaatccctcgcttcgatcgggtgggcaaaatgggccgtatcggcgtgttttcgctgcgggcgcttgatgcggagtttgtcggcaatgccagcgcaagctggccggtcctcgtcaaccagcttgtggcggaaaagtgtgttcagccggaggccgccagcagcacggcccggctttgggcattcggcatgctgatcggcaataccgacatgcacgccggtaacctgtcattcatcagtcgtcatggccgtccttaccacctcgcgccggcttatgacattctgccgatgggcttcgcgcccagagcgggcggcgccatcgtgaatacgctgcggccagcgtcactgccggaagtggtcagcagcgatatatggcgggaagcactggttttggcggaggaatttttgtcgctggcgaacagttgcgatggcttctcagatcgttttgcgccgtgcctcgccgcgttacaacaacatctggatgaggcccgagcgcgcatcgcccgactcggctaa

SEQ ID NO: 21751 - DNA, 234 bp, Glycine max
  Peptide Sequence Number=SeqID_113436
atgaatcctcaagactttacaaaagaaaaaagtcaaggccctatccatgataaaaagctattgaaagaaagacttcaaaaccgggaccaacagctgaaatccaaatggtctggcccttttgttatcaagaaagttcgatcttatggtgcaatagagctatacgacccacaatctcagaatcctgacagacccatcggtagtaaatggtcagaggttccaactgtatcatggtga

SEQ ID NO: 21752 - DNA, 557 bp, Glycine max
  Peptide Sequence Number=SeqID_113437
ggcgaggttcaaacgaagaaaggcttatggtggatacctaggcacccagagacgagaagggcgtagtaagcgacgaaatgcttcgggagttgaaaataagcgtagatccggggattcccgatatagaggaaaagaaagcaaaagcgattcccgtagtagcggcgagcgaaatgggagcagcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctg

SEQ ID NO: 21753 - DNA, 357 bp, Glycine max
  Peptide Sequence Number=SeqID_113438
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggctttcgaagagttacagaaactcacggattgcgtaacaatacttccttttgatttcgatcacgttacggaatttcacggatcgcgtaacaaccttttgatttctggaacgtgtcgggacttcacatattgtgcaacaaagggtgccaagtacctcgaagcggtcaatcaaaggttgcatgccatcaagcaatacttcccggacgaaattagggtatga

SEQ ID NO: 21754 - DNA, 537 bp, Glycine max
  Peptide Sequence Number=SeqID_113439
atggccccgaggaagcttgcctcaaagaggtccaggaaggacaaggcggccgaaggaactagttccgctcctgagtatgacagtcaccgctttaggagcgctgtacaccagcagcgcttcgaggccatcaagggatggtcgtttttccgggagcgacgcgtccagctcagggacgacgagtatactgatttccaggaggaaatagggcgccggcggtggacatcactggttactcccatggccaagttcgatccagagatagtccttgagttttatgccaatgcttggccaacagaggagggcgtgcgtgacatgagatcctgggtaaggggtcagtggatcccgtttgatgccgacgctatcggccagctcctgggatatccgttagtgctaaaagaggaccaggagtgcgagtatggccagaggaggaaccggtctgatggggaggcgagtgcgaatcatgcgcaccaatatgaccaccctgacccagatatggatgacgttgctcctcagcaacatcatgcccagcgatcataa

SEQ ID NO: 21755 - DNA, 384 bp, Glycine max
  Peptide Sequence Number=SeqID_113440
tggtgccactcatttgtttccatgttgtagagtggtaccaacccgatagagtgttgcgacaatttagaatgcaacagcctattccggagtctccttcgcaaccacagaatatccatgggctaacgctgaaaggcaaacaagttgatgagcaagagaggatcactgagcctgtggcacatggtccagcatcagagcgtcgatttctgtcacaacagtttcacatgcttcagtccagtgtcaaaactcgatgttttgacagacgaagggagattgttcaagcagaagatttttcccaacaaatggagcagcgtggccatggaatgtactacacgctaccaacattttctcagtatccttcgcagatgtatcagtatcctttcgaag

SEQ ID NO: 21756 - DNA, 498 bp, Glycine max
  Peptide Sequence Number=SeqID_113441
atgcataccagggcaagatttcagccagcttctgcaaggagacgagtgtggatcatgcgcaccaacatatggatgatgttgctacctagcaaccttcttcagagtgaccacaactctgatctccccctaccgaagtggattgcgcctacaggacactcagtgggcccggagaagtccaacagggtcctggggttttcagctctgattacgagccttcatcagttctacggagtgcccgtcgcccctagcaggttcatcaggcccctattaatagggctttcatcgagaagtattgcgcccccaagcaggcatagggcaaggcatcacagtagagggcaacagacgcaccgccaccacctccagagttcacctcagctcacccacaaaaaggctggagcgttgcctacgacacatggtcaaccagtaggcacccaaccaccagaacaggtacgagcaggtactgggcccgtgatcaacaaatcaccatcttgcgtctag

SEQ ID NO: 21757 - DNA, 222 bp, Glycine max
  Peptide Sequence Number=SeqID_113442
atgagggaggggagttttgggtggagagaaactccccctcccctcgtttttatgtttccaggtgcaggggtgttcgcccaggcgagcaaccccccccccccccccttagggatactaggttgtctcccaactgcgcttctcgcttgtccggaactgggcatgggacgacgatccatcgatcatgggcctagcctctactcgcatccatccctaagtacctga

SEQ ID NO: 21758 - DNA, 189 bp, Glycine max
  Peptide Sequence Number=SeqID_113443
atggcctcctatggtgaagcaaaggaatccattgatgatgaagatcctaggcctacaagctccaatggagcttacatcagcaacttcagcgcgcttagcgcgatagaagaatctggcagggcatcaatatcaaggtcacgcgctaagcatgagatcagtgtgttaagcacaacaattatcttcagctag

SEQ ID NO: 21759 - DNA, 516 bp, Glycine max
  Peptide Sequence Number=SeqID_113444
atggctgatgaacatcagcaaagggttacccttgaggactactcaagcaattcagtgatgcaattctttacaagcattgcacgtcttgaagggaaattattccaaggattaccaaatgaggacccttatgcacattcggtgacattcattgaaatctgtaacactgtaaagattgtaggcatgccagatgaagccattagtcattttattttcattttccttagcagtagaagccatgagttccttgacgagtccttgagtgaagcgttggagaggtttagaggtttattgagaaagactcccacccatgggttacaagttgtaccatctgtggtgaggctcatgaaacacgtcaatgtattcccatcaaagaaaacactcaagaagttcactatatgggaaatcaacagagacaaggatatactcgaggaggattctcaggcttccagcagggcccttataaccaacaaggacagtggagatcacaccctggcaatcaattcaacaaggaccagg

SEQ ID NO: 21760 - DNA, 216 bp, Glycine max
  Peptide Sequence Number=SeqID_113445
atgtgggtgcaagccattggtctgtttgctcaagcgacctgtgctcctgagtttggacttccaagaccgttcaatcagagattactcgtcttgcgcattggtggggctgccgtaaaacaacaaattaatgatgcacacagggacaacccttcccttgtgttcaagaatcccctacaacaagagacccacggtctcttaatcccttttcaaaaataa

SEQ ID NO: 21761 - DNA, 687 bp, Glycine max
  Peptide Sequence Number=SeqID_113446
taccctcacctcgtagggctacatgccctcgccatcagaggactgcatgtcctcaccttcaaagggctacacgccctcgccatcagaggactgcatgtcctcaccttcgtagggctacacgccctcacctttagaggaccacacgtcctcaccttcagaggaccacacgtcctcacctttagagggctacacgccctcgccatcagaggactgcatgtcctcaccttcgtagggctacacgccctcaccatcggaggactgcatgtcctcaccttcagagggctacacgccctcgccatcagaggactgcatgtcctcaccttcatagggctacatgccctcacctttagaggaccacacgtcctcaccttcagaggaccacacgtcctcacctttagagggctacacgccctcgccatcagaggactgcatgtcctcaccttcgtagggctacacgccctcaccatcagaggactgcatgtcctcaccttcagagggctacacgccctcgccatcagaggactgcatgtcctcaccttcgtagggctacacgccctcacctttagaggaccacacgtcctcaccttaagagggctacacgccctcgccatcagaggactgcatgtcctcaccttcagagggctacacgccctcaccatcaaggactgcatgtcctcaccttcgtag

SEQ ID NO: 21762 - DNA, 812 bp, Glycine max
  Peptide Sequence Number=SeqID_113447
accacaggaagcaagtcgaaaatggggtggttggaataccgagaaaatatttagaggcaaaagctagaatctcggcaggtaaaggcgagtgggccctgttcatagatattctcgcattgttgattttcggaggagtcctctttccgaatgtggatgggttggtggacctggcagcgatcgacgcttttctcgcctatcataaccacaaggaaagcccggttgtcgctatgctagccgacttatatgacaccttcgaccgaagatgtgaggcatgcttgcccgctagaaagccaccgttgatgcacagagaaaggaggggaaattgggaccaactcctagcaagcaaagaaggagcatctgtcaactggttccctcggtggaaagaaggaagaaccggagttctttcgtgcggaggatttctgaatgttcccttgatggggacgaggggttgcatcagttacaatcccgttcttgctataaggcaacttggctaccctatgagaggggcgccactagagtatgagctcgtgcctgtctgcaaggcatgggaggtgttgcaaaagaaggacaaggaactcaggggcagtaacaatgggaccatcggtggctatcgtaagtggttaaaagcccacgtgcaaggtttggattggcttccaagtttgagaaccactaaaagagaggaagttgaggcaccggaggaagacaaagaagtgcaggcccttagggtggaagtcgagcaagcccaaacagttaaagaaaggttcaaatcagcagctctgaaaatccgaaaagagaatactgaactgagagat

SEQ ID NO: 21763 - DNA, 365 bp, Glycine max
  Peptide Sequence Number=SeqID_113448
agtctttcgatgaagatgatagtgatgatggaatatctgatatagacgatgaagtcactaacatcgttgaaccagtttcaattgttcacccaaccgaaggtgtaccagaaattcaaaatccattatggaatgatgccatgcattataataatatcaattggagtcatccggacgaggaggacatttgtggtctggacatgccaacgacttttaatgttggacaagaattatatgttggcgtgaattttgatagtaaagaagcggtcaaaaatgcacttaaacaatatgtgatgaaggttaagtggtggctggacagaaatatagaaatggcaataactgaagctacagggctccaaatgaggtga

SEQ ID NO: 21764 - DNA, 312 bp, Glycine max
  Peptide Sequence Number=SeqID_113449
atggaggctgatatgagcattgaacaagaccaggatgctaacatagttgatcaggtcaatagttgggtcaacaacaaactgaggaagagtctgtggatgatcgattggacaagcaataacagacatcagtcaactgcaggagggactgttgtgcatgttcttaatgttcttgcttctgatgtgatgcttgagaggaaattggttcagaactccagatttggtgccaaaaaagttataaaggagtttgcacgcatttactggtattccatcacggcaaacattgtgcttcaaagaagctacatgggaagatga

SEQ ID NO: 21765 - DNA, 1158 bp, Glycine max
  Peptide Sequence Number=SeqID_113450
atgtctaggacgctagtgcagccaataggacagaagaggctaacaaatgtggcagtggtgcgtctgaagaaacatggcatgcgcttcgaaatcgcttgctaccctaacaccgtcctctcttggcgttctggcgtggaaaaggacccggatgaagtgctgcagtcccacactgtttataccaatgtttccaaaggggttcttgccaagtccaaggatttaatttcagcttttggcaccgatgaccactccaaaatttgcttagatattttaaagaaaggggagcttcaggtagctgggaaagagagggaatcattgttatcgagtcagttcagggatattgcgaccattgtgatgcacaagacttacaatcctgagactcagcgtccatacactatcagtatgattgaacgcctcatgcgggaaatccattttgctgttgatccacacagcacctccaagaagcaggctctggagttaattcaagagcttcagaagcacttccctataaaacggtgtccgttgagaatacgtgctactgctcctgatgaccaggtgcctgaacttttaggaaagctgaatgaatggaatgccactgttatttctaaagaaggatcttctgctgtttcttgccataccatgtctaaagtgaaacaaaggatgactatggttggtagttttaaagaggtccttagtatgtcttctgtgggtgtttggatttttgaattggaacctggtctatataaggattgtcatgactttgttatgaataagatgcatggaagatttgaagttcttgcacactctctttatgtggagggggatacccaagtggagcaatacaatgattatgaggatatacctgaagccttgcccaaagaaacttatgattctgtgcttaaactgaatgagaaacttcaaaagcaaacaatttcatctactagtaggcctaccgagggacaacaaaagcaaaacaagtgcagcacatgtaatgtttcttttgatgacactaagctgtacagggaacatcacaagagtgaatggcacaagcacaatatcaagcgtaagacaaggcaactcccaccgcttactgaggaagagtgcatggctgacatggaattgggtgattcaaaatctgatttgaaggattattcattttaa

SEQ ID NO: 21766 - DNA, 1440 bp, Glycine max
  Peptide Sequence Number=SeqID_113451
atgtcggtgagttcgagttccaggggaagaataacgacggagcttcaagtcccgaagaaatggacagacagagaaacaagtcctgagagaaccaaggtttgggccgagccaaagaccaaaacggcaaaaaaagtctccgtcgtttactacctctcccgaaacggccaactcgagcatcctcacttcatggaagttcctctctcttcgcctcacggtctctacctcaaagacgttatcaaccgcttgaacgccctccggggcaaagccatggccaccttgtactcttggtccgccaaacggggctacaaaaacggcttcgtttggcatgatttgtcggagaacgacttcatccacccgacgcaaggacaagactacattctcaaaggatcggagattgttgagcacggtgtagccgccgtcgccgctagggttaacaaatcggaggaagagtccaattcgccggtggcgatcacgagacggcgaaaccagtcgtggagctctattgatatgaatgagtaccgagtttataagtccgaatctttcggtggctcggctgagagaatcggcgccgacgcggcgactcagacggaggagaagctgaggcggaggagggcggcgagggaggaagaagtggtggagattcaagagaagaatgatagaagaattgaagcgggaatggagggagagagggtcccgcacgtgacttgtgatgataatgatagtaataaccacactacggagctgagtagggacgagatctctcctccaccgtcggattcgagccccgagacgctggagacgctgatgaacgcggatggacggctcggactgcggtcttcggaatcccagaaggacaatctgacggtggagagctgccctagtgggaggatgagagcttcgtctgttttgttgcaattattatcgtgcggtgcggtgtcgtttaaggagtgtggagccaacgcggtgaaggatcgagggttctcattggttgggcattacaagtccaggatgccccgcggagcagggaatcattcgggaaaggaaacggggacatcgatggaaattccagatttgagcagggtgaggttggaagataaagaatattttagtgggagcttgatcgagaccaagaaagtggaaacccctgctttgaagaggtcctcttcttacaatgcagatagtggttcccggttgcaaatagtggagcatgaagaagatgtagtgcgggcaaagtgcataccacggaagtcgaagacactaccaaccaaaaaagaagaaggtgcttccatgcatattctgatgcctgatagtggaggagaagaggacaaaaagcttagggatgtgaggttagaacgagaagtgtggaagaatggacagtatagtgatctagagctttgcaatttgcaagtcacggcatggtgggcatacacgtcgaggtag

SEQ ID NO: 21767 - DNA, 954 bp, Glycine max
  Peptide Sequence Number=SeqID_113452
atgaccaacaggccagagttatatccagggagggaggggagtgataacagaaaaaaggcaattctattatgcttacaaaacataacttctaatcaggtcattgttgctgacaactacttcactggatcaaaggacaacctcaaaaaatggattggtcatccaagatttgagcttatccgtcatgatgtcactgaacctttgacgattgaggttgatcagatctaccatcttgcatgccccgcatctcctattttctacaaatataatcctgtgaagacaataaagacaaatgtgattggcacactgaacatgcttgggcttgcaaaacgagttggggcaaggattttactcacatcaacatctgaggtatatggggatcctcttgtgcatccccaacctgaaggctattggggcaatgtgaaccctattggagttcgtagttgctatgatgaggggaaacgtgtggctgaaactttgatgtttgattatcataggcagcatggaatagaaatacgtgttgcaagaatctttaacacatatgggccacgcatgaatattgatgatggacgtgttgtcagcaacttcattgctcaagcgattcgtggtgaacccttgacagtccagtctccaggaacacaaactcgcagtttctgctatgtctctgatctggttgatggacttatccgtctcatggaaggatccgacactgggccaatcaaccttggaaatccaggtgaatttacaatgcttgaacttgctgagacagtgaaggagctaattaatccagatgtggagataaaggtagtggagaacactcctgatgatccgcgacagagaaaaccaattataacaaaagcaatggaattgcttggctgggaaccaaaggttaagctgcgagatggccttcctcttatggaagaggatttccgtttgaggcttgacaaaaacaattaa

SEQ ID NO: 21768 - DNA, 579 bp, Glycine max
  Peptide Sequence Number=SeqID_113453
atgccttcagtttacatgggagataggatggataattctaactcgagcttgagttctaattctaaagaaagcagtgttgttgttaatgggaaagaaacgtacaaaaaacttctggttgcatcacggcctaaaggctttgcacagagaaattatgaacaccttgtgtcattaacccatggtgactttggaagcagtgctgtgggacgtgtcacgttttttctactaaaacttgctgcattagaaaccgtgaggagattctccaggagtaaatgtccgtgtgtatggcgaggcctacagggtctccaaatccttgtctatccaccattcaaatggattcagaggtgggcacccttcaggggtttggtgaaaagcatgcaggtactatcaagacctctattagtcctttctattgcaaccgtctttactgatcaaccacaatgtagtgatggaacctcagattgtgttgcttcgcatgattctgaagcatccgccgaactatctccagcagaggctaatttgaatacaaggattaagaatctaactgagcctgcttgttccatatatcatatggaaaactaa

SEQ ID NO: 21769 - DNA, 1767 bp, Glycine max
  Peptide Sequence Number=SeqID_113454
atgccgagaaaaggaatgagaagcattttcttcacatcaacgcccacggcatcactaccacctccttcccgtcaacgcactttctcagactcgttaatggacgaaaacatagaaaccgcagagaagctcataacgaaatgggacgattccaaagtcacaacaacaacgcaacttttcagcggcacgcgccaggaagccaaacagtacctaaacgccgtgaagggactacaatccgctatgcagtacctcgtcgcacaggattccacctccagcaccctcgtgcgcgcgcagttcctcatgcaactcgccatgaagacgctccagaaagagttctaccagattctatcctccaacagagaacacctggatcccgaaactgtctccacgcgctcctccgttgaccaccgcagcagcgtctccgattacgacgacgaaatctcaatcaccgaggacgagttccgcgtttccgagaccgagcgcgtttccatgctcgccatggaggatttgaaagccatagctgagtgcatgatttcctccggctacggcaaggagtgcgtcaaggtttacatcgtcatgagaaaatcgatcgtcgacgaagcgctgtatcatctcggagttgaaaaattgaacctctctcaggtccagaagctggattgggaggttctcgagttgaagatcaagagctggttaaaagccgttaaagtcgccgtcggaacactgttcaacggcgagaggatcctctgcgaccacgttttcgctgcggattcggggaaaagaatcgcggaatcatgtttcgcggaaatcaccaaagacggcgccgtatctcttttgggatttccggaaatggtggcgaagtgcaagaaatcgccggaaaaaatgttcaggattctggatttgtacgaagcgatctccgactactggcctcagatcgaattcatattctccttcgagtcaacggttaacattcgcacacagaccgttacgtcgatggtgaaactcggcgacgctgttagaacgatgctaacggactttgaaactgcgattcagaaagagtcatcgaagaaaccggtccctggcggtggtgttcaccctctcacgcgctacgtgatgaactacctcacgttcctcgccgattacagcggcgtgttggtcgatataattgccgatttgccgcaatctccgttgccggagtcttactaccgcagcccgatgcgcgaggaaaacccgccggcttcggagctatcggagcgaatcgcgtggatcatactcgtcgtgctctgcaagctcgacggcaaagcggaactctacaaagacgtggcgcactcgtacctgtttctcgcgaataacatgcaatacgtcgtcgtaaaggtgcgcaaatcgaacctagggtttcttctcggcgaagagtggttggcgaagcatgaattgaaagttagagagtacacgtctaagtacgagagcgtcgggtggagcgctgtcttctcgtcgttgccggaaaatcccgcggcggagttgacggcggagcaggcaagggcctgtttcgtgaggttcgacgctgcgtttcatgaagcgtgtaaaaaacaggcctcgtgggtcgtatccgacccgaaatttcgtgatgaaatcaaagactcgatagcttctaagctgatgcaaaagtacagcgtgttcttcgagaagaatcgggtcgggtcgaaatccgttagggactttctacccgatgatattgggaaatacctttctaacattttgtgtgacggagattcg

SEQ ID NO: 21770 - DNA, 453 bp, Glycine max
  Peptide Sequence Number=SeqID_113455
atgaaggcaaagcttaattatattatttactctatcaaggatgcacaagcaaacaaactatgtccagttgataacagcagatgcagccaagacattgtccaagaacagggcataatgatagagactaggattctccaaattctcacttctagggaattttctcttttcaagaggaatgaggcagtaatctatgggcagcctaataccacaaagatcttccttaatgggccaaatgaaaaatcacacaatctcccactcgcactagctgttgatgtcggtttcagtctcgacgacgagacatcgtcgcgtcgttgccatgtggtgtacgacgtgagggagaaaacacagcgtgagcactcatacttgttcatggtggttcaaaagatgaaaacagagacagggttgctagacgaacaacctccatctaacactcaactagaggacattggcagg

SEQ ID NO: 21771 - DNA, 196 bp, Glycine max
  Peptide Sequence Number=SeqID_113456
gaagcggaagagcgcccaatacgcaaaccgcctctccccgcgcgttggccgattcattaatgcagctggcacgacaggtttcccgactggaaagcgggcagtgagcgcaacgcaattaatagttagttctgatcctcggaccacgcttccgttagccctcgctttgtgcatcaagctcaaggagtgtttggcgtga

SEQ ID NO: 21772 - DNA, 786 bp, Glycine max
  Peptide Sequence Number=SeqID_113457
atggagagtgggaataatactaatcatgagttggagatggaaatggagagtggagggagtaatggtaatgagggggttgcagcgagttcgcggtggaaccctacaaaagagcaaataagcatgctagagaatttgtataagcagggaataaagactccgagtgctgaggagatacagcagataactgctaggcttagggcgtatggtcacatcgaaggaaagaatgtcttctactggtttcagaaccacaaagccagacagagacagaagcagaagcaagaaacctttgcttacttcaatcgctttcttcatacgcctcagccttttttttctccgccaatttgcccaaatgccatgtgtgccccatattacatacctcagggacagggtgaaattgggttttatcccccacaccaaaaggtatttgtacccgtaggttttaggaggagcccctctgagaaagttgtgcccacaggcatgataagtagtaatggccctctggtatacgaaggcatgcatcaaatgcaacagagaatctcggattgcagcaactctcacttcagtcaccaagaaacgttggatcttttccctctgcacccaaccggcattttggaagggaaaacaacaacaacaacagaccaggtgtcttctctggcttcagtagtttctgctgatagttccactgatacaacttctgctgatgacatcaatgaagatgatcatgcttccccactgaaccaacccttctttaatttttttactacttctggacaaggttcttattaa

SEQ ID NO: 21773 - DNA, 84 bp, Glycine max
  Peptide Sequence Number=SeqID_113458
atgacaagcttggaggatcttggaaagagtgccacgggcgccgttggatcaagcggaggtgtcgaagatataaaggttgactag

SEQ ID NO: 21774 - DNA, 417 bp, Glycine max
  Peptide Sequence Number=SeqID_113459
ggagttttctattctaattttgtgggtattgatatccaccctccgaaggcgcagtggattaagcaagtctcttggcatctcccgcgtgttggcattgttaagtgtaatatggacgaatcagccaaaggttctcttggacatgctgctgctggagttgttattattgccttggaagtggcaaagtgcagaggttggaacaatctttggattgaatgtgaatcatctttgatcattcaggcttttggcaacccgttgctggtcccttggcgcctccacgataaacttgctaagcttgacacttcgactcatgatagtacacttggtggcactctatccctagctttcttaggacagaaattccttaggaacataatttatcttccttcttataggcgtatttgggtttttggggtgtga

SEQ ID NO: 21775 - DNA, 1353 bp, Glycine max
  Peptide Sequence Number=SeqID_113460
atgggtagcccctcgaagaagaacgaaagtaaggggtttttcgccgccgtgtcttccatgttcaccagcgctgtcaaccgatcggtcaacgggcttagtgtagaagtcataaatccagagggaggtaaagaagattcggaggaggaagctcagagaggaagatggaaacaggaggaaagagatggttactggaagatgatgcagaagtatattggctcggatgtaacatcaatggtgacactaccagttattatatttgaaccaatgactatgattcagaaaattgctgagttgatggagtactcctacttgttagatcaagcagatgaatcagaggatccatacatgcagttagtttatgcaacatcatgggccatatcggtgtactttgcgtaccaacgaacctggaagccttttaatcctatccttggagagacttatgaaatggttaaccatggtggaattacatttcttgctgaacaggtgagtcatcatcccccaatgagtgctgcgcatgccgagaatgagcattttacatatgatgtgacttcaaagttgaaaactaagtttttgggaaattctgttgatgtttaccctgttggaagaactcgtgtgacccttaagagagatggtgttgtcttagatttggtgccacctcctacaaaggttaacaacctcatatttggccgaacttggattgattcacctggggaaatgataatgacaaatttgacaactggagacaaagctgtactatattttcaaccatgtggatggtttggtgctggtcgatatgaagtggatggatatatttataattcttccgaggagcctaaaatattaatgacagggaagtggaatgagtcaatgagttatcagccctgtgattcagaaggagagcctcttccaaacacagaattgaaagaggtttggcatgttgctgatgttccccagaatgacaaatttcagtatacacattttgctcataaaataaacagctttgacactgcccctaaaaagttgttggcgtcagattctcgtctacgcccagatagatatgcactcgagatgggcgatctgtcaaaatctggggcagaaaagagcagtttggaggagaggcagcgtgctgaaaagagaagccgagaggagaaagggcatagcttcacaccaagatggtttgatttaactgaagaagtgacaccaactccttggggtgatttggaaatctatcaatataatggtaaatacactgaacatcgggctgctgcagataactcgggaagcattgatgatgttgatgttaaatcaattgaatttaatccatggcagtatggtaatttggtcacggaatga

SEQ ID NO: 21776 - DNA, 1896 bp, Glycine max
  Peptide Sequence Number=SeqID_113461
atggaagacaacgacttctcagaaactgcaaagttcattagccagatcctcatggaagaaaacgttgaacttgaacagagcccattctacgactcactcactctgcaagttactgagaaatccttctacgacgctctcgccggtaacctacttctcagtccccaagctagcaacaccaatttttcagttgaaaattctcgtgagttgaacctcccttccccagattctctttctgtttctgctcttcagtttaacccccacgcactctctcaaccaccacctttggttaatgttagtgaaggagtctctgatttggactcttctattgcaagactcttagcacataatattttcaatgatgttgattctgtttcccactttaggagaggcttcgaggaagctagtagatttcttcctccagggcctaaccttgtaactgctctacattcaaacgcgcaagaaccaatcaattcttttcgagagaattcctatgggttgttgaagggtagaaagaatcttgagcgccaagagataaacactagagaagaagaaagaggagggagaagtaacaagcaatcagcattttcctttgttgatgagagtgacctgtcagatgctattgatagggtgtttcttagtgtggaaaacgtgtgtagtgaacacagttctttgcagagtggaccactgagagcggaggagcaagatcgagggaagggtctttcaaagaaacaagagaggaggaagcaggaaacagtggatttgaggaatcttctgttgatgtgttcacaatctgtgtatgccaatgacaacaggactgccaatgaattgctaaaacagattaggcaacactcttctcccgttggggatgcatcacagaggttggctcattacttcgccaatggcctcgaggcacgcttggttggggatggtacaagttcgcaaggaatgtatacttttctgagctctaagaacatcactgctgcagagtttctgaagacacaccaagattttatgtccgccagccctttcaagaagtttacatatttctttgctaataaaatgattatgaaagcagctgccaaggtagaaaccgtccatattattgattttggtatcctatatggtttccagtggccaattcttatcaagtttttgtcaaatagggagggtggacctcccaagcttagaataacggggatagagtttccccaacccggctttcgtcccacagaaaaaattgatgagactggtcgccgtctggctaactattgtaagcgttatagtgttccctttgagtacaatgccatagcatcaaagaactgggaaaccattcggattgaagccctaaaaattgagagcaacgagctagttgctgtcaactgtcaccagaggtttgagaatttactggatgactctattgaagtgaacagtcctagaaatgcagtcctgcatttgatcaggaagataaatccaaatatttttactcagtccatcactaatggatcatataatgccccgttctttgccccgcggtttagggaggctctctttcattattctgctatttatgatctgattgacactatcatacatcgtgaaaatgaaaggagattgatgattgagagagagcttttgggcagggagattatgaatgttatagcatgtgaaggttctgagaggattgagaggcctgagacctacaaacagtggcaggttaggaatatgaaggctggtttcaagcagctaccactggatgaggaattaatggccaaatttaggactgagttaagaaagtggtaccacagagattttgtctcagatgaagatagcaactggatgcttctaggttggaagggccgcattttgtttgcttccacttgttgggtgccagcatga

SEQ ID NO: 21777 - DNA, 387 bp, Glycine max
  Peptide Sequence Number=SeqID_113462
atggagctgatagagactatagcagccagtgatcacgccatccttcatggtcgagcctacacacccacaaagaagagccttattgagcttatttctcaagatgctatgttagctcaaaacaagcttctggccattagagaccctcacataaactctgaggcccataagtttggcatgtgcatggcacaagatgataaatccaaagaagtcaactacatgaaattggctgaaacatccaccggcagtgttttgaccaacacaaaaaagaatcccaagaaggagtgcaaggtaattttcactaggagggaaagtgccgagaacagaaagagaattgaggagggtgggcagacccaggattcaatggttgcaggggccaaaatcaaataa

SEQ ID NO: 21778 - DNA, 237 bp, Glycine max
  Peptide Sequence Number=SeqID_113463
atggaggactatggatttgagtactcacttgaggagcaagaggagcagtattttgatattgagaatcaacattacaattcaagaggagcaagattatggtttaagacaaatgttaaagtttgtaagatcttctttgatattggggaatatggacgaatgagtaaggaacttctcaattcttgtcaaaggaaagatggtacagatgagcaagagttaggagggcagcatttgctatag

SEQ ID NO: 21779 - DNA, 522 bp, Glycine max
  Peptide Sequence Number=SeqID_113464
atggaatctgatcttcatcatgatcatcaagctgcagcatcagaaaatcatccctctgatggagaggagcaaggtgcaagtcacgtgacatcgaggtccttcgagtgcaacttctgcaggaggggcttctctaatgcacaagctctaggaggacacatgaatattcatagaaaagacaaagccaagctcaagcaacaacaatcttcaaaccaaattcaacaggatcaggccaagtcttatggtgaagatagcaacaaacaaaaatggaattggaatgtgtctctacaagaacatgccattcacaagaggcagcagcttccactctttgccgaatcaccaactagtagtgaaacacaaaagccacaacaaggtcaaactcaaactactactgaacaggcttcgttatctactcaagattcctcatcggagttagaccttgaactgagactaggacctgaaccacaggactcgtcagcagcagaaacggatgttcatgaaccgcgcgcccctttttattggtga

SEQ ID NO: 21780 - DNA, 1500 bp, Glycine max
  Peptide Sequence Number=SeqID_113465
atggcttctctgccactaactcccttcacatgccaaaatctccacacgctaaaccctaggcctcgatgtcgcaccttcaagcttttttgtcgaccttcttcttccgccgtcgcgcacacctcgcctcctctctccggcgacctggaccgctacctccgctgctccatgccgcagaactcgccgctccgagtcgcggttcttgtcagcggaggcgtcgatagcagcgtcgctctccggctgctccacgccgctggccactcctgcaccgctttctacctcaagatatggttccaagaagatttcgagaacttttggtctgagtgcccctgggaagacgatttgaagtatgctaaagatgtttgtaatcaggttgatgtaccgttagaagttgttcatttaaccgatgaatactggaacaatgtggtttcttacctcattgaagagtatagtagtggccgaacccctaaccctgatgttctgtgcaatacaagaattaagtttggtgcattcttggatgcgattggtggcatgggttttgactatgttgcctctgggcattatgcaaatgttatccacccatgttctgatcggagggatgaaccttctgttctggaactatcacaagacatggtaaaggatcaaacatacttcctttcacacctctcacaatcccagctgaagcaacttctttttccgcttggttgtattcccaagtcaattatgatgtctatcgctagaattcaggcagatgaagtccgcaagcttgccacaaaatttgatctaccaaataaggatagaaaggattcccaaggaatatgctttttgggcaagataagattcagtgaatttgttgcaagacatattggggagagagaaggtgtcatactagaagctgagacaggagatttccttggcaaacatcgaggattttggttttatactattggtcagcgccagggtctacggctacctggaggcccatggtatgttgttgagaaggatgttaaaaacaatgtagtttttgtgtcaagaaattacttttcctttgacaaaagaaggcgtgtattccgtgttggctcttttaaatggcttagcgggttgcccccaggccagacaactcagctccaatgcaaggtgagacatggtcctggattttatgattgtagcttacaaatggaagtcgaagctgatggccaatgtcactctgctgttgtccgcatatctgaagatgatcaaggcctagcagctgggcagtttgcggcattctatgagggaagaacatgcataggttctggtgtgattttggagttctgggatgatcagagttttccagtttgtacaaaagctttagaaattgctagaatggaagataaatcaaagattgggaatccggtaaaaataaaagttaaaccagataacccgcaagaagtgtgtgattctgcagagttagcaagtaaaacatcacaagggaataagaaattaaagagttgctggcactga

SEQ ID NO: 21781 - DNA, 1311 bp, Glycine max
  Peptide Sequence Number=SeqID_113466
gataaagaaagtgcaggaagcaaaaagggaaatatagaaagcaataacccaaccgagatggtggcgacggcgatcgaggaagtgcgaaccctctggattggcgatttacagtactgggtggacgagtcctatctctctcagtgcttcgcccacaacggcgaagtggtttccattaaaatcatccgcaacaagctaacgggccagcccgagggctacggcttcgtcgagttcgtctcgcacgcctcggccgaagcctttctccgaacctacaatggagcccaaatgcccggcacggagcagaccttcaggctcaattgggcctcgttcggggactccgggcccgaccactccatcttcgtcggcgatctcgcccccgacgtcaccgattttctcctccaggaaacctttcgggcccattatccgtccgttaaaggggccaaagtcgtcaccgaccccgccactggccgctccaagggctatgggttcgttaagttcgccgatgaggcccagaggaaccgcgccatgactgaaatgaacggcgtttattgctccacgcgcccaatgcgtattagtgctgccacacctaagaagaacgcttcttttcaacaccaatatgctccacctaaagcaatgtatcaatttcctgcatacagtgctccagtgagtgctgttgcgccggagaatgatgtgaataataccactgtttgtattggtaatttggatcttaatgtgacggaggaggagcttaagcaaacctttatgcaatttggagatattgtgttggtgaaaatttatgcgggcaaaggatatggttatgttcaatttggaactagagtgtctgctgaagatgccattcagagaatgcaagggaaggtaataggtcaacaagttatccaaatttcttggggcagctccatgacagctagacagggtaaggctgcgtacaatatccctcccccataccttcgcatagcgaagagcctctgggcaatgggtttggttcacttgatgggattggagaatgttggtaaaaaggaattaggttcaggtccagttggaggtcatgaggttgtgatgatatgtggtgaccaaatggatccaagtcaatggagtgcctactatggatatggacagggttatgaagcatatgcttatggtgctactcaagatccctccatttatacttatggtgcatatgctggttatgcacaataccctcaacaggttgaaggtgctcaagacatgtcagtagtgtctatgcctatggaggaattgtatgatcccctggcaatgcctgatgtcgataagtaa

SEQ ID NO: 21782 - DNA, 60 bp, Glycine max
  Peptide Sequence Number=SeqID_113467
atggaggaagtggcatatgctggaggaggccagagagatggtggcagtggagatttttaa

SEQ ID NO: 21783 - DNA, 360 bp, Glycine max
  Peptide Sequence Number=SeqID_113468
atgcagaagtatgctttagggaatttggtgatagtgttaagcactggaggttatgcaagtggtggatccccacccaatagacgctccaagtgttttgctaactgcactgctggtgattctacttctgagccggttacacaccacctcatacttgctcatgctgcagcggtaaaagtctacagggagaagttccagaaaataagttatgaagtagaagataagaaccgtgagctgagcttgggattgctctgcctgggtactacatatgcatcatttttggaagaaagacttgaatgctttcagattctgaagtatgatattgaagctgagcgtctacccaaacctgccgaacggcagtag

SEQ ID NO: 21784 - DNA, 1995 bp, Glycine max
  Peptide Sequence Number=SeqID_113469
atgtcatctcttgttgctggtctgtctgcctgtcaggagaaaattggaaccgggtatctatctgcatttccgtctgagttttttgatcgatttgaaactgtccaacctgtttgggccccctattataccattcacaagatcttggctggcctcttggatcaacatacttttgctggaaaccctcaagctctaaaaatggtaacatggatggttgattacttctacaacagagtgcagaatgtaataacaaagtacactgtaaataggcattatgaatcactgaatgaggaaactggagggatgaatgatgtcctttacagattatacagcataacgggagattctaagcacctagtgttggctcacctttttgacaagccatgctttttagggttgcttgcaatgcaggctaatgacatagctaattttcatgccaatacacatatcccagttgttgttggatctcaaatgcggtatgaaatcacaggcgatccactgtataagcaaattgggacattctttatggacctcgtaaactcttctcacagctatgcaactggagggacatcagtcagcgagttctggagtgatccaaagagaatagcagacaacttaagaacgacagagaatgaagaatcatgcacaacttataatatgttgaaggtttcgcgccacctgtttagatggaccaaagaagtctcttatgcagactattacgagcgcgccttaaccaatggtgtgctcagcattcaaagaggaacagatcctggagtgatgatttatatgcttccactaggctttgcggtttcaaaggctagaactggacatagttggggaacacaatttgactctttctggtgttgctatggaacaggaattgaatcattctcaaagctgggggattctatctattttgaggaggaaggaaaagatcccacactttacatcattcagtacataccaagctcatttaattggaaatcaggcaaaattttgctcaatcagacagttgttccagttgcttcatcggatccttacctacgtgtgacatttacgttttctcctgttgagaatactttgtctacattgaactttcgactaccaagttggactcttctggatggcgccaaggggatattaaatggtcaaactttatccctgccaaatccaggaaagtatttgtcagtcacaaggcaatggagtggtagtgacaagctgacccttcagctgccccttaccgtaaggacagaggccataaaagatgacaggcctgaatatgcatctgttcaagcaattctttatggtccttatcttcttgctggtcatacaaccggtggtgattgggaccttaaagctggggctaacaatgcagactggattactcctattcctgccagttacaatagtcaactagtttcttttttccgagactttgaaggatcaacttttgtcttgacaaattcaaacaaatcagtttcaatgcaaaaattgcctgaatatggcactgatttgactcttcaggcaacctttaggattgtcctaaaagattcttcctcaaaattttcaacattagcagatgctaatgatagatcagtgatgttagaaccatttgattttcctggaatgaatgtgattcaccaaggagcaggcaaacctcttctcattgcagattcttctcatggcgggccatcttctgttttccttttggtaccaggattggatggacgaaatgaaactgtatctttagaatcccagagcaacaaaggctgttatgtgtacagtggtatgagccctagttcaggagtcaagctcagttgcaaatctgattctgatgctacttttaacaaagcaacaagctttgttgctctgcaaggattgagccaatacaatcctatcagttttgtggctaaaggcacgaacaggaattttcttttgcagccattactctcattcagagatgagcattacacagtttatttcaatattcaagattga

SEQ ID NO: 21785 - DNA, 6267 bp, Glycine max
  Peptide Sequence Number=SeqID_113470
atgcagaaggcaccacttgcacattccaatgagtttgccttgaaggagacctctcccaagattggtgcaggggcagtaacaagagacaagctatcatgcacctatgaccttgttgaacagatgcagtatctctatgttcgtgtggtcaaagccaaggatttaccttcaaaagatgtcactggaagtctcgatccctatgttgaagtgaagcttggaaactacaagggactcaccaagcactttgagaagaagtccaaccctgagtggaatcaggtctttgcattctccaaagaccggattcaagcctcggtgttggaggttattgtcaaggataaggatgttatttcagatgattttgtagggaggatgtggtttgatctcaatgagatcccaaaacgtgttcccccagatagtccattggctccacaatggtacagattggaagatcgaaagggcgaaaaggtgaaaggagagataatgcttgcagtttggatggggactcaagcagatgaggcatttcctgattcttggcattctgatgcagcaatggttggctctgaagcagtttcaaacataaggtcaaaagtttacctctctcccaagctttggtatgtcagggtcaatgtgattgaagcacaggacttgataccaggtgataaaacccggtttcctgaagtttatgtgaagattaatctaggaaaccagtttttaaggactagagtgtctcaaagtaagaccatgaatcccatgtggaatgaggacttgatgttggttgctgctgagccttttgaggagcctttgattctgagtgtggaagacaggcttggaccaaacaaagatgaagtattgggaaggtgtgtgatccctttgcagattgtgcaacggaggctggaccataagcctgtgaacactaggtggtttaatcttgagaagcatgtggttgttgaaggggaaaaaaaggagattaaatttgcaagcaggatacatttgaggatgtgtttggatggtggtttccatgtgttggatgaatcaactcattatagtagtgatcttaggccaactgctaagcaattatggaagcctaacattggaattctagaagtggggattataagtgcacaagggcttatgccaatgaaaacaagagatggtagaggaaccacagatgcttattgtgtggcaaaatatggacaaaagtggatccgcactaggactcttgtggatagctttactccaaagtggaatgagcagtacacttgggaagtgtttgatccatgtactgttattaccataggggtctttgacaacggtcatatacaaggaggaggagagaaaggtggtggtggatcaaaggattctaggatagggaaagtgagaattaggctatccacacttgaagctgatagagtttacacacactcatatcctcttttagcacttcacacttcaggtgtgaagaaaacaggagaactgcaattggctgtgaggttcactaactcatctttcatcaacatgttgtatttgtattcccagcctttgttgccaaagatgcactacatccatcctctatctgtgattcagctagacagtctgaggcatcaggcgatgcagattgtatcaatgaggttgagtagagctgagccacccctaagcaaagaggttgtagaatacatgcttgatgtggattcacacatgtggagtatgagaaggagcaaggctaatttcttcaggataatgaaagttctaagtggtttggtagcatttggaaggtggtttgatcagatatgcaattggaaaaaccccatcaccaccatactaattcatgtccttttcataatattggttctctaccctgagctaatactccccacaatcttcttgtacctgttcttgattggaatttggaacttcagatggaggcctagacaccctccacacatggacactagactgtctcatgctgatgctgctcatcctgatgaactggatgaagagttcgacacattcccaacttcgcggtcatcggatatcgttaggatgagatacgatcgtttgagaagcattgcagggagagtccaaagtgttgtaggtgacttaggtacacaaggagaaaggttccaaagtctgctaagttggagagatccaagggctaccacactcttcgtcacattctgtttcgttgctgctatagttctctatgttactccttttcaggttgtgtcacttctcattggcttctttatgctaaggcaccccagattccgccacaaacttccatcagttcctctcaatttctttaggaggttgcctgctagatcagacagcatgttgcttggttataagaatatcacagttttggagaaacatcacacggttagtggcatgtgtgaatcagtagaaattgaaggaaaagtttatgatctagatgggcaagttcttgcagcaaccagtacaccaatcatttttcgcttggcaagagagacaggctctgcactagaagaattggactcccacaagcttgctgttattgacccttcctctggagaatatcaagatactaaagttgctgatgattatgtatctattgtgtcacttacattggaaatccaagaaaaggtgaagaattgcgatcggattggggtccatgctgttagtgacattgcttcagacttaactccagaatatcttgagcatcatggactcaaatctgttcctaaatctgtagcttacgatggatatactagtctttggcagaagattgctgaattgcttcctttaaaacttcactgcagcactgaagtattggcaaacaggcggaactctgatggtgtcaccgttaatatcaagagcttaaatcaatttgaaactttggaatttgataagatcataatctctgagtgtgaaacagaagtaatggatgcaagtgaccttgaaaaggatttgttcagcaaagtagagacaaatgactactacaccactgttttaaagattaaagggctagaacatttgcctgttggattttattattttagtgaatatatgaaagatcctagcacaattggacatccagttgcaatgcagagattttatgctgacactaatatattcttattatggtcctatggaaactctgttgatattaagggaccaacagtcatggagctagcaatcaagacaatagaagccattggaggagagaatttgtttcccttgcaagctgagtgccagaaaaagaatcctagagaattaggtgaattgccagaagtgcaatttcctgatttgcctactttgaatagctactttaagcactggggaactcatctaatcactcaaaacaggaatctttatacttggattaatgaagaagggactccagtatgccaaaggacctatggagaactatattttaactcttcttgcattgctcataatctcctaacaagccaaaagccagttatcaagccagctgacaaggttctcatggtctatgcccctggtttggattttattgatgcgttcattggatgcctaagagctaaagtcataccagtccccattcttcctccagatcccatgcaaagaaatggacaggctctaattcaaattgaaaatattgccaagtcatgtaacattgtggcaattttatcaactgtagcttatcactcagcagtccgtgcaggttcaactagtgatgctaaaggagtgatgatcgctcatggtgggctaattcacaatgtaaagttcatgcgaacaagatacaagagcacctcaaggacaatcctagtaagctggctccctcagtatcatgacatggggcttattgggggactttttacatctcttgttagtggtggatctgcagttttattttcaccaatgacatttatcaagaaaccactcttatggcttgaaactattagcaaatatcaagcaactcatagcgctagacccaactttgcctttgagttactgattcgaagattggagtctgacaaggataagcttcggaatttagacctttcatccttgacttttcttatggttgctgctgaaccagtgagacaaaagaccctgaaaagatttattgagctaacaagtccttttggcttatctgaaaaagtgatggctcctggatatggcttagcagaagattgtgtgtttgtcagctgtgcatttggagaacgcaagccaatcattgttgattggcagagaagaatttgttgtggatatgttaatcacgaggatgcggatgttgaaattagaatagttgatccagagacttgtgaagagcttcaggaagatggaaaggagggagaaatatggattagtaatccaagtgcaggcataggatactggggaagggaagaattgagtcaaaaaactttcaggaatgaacttcataatcatcctagacgtagctacgcgagaactagagacttggggcgaataatagatcagaagctattcatcactggaaagatcaaggatctaatcatcgttgctggaagaaatatttactcagcagatgttgaaaagatagttgagacttcatctgaatttcttcgtcctggttgctgtgctatcattggagtccctgaggaaattttatcagcaaagggaatttccattccagatggctctgatcagcctagaaccatcagcaaaacaacatcaggaaaaatcaagggatttgaatgtgtcaaacagttcacagatgaaacactgaacttggtaccacaaggttcaaaaactattttgacaaagaagtctttgttaaggtcattcactacaagaacatggggagaagaaaaaacaccagggccacagcaagtaagaggtagtatacttgctcctagaaaaaggatcaataagaatgaaattgtagagctcttgaaagggcttatttctgagcagactggaatcccagtcaacgacatctcaatcacagacaacctgacatcctatggaattgactcaattggtgtggttaaagcaactcaaaaactctcagatttcttaggcactccagttgcagctatagatgttttcactgcatcctgtattctagaattggctaacttctctaaggatcttctatcaaagtctcagccttctctttcaagcaatccatccaatgcccaaggaatttcttctacggttctggccgtacacctcaggggaacagtttttctgaattactggtttgagattctgggtgcaaggattggatcctcagttttactcgatactgttgacatcactgacccatctttggtgtcaattggagatgaagttgtcattgctgaaggtgttttggttcaaatccacgaggtaaagaatggaattttaagtttccatcctattaggattgggaaatgttcttccattggaccttatgttgttatccaaaaaggaagtgttattgaagaaggtgctgagaatgaaaactacctattatcagcaaaactcaatgtgatatcatccaccactttatgggaatctatcttgttggctttctcagctcccttgctgcagtcattgcctacttattatatatttggttctccaagcaacctccatcaccccagcacttcacctttgtttgcatatatggtgccttccattggataccgtttacaatcattgcatatgctaccctgttttctgaagtctcgtcaaatcccatcacctttgccatttcatttaccagcgcctacttgcttcatgcttctctcaggaacagaagccttctgcatatatctatgccttttaggtgcgaaaattggtgaacattgttccattagagccatcaacccagtttcaaatccagagttaatgtcaattggtgctggtgtccatcttggagattttagccgtgtaattacaggttttcattcttcaagtggatatgttggaggaaaaattgaggttcaggacaatttggttagcgggagtcaaagtctaatcctccctggttctctagtccaaaagaatgtcattcttggtgcactttctgttgctccaatgaattctacattccgagagggtggtgtctacattggctcacagtcccaagttgtcataaggaactccgtgaagaattcttatgatgaagggaaagaagagacagacatggtaagcaagataagagttggtaatttggctgcagcattgcacaaaaatgagtcacacaaagtgaccttgaccagaacatggtatcagacattcttcactcagccactgctacaaacagttcaagatttttaa

SEQ ID NO: 21786 - DNA, 285 bp, Glycine max
  Peptide Sequence Number=SeqID_113471
atggcctctggtgaagttgttggcagcatcttccttgtcgaagatgagttattcagggtggaagagttgatggtaggtgccgcaatggacttcgtcgatgattgtgggttcgagatcgacgaagatggcacaatggatgataagtgttatgaatatgtaaataggtctcgctctgtgcgaaagaagctgcttagtgctaggaagcttcattggaagacagttgtcatgggcaagtgcgctaagcacgcaaactcgcggcttagcatggatccacttgcaatctag

SEQ ID NO: 21787 - DNA, 1200 bp, Glycine max
  Peptide Sequence Number=SeqID_113472
atggagaaatacttggtttcgcataaacccccaattgaaaaagttcagcctcatcgtcgtagttggaggtgccaatggaagaggggctcggttgaactaaatgggagatttgagcgtaattatcgtcatgagatgctggatctgctaattcgatcgtattctgagacgaatcgattgattggtgaggcaaatggtgatggccatcttccatttagaaagcaaggcatctctgcagtagattttgacaacaagggaatatacttggtgtctgtgacaaaatcaggttgcttaacagttcacgacttcgaagctctttattgccagatacctgaattaacttgcttgaaagaagatgaaagcaagcatttaatgcatctctcactaaatcaacaacttgatgctgtcagatggaatcctcttaatcaggatgaggttgtttgtgcatctgtaaaaagtaacaaactactcatattcgacgttggatatgtctcatcagatccagttgaagtgttaagaacaagacaaacaaccacggttaatggatccagcatacacaaaggtctctctgatgtagcttttacaaaaaatgacacaaggatacttgcttctgatacacatggtgcaattaatgtctgggacagaagagtgaatactctaccttgccttgagcttgcatctgcttcatgtggtacgcttaacagcatccaattaaatgcagataatcagattatttttggtgctgggaaacacgggcttgtgtatgtatgggatattcgtggtggaagagcatctgctacttttcaaagtctcaaagagatatgccatccacctgtaacatcagtgaagttggcaacattgctagagaagattggatctttgaagtttggtgttctagtaagagtagttttcacttcaggcttctctccagactatacagtttgcaataagatgtctggatttcaccatctggcacaggcaaatattgttcccaaggagattcactctattgatattgatccatcatgcccatatcagttagctttccatcttgtggatggctggtcaggcgttttggatactaataattttcaagttacgcatattcattgcccacccccagcttggttaaacgattcctacattcccgctgatctatcatatttaagaaaaccttcatggctatcgacgggttcggcttaa

SEQ ID NO: 21788 - DNA, 438 bp, Glycine max
  Peptide Sequence Number=SeqID_113473
atggagggtttgtgctctgtggagaagtatgaggaagctaagaagcttatgtttgatatggcgtatcatgggtctaaagctcagccggtgaattttggtgttttgatgaacgatcttgggaagagaggaaaggaaggtaaggcaatggaagcttacaaagtcttacttgagatgcagattgggggatgtgtgccaaatgcagcaacatacaggatggtggttgatggtttgtgccagattggggattttgaggggaacaagctgatttcgaggatcagttacctccagaaaatgcagagaaaagagggaaataagaggatttgggctcctaattcttcttccagcaataccctcaagtcgtgtaatcttccaggtaacttggctttttcacccttctcttactattggtctcttcttctccctgcacccttgccatag

SEQ ID NO: 21789 - DNA, 564 bp, Glycine max
  Peptide Sequence Number=SeqID_113474
atggttacctaccacaacgccactttcgcgtttgcgccttacgacacttactggaagttcatgaaaaaactaagcaccactgaactcttgggaaacaaaaccctagcacagttcctacctattaggacaagggaagttcatgacttcattcaaattttgttccataaatcaaagacccaggagagagtgaacctcactgaagctcttttgagtctttccaccaatgtgatatcgcagatgatgttgagcattaagagctccgaaacagacagccaggcagaacaggcacgggctttggttcgtgaagtgacgcagattttcggggagtataacatttcagatttcttaggtttctgcaagaacttggacttgcagggtttcaagaagagggcattggacatacataagaggtacgatgcgttgttagagaagatcatctctgataaaagaatgcgaggtcgagttaactcggaaccacgtcaaatcattgatcttgggtgtcctggaatgcctttgaccatgcgtgaattgccaactatcattggagctctcacagtgctttga

SEQ ID NO: 21790 - DNA, 1032 bp, Glycine max
  Peptide Sequence Number=SeqID_113475
atgcctcctaaggggtctagctccttcggcagaggaggaagatcccgtactaaaggaaaagatgttctattggctctaccagaaccaataaccaagaagggaactgcgtcatcttctgggtcacctacccagactgggtcatcaacccagaaaggaaagcttgaagggtcattgacccatataactaccattaaacctgagtcatcaactcaggaatccccaaaaccaacaacaacaaaacagaccgtggctgactatgcctggtcaatacaaactctcctggccttagaagacataggcctcaccagagtaccaaaattggccaaaaaaacctgggcagaaatggcctcagaatcagacgatgattctgaaacagacctgcaaaaacaaattcaaaaagccaaacagaccaaaactatctgtaaccaaaaaccaagccaaccattgactccacaagaatcaacaccacaacctagcaacagctatatttcaaaaaaaaaaattcttcaatgtcttacaaatggagccagaatactgggacaagaatcctttcaaggcaaccgccaaaatacaaactccgtatctattaaacatttcaaggaccccaaagatccaaatctaaacacccactccacaatccagatcctaaaagtaatgcagccacgacattacggctcaaacttaaaccaacccaaaaaaatttctgcaccttttgaccctgcaggatataattattgggactacattgacgcctggaccaatagacatgcctttgtaaaatggtggtcacaatttgatacctcaaaggctgctccagaaaaagtcaagaactggtttcagaggaaccctgagtttctcaaacctgctgatccagagacatctttgtttctgaatcagaagtctcaacttgaagaaaaagaagaaccccccaagaaggaagctgaatcatccgaaaataatgatgaccaagaagatgatccattctaccagaatgaggatgactgttttggtatatcgttagacgatgattag

SEQ ID NO: 21791 - DNA, 311 bp, Glycine max
  Peptide Sequence Number=SeqID_113476
ttgaaaggaaagatattgagctggtagacgaggaagaaccacggattggtgctgattgttctagtgtaacctctaataaatctgagatttataaggaggaagcagggaatgcagcacagaagcataaaccaaagagggtagagagtgtcaatactgatgcagaagcctttggtgatcactggaaagttcagattgcagattcaactgtgctgaagataggagattcggctaaagttgtgataaaacaagacatgaagggaggagaacataaatatgggtttaacaacaataaacgtgagaagccagagaag

SEQ ID NO: 21792 - DNA, 195 bp, Glycine max
  Peptide Sequence Number=SeqID_113477
atgtctcgctcaagcaaggctatcagtgatgaggcaatgtttggttatgtctctcctcacttaagcaccgggtaccgagctcgaattcgtaatcatgtcgggaaacctgtcgtgccagctgcattaatgaatcggccaacgcgcggggagaggcggtttgcgtattgggcgctcttccgcttcctcgctcactga

SEQ ID NO: 21793 - DNA, 153 bp, Glycine max
  Peptide Sequence Number=SeqID_113478
atgtgggatcagcacaggcttaaaagagcactcaaaccggatgtatttacccccaaggcctacactccgaagagtcctttggggcctctccctcctgatttagacactgctcatgaattatacaatacccacgacctcacactcgtattttaa

SEQ ID NO: 21794 - DNA, 252 bp, Glycine max
  Peptide Sequence Number=SeqID_113479
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggccctgttttggcagcagcaaaactattatggtgttgatttaacacccctacatgggactgcatttcaaggatacttttctcaggggaggatccctccttga

SEQ ID NO: 21795 - DNA, 246 bp, Glycine max
  Peptide Sequence Number=SeqID_113480
atggttaatatgtttttggcgccgttgccagggacttttttcttcttacttggttgccatacatattcaatttctagaaatgcaaccgaagatttagctctactaaatccagagattgaagccacttgcaggcgtaacaacgccgcagaagaagaagagagcaagaaatacaagggagcaatcaaccctcacctccaccctctcacaagttactatcaatggaagaggagcatgcatgatgagtga

SEQ ID NO: 21796 - DNA, 252 bp, Glycine max
  Peptide Sequence Number=SeqID_113481
atgagggttcactgtaatcaagcaagtcggagacctagcataatcacagattcacctttactccttatcttcccacgaacccggtccccagtggagtcaccaactgtcgcaacctacccttcggcgggagagcgatgcgtgactcgcgggtgcatcttccaagaaaggaatacgcgcggagtcgccaccaacgtttatttgaggaaaacgtcggaaaagccagaaaagacgtggtctacgaactttaagtga

SEQ ID NO: 21797 - DNA, 622 bp, Glycine max
  Peptide Sequence Number=SeqID_113482
atgcctaatgttcccaaaattgatgcacttattgttggcgattttcatccaggctcaaaaagagatattattgttgaaactcaaaatggagaattacaaataatccatgaactgcaccctggctatctaccactacagtatcctctactctttccttatggagaagatggatatagagctgacatacttcaccgttctacttcatccagcaaaaaaagaaagagaaattgtctgacaatgagagagtggtttgcttatagacttcagtccaggtcaaatgaagcacatactttattgcattctcgaaaattatttcaacaattcattgttgaaggttataccatggttgaatctgaaagacttagctacatcagaaacaaccaaaagaaacttagagttgacaagtattgtagcttacaaaattcattggatattggaacagctaaaggcttaaccaaagggaaaagagtcatcttaccttcaacgtttgttggcggtccacgttatatagatcaactttactttgatgacaaaccagacattgtatcacgaattttcaaattgaaatatgaacaaatgctctcagacttaacaaagggtcattactcggaaagtagtgcat

SEQ ID NO: 21798 - DNA, 417 bp, Glycine max
  Peptide Sequence Number=SeqID_113483
atgggttctccacctgcctccactacttttcctcctcctcctcctcctccttctcctcctcgtcctccccctactttggatgcatcggcttcaacgtctgccgtgaagcggacacgcaaagcctcacgtctacgatcattgtccactagaccacctggtgttgagagaccagtggtgcatgttgatcttgctaccgggaaggccgacagtccccataaaaagaaattaagaacatatttggggattgtggcacatgataaggtggacatcacctacgagaattggaaggaggtccctactgctcagaaggacctgatttgggaggatattcaggcggaatttgataacccagaggcttctgacagtaggacgaaaaggaagtactatagaccgtggggagagatggaggcagtttaa

SEQ ID NO: 21799 - DNA, 552 bp, Glycine max
  Peptide Sequence Number=SeqID_113484
atggaggccataaaagagcaaatggccacaatgatgaaggccatgatgagcatgaagaagataatggaagccaatgcggttatagttgccgctgttagcgctgtcgctaaggtgaacccgatgctcccatctagcctcaagcaaatgaatcatccaacctcaaatatggcacatatctctcaaaccatgggggagacacatgaaattccccaccacaatctagctgacttcgagccttggctcggatatgccactgaagggcaagcagttggtggtataccctttgaaaacactttggagggccctcagtttcgcccacaaccacaaccattgcattttgcggtgggaagagcccctcctgctatggccgaaaagggaaaggcggatcatctagaggaaaggctcagggccattgaaggaggtgaagattgttcctttgctaatctagaagagttgttcctagtacccaatatcatcacccctcccaagttcaaggtgctggactttgacaagtacaaggggactacttgtcccaagaaccatccaccccac

SEQ ID NO: 21800 - DNA, 285 bp, Glycine max
  Peptide Sequence Number=SeqID_113485
atggaggggacacatgaaataccccaccataatctagccaacttcaagccttgcctcgaatatgccactgacgggcaagtagttggtggtgtacccctaccagaaactttggagggcactcagtttcgcccacaaccacaacccttgcattttatgatgggaagagcctctcctactatggctgaaatgggaaagttggatcagatagaggaaatactaagggttgttgaaggaggcgaagattatacccttgctgacatggaagatttgtggcctagtacctga

SEQ ID NO: 21801 - DNA, 246 bp, Glycine max
  Peptide Sequence Number=SeqID_113486
atggaacacagctccaaactcgaaaatggaggacacatgaatgacaacgcaattcactcacgtggctccggaaaaggacgagaatggaggattgccttgaggacgagaatggaggattgccttgaggttcctctcttaggcaatcatggaacacagctccaactcaaaagtggaggacacatgaccagcctaagcaataacattcatgtggcttcggaaaaagacgagaatggaggattgccttga

SEQ ID NO: 21802 - DNA, 334 bp, Glycine max
  Peptide Sequence Number=SeqID_113487
atggagaggagtatgattgatgcttccagtggtggagctcttgctgatatgactcctgtagaggctaggaatttgattgagaagatggcttccaactcccaacaatttagtgcaagaaatgatgtcattgtccttagaggagtccatgaggtggccacagactcatcttcatctgctgaaaataaaaagcttgagggaaaacttgatgccttgcaatctagagtcaatgagcaacctgaagcttatgctgcaaacatttataatagaccccctcagcagcaaaaccaacaacaacaaaataattatgatctttcaagcaacagatacaatccag

SEQ ID NO: 21803 - DNA, 372 bp, Glycine max
  Peptide Sequence Number=SeqID_113488
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtcgactctagaggatccccatcaaccctccatctcccattgctcgacatttgaagtgaaagttggcctggacaaagtgatatgggcagatgacctctaa

SEQ ID NO: 21804 - DNA, 369 bp, Glycine max
  misc_feature (340)..(340): n is a, c, g, or t
  Peptide Sequence Number=SeqID_113489
atgattatgaggggccaggacatttatagtagccaagatgaggctactacttcaccttcctttagtgaaagtgaagaaggaaaaggggaagaatctagtgaagaaatctacccccaagaagaaggacaacctttaatggttaaggaggagtgtaaggagataagtgtatcctccaagaggttagctaagaaggaaagtcattttgacataaagacaaatacacttgctagcattgcgacacctcttgggcttgaggttattcctcaagtaaagaagttgctggatgagggtttggttcataagagcttaaatccttatgctttgctggtgcccaaaatangtattattaggcaccaaatccctaaataa

SEQ ID NO: 21805 - DNA, 330 bp, Glycine max
  Peptide Sequence Number=SeqID_113490
atgacgactctcatctctactccttctttttttctgcacaacacaaaacaaaatacaaacaacaacaagaacaacgaatataatatacatatacacatatacacatgtttggcgaaggaaccgatccggaaaataacagaaaaacatatttcccagtcaccagaggctccgcgcttgataacggaggacacaggaacagcacaaggcaatgaattcatgggtctccgaataaaaagtggagaatggagaattggcgaacagcgctacgcaataacttcgcggggctccagactcgaaggtggaggacacatgaacagcgctaggcaatga

SEQ ID NO: 21806 - DNA, 354 bp, Glycine max
  Peptide Sequence Number=SeqID_113491
atgatattgcacgagattagaaggcctaactctctaaaaatagtccccagtggagtcgccaactgtcgcaacctacccttccgcaggagggcgatgcgagactcacgggtgcgtcttccaagaaaggaaaatgtacggagtcgccaccaacgtttatttgagaaaaacgtcggaaaaaaccggaaaggaggtggtcttcgaaatttaagtgaaaggttcgggagttgtatttacgcacggggaagaccgaagaacgacgaagaacgaatgaagaacgatgaagaacggtggaaaaccttcgcgaaatcgcccacggaaacgtctcgaaagcgttacggaagtgcctcggcttag

SEQ ID NO: 21807 - DNA, 432 bp, Glycine max
  Peptide Sequence Number=SeqID_113492
atggagaaaaatgaagaaacaacaatggaagagaaggtaaagcaaaaaattaatggagcttcaatgaggtccttcaatggtgatttttcaccatggagatgcagcggaaggcaaaggagaagaggagaggggaggcaccatccattagggaataagctgtggaagaaggagcttcaccaccaagagtgtgccttggataagaagcttgaagaggatgctttaatgaaggaaaagaaagagagaaggggggagaacggaattgaaggaataaaagagggagagaagtggaactttgaagtgtgtctcataagactttcactcatcgaagttacagcaaaaatctaccctggggttcatgataaccccaaggccttctttagcaactctagcccaaacctcttggagtcttccatccaatacccttgggggtag

SEQ ID NO: 21808 - DNA, 321 bp, Glycine max
  Peptide Sequence Number=SeqID_113493
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccgaactgtgaagacactacacctgttgtggcttgtgggtaa

SEQ ID NO: 21809 - DNA, 231 bp, Glycine max
  Peptide Sequence Number=SeqID_113494
atggcctcatcaaactttttatttcctgaaggaaactctataaataggcctcgtatattcaatggtgtgggttatcattattggaaaaccggtatgcaaattttcatagaggctatagatttaaacatctgggaaaccattgaaatcggtccttacatccctactatggtagcaggaaatacaactatggaaaaacctaggaaacaatgggatgaagaagaaaggaaaatg

SEQ ID NO: 21810 - DNA, 837 bp, Glycine max
  Peptide Sequence Number=SeqID_113495
atgatcgaccctctcgatgagtcaatcacttgctttctcataagggtggacccttgggtactagtacttatcaccctaagaggactgcacgtcctcgccttaagagggctacatgtcctcgccataagggggatacaagtcctagccttaagagggctgcacgtcctcgccttcagagggctacacgtcctcgactttagagggctacacgtcctcaccttaagagggctgcacgccctcgccatcagagggctacacgccctcaccttcagaggcttgcacgcccatcgccttcagagggctgcacacccttgccttcagagggctacatgtcctcaccttcagagggctacacgtcctcgccttcagaggactccacgtcctcgccttcagaggactgcacgtcctcgccttcagagagggatacacgtcctcgcctttagaggactgaacatcctcaccttcagaggactacacatcctcgcctttagaggactgcacgtcctcgccttcataggtctgcacgccctcgccgtcagaaggctacatgtcctcaccttcaaagggatacacgtactcgccttcagaggactgcatgtcctcaccttcagagggctacacgccctcgccttcagagagctacacgccttcacctttagagggctacacgtccttgccttcagaggactacataaggctacatgccctcgccttcatagggctatacgccctcgccttcagaggactacacgtcctcgcattcagagggctgcacatcctcgccttcagatggctccacgccctcgccttcatagggctacatgcctttgcctttag

SEQ ID NO: 21811 - DNA, 323 bp, Glycine max
  Peptide Sequence Number=SeqID_113496
tgattgcgtctgattcatcagaaagtgaaaattctgaatccacacaagtttcagatgctactgcacatgctcttaaattaatattcaaaattcttatcatcatattgtactgtgatattaaacaatttcaggatattctgatcttggtgatcaactcatccaatgtagatattgtaatgcacaaatgtggtatgatgaaagaatatcaaaagataaaaattttcagaatccaaggttcagcttatgctgtggagatggcaaagttgaattaccgccattattacaaaatcacctcaacatctgcaatgacttctgtttcatga

SEQ ID NO: 21812 - DNA, 1025 bp, Glycine max
  Peptide Sequence Number=SeqID_113497
atggcgccgccgccggctaagctactgaaaaaaatacgtcaggccgacgccttaatcgtcgaagcggacatcaccggtaatgaaacgcctttcagtaatctcccctcttatcccccgctggctgaacgtctgagcgaaacgcaattagcagaattacgctcacgcgccggcgaactgggtttgtcggtcgatcttttcgatagccagccgctatggcaggtggcgatggtgctacaagccactcaggcgcaaaagctggggttacgacccgattacggcattgattatcagttgctgatggctgcccgcgagagcaacataagggtgatggagctggaaggcgccgatagccaaatcgcgctcctgcgcaatctaccagacggtggtaaggcgctgctggaagatacgctgacccactggcgcaccaacgcccgtttactgcagttgatgatcggctggtggctcgagcaaccgccgtcgcgcggcgcggaaacgctgccgacgaccttcagccagtctttatatgatgtactgatgcatcagcgcaatatagcctggcgcgacacgctgcttgctctgccacctgggcgttacgtcgtcgccgtcggcgcgctgcatctgtatggcgaagggaacctgccggatatgttgacgattactatgactcccgccgttaaattactcgaaaaaaacaaaatcacctttcagatccacagctacgaacacgatcctcaagagactaattttggcgatgaagtggttcgcaagctggggcttaatgcggatcaggtttacaagacgctattagtggccgttaacggcgatatgaaacatctggcggtcgccgtcaccccggttgccggacagttggatttgaagaaagtggccaaagcgctgggcgccaagaaggtagatatggccgacccaatggtcgcacagcggatcaccggatatctggtcggcggcatcagcccgctggggcagaaaaagcgcctgccgacggtgattgatgccccggcgcagga

SEQ ID NO: 21813 - DNA, 825 bp, Glycine max
  Peptide Sequence Number=SeqID_113498
atgggtcaacttcaacggcaagccttccgcaaagcctatggtaagatttgggacctagctagggtagaagtctccatggaaccgattgcatccctttcccagtattatgaccagcccctaaggtgcttcacatttgaggacttccagctagtgccgactgtgaaagagtttgaagaaatcctgggatgcccactaggaggaaggaagccatatcttttctctgggttctatccctccacgacaagagttgccaagtcggagtaccaaggaagtgtttggaggaaagggcaaaggccttggcaaatcaaggcgaatgggctttcttttattgacatcttggtgcttttgatctttggagttgtcctctttccgaatatggaagggttagtggacctagcagcgattgacgctttcctcgcctttcatcatggcaaggaaagcccggtcgtcgccattttggccatgtatgacacgtttcaactgggggatgtgaaaagagcggcgcaagaattgtttgttgtgcaccaactcttggctagcatggagggaacgaaagcatcacgcctttcattgcacggggtttcagtgaccacaatgcgagggtactccaaggagttcgcaaggcatgggatgcggcgtgaagaaaggacagagagcttaggggaagcagtacaagccctaaaggcagagcttgaaagagcccgggtggtcgaagagaagttcaagtccatagccatcaaactgaagccttggaacgaagaggtgaaaggaatcatcacgggtcaaaggcatgatcttgaaggacgagctaacggcttgccttag

SEQ ID NO: 21814 - DNA, 312 bp, Glycine max
  Peptide Sequence Number=SeqID_113499
atgtcgcaaaggaaggacaaggaacttaaggggagtagcaacgggcccatcggcggttaccataggtggttgaaagcctatgcacaagatctggattggctcccgagtttgaggaccactaaagggatggaggttgaaactccagaagaagatgaagaggtccaagaggagtttgtcttagcggttatgcgagaccgaaacaaacatgttagccatcatcggcaagtaccaagaagaattaaatctagccacgacccacgagcacaaagtggcggacgaatacgcccgagtgtacgcggaaaaggagactag

SEQ ID NO: 21815 - DNA, 294 bp, Glycine max
  Peptide Sequence Number=SeqID_113500
atgactttgtctttaaagtatcttccatgtgagttaatgataaaattctacaaggagaagaccaagaagttccatgacagcttgatagctaagaaggacttcgtggttggaccaaaagttctattgtataactctaggctcggactcatgagtgttgagatcaaaagtgaatccacagataagagcttcaaggtcaatggacactggttgaaaccattcctcacaaatccctccttggtggatgtagtggtggaggagacctccttacttcaccctacttctcttcccccatga

SEQ ID NO: 21816 - DNA, 1153 bp, Glycine max
  Peptide Sequence Number=SeqID_113501
atgctggaaaaagtgttgccggcggtcgttagcgtacaggttgaaggcacggccgtacaaagccaacgcgtccctgaagaactgaaaaaatattttggcgatgaggctcccgaccagcaggctcagccttttgaaggcctgggttcaggcgtcattattgatgcagccaagggctatattctgactaacaaccatgtcatcagccaggctgataaaatcagcgttctgcttaatgatgggcgcgagtttgatgccaaactgattggcggcgatgaccagagcgacatcgcgctgttgcaggtgcaaaaccccagcaacctgacccagattgccatcgcggattccgacaaactgcgcgtcggtgattttgccgtcgccgtgggcaacccctttggtttagggcagaccgcgacgtccgggatcgtctcggcgctgggccgcagcggcctgaatctggaagggctggaaaactttatccagaccgatgcctcaatcaaccgcgggaactccggcggggcattgctcaaccttaacggcgagctgattgggatcaacaccgccattctggcgccgggcggcggcagcatcggtatcggcttcgccatcccgagcaacatggcgaagaccctcgccgatcagcttattcaatacggcgaaatcaaacgcggcctgctgggcattaaaggcatggaaatgagcgcggatatcgccaaagcgatgaatatcaacgctcagcgtggcgcctttgtaagcgaagtcctggccaattcaggctccgcaaaagctgggattaaatccggtgatgttatcgtcagcatgaacggcaagccgctaagcagcttcgccgagctgcgctcgcgtatcgccactactgcccctggcacaaaagtaaaactggggctactgcgcgacggcaaaccgttggacgtcgaggtcacgttggataagagcacctcctccaccgccagcgccgagctgattatcccggccctgcagggagcggcgctaagcgatggtcagttaaaagacggcactaagggcgtgagcatcgataacgtcgataaaggcagcgcggcggctcaggttggcctgcataaagacgatctcattatcggcctcaaccgccagcgtgtgcgttccatcgccgagctac

SEQ ID NO: 21817 - DNA, 225 bp, Glycine max
  Peptide Sequence Number=SeqID_113502
gcatacttagcaaggcctaagtggagaaggaaaaaagcccaaatggagaaggacgaaggccgaagtggaaaaggacgaagccccaagtggagaaggatgaaggcccaagtggagagggacgaaggcccaagtggagaaggacgaaagacccaagtggagaaggatgaaggcccaaaagcgaaggcactactaagcatattaatcgttgctgaagcccaagattaa

SEQ ID NO: 21818 - DNA, 393 bp, Glycine max
  Peptide Sequence Number=SeqID_113503
atgtcatctattgtttgcagggatcgtgcccataagtcgcccagtgggcccaaagaagtccaacaggaccctggggtttccagctctagttacgggcctctgtcagtcctacagggtgcccgttcccccagcgaggtcatgccatcacaacataggaattgcacccacaaagacacccagtggacccggagaagtccaacagggccctggggtttccagctctggttacgggcctctatagtcctacagggtgcccgttccccccggcaaggtcatgtcaacatagggtgcccgttccccccggcaaggtcacgtcatcatagggatcgcgcctgcaaaacacccagtggacccgaagaagtccaagagggtcttggagttgtcaagctctaa

SEQ ID NO: 21819 - DNA, 735 bp, Glycine max
  Peptide Sequence Number=SeqID_113504
atggacctcatcaaggctgctggactactgaagacagtcaccaagttgggagattgctatgaaagtctagtcagggaattcattgtcaacattccctctgacataacaaacagaaaaagtgatgattatcagaaagtgtttgtcagaggaaagtgtgttagattctcccctgctgtgatcaacaaatacctgggcagacctactgaaggagtggtggatattgatgtttctgagcatcagattgccaaggaaatcactgccaaacaagtccagcattggccaaagaaagggaagctttctgcagggaagctaagtgtgaagtatgcaatcctgcataggattggcgctgcaaactgggtacccaccaaccatacttccactgttgctacagagagaatcggctctgtcctgcattacaaactgtttgaggggacacatgtcccagacattgtctcgacatccgggaaagctgctgcttcaggtgctgtgtccaaggatgctttgattgctgaactcaaggacacatgcaagatgctggaagcaaccatcaaagccaccacagagaagaaaatggagttggaacgcctgatcaaaagactctcagacagtggcattgatgatggtgaagcagctgaggcagaagaagaagcagctgaggaagaagaagaagccgctgaggaagatgcagcagaggatacagaatccgatgatgatgattctgaagccaccccatga

SEQ ID NO: 21820 - DNA, 300 bp, Glycine max
  Peptide Sequence Number=SeqID_113505
atgacaaaacctaggcttcaatgcacaagctgctcctcttttatgcttctagggctcttttccccaaataggcctgtggctgatctggaattctatgccctagtcatctatagaagctgtcataaaggtggtaaaagttgttaccctaattctgcacaagacaggcttcaaataggctctgaaatcacgacgctgcgcttagcgccacccttgcgcttagcgcgagtaagggaatttgggcttagcgccagtctcgagcttagcctggctgaaggcacctgctgcgcttatgttaattag

SEQ ID NO: 21821 - DNA, 299 bp, Glycine max
  Peptide Sequence Number=SeqID_113506
atgggaacaaatcaaaccggcaagaggttctaccaagtcaaggttaaaagcctagataccaccagcatcaaggaattagggcggttgatggaacctctccaaatgcaagccttccacaagacttacggaaagatcttagagttgaccatagcggaggtatccatagaagccattgcatcactcacccaatactatgaccagcctttgagatgcttcaccgagaggtttggaccgcatgaaacagactcgaaacggcatagcgggcctaccacggaggtacctagaagacaaggcaaggg

SEQ ID NO: 21822 - DNA, 624 bp, Glycine max
  Peptide Sequence Number=SeqID_113507
atggaagcaaagatttcggtgccgcagtatgagctgcgcggtttcagcctgtggggctttcgcgatatggcgcactgcatggactttttgttcgacggcggccgggtaaaacagggcacgctggtggccatgaacgcggaaaagatcctgaaggcggaagaggaccaggcgctgcatgcgttgctggatgaggcggagtacaagtacgcagacggcatcagcatggtgcgctcgattcgccgcaaatacccggcggcggacgtttcgcgcgttgcgggcgccgatctgtgggaagccttgatgcaacgcgccggccgtgaaggcacgccggtcttcctggtcggcggcaagccggaggttttggcggaaaccgagcaaaagctgcgcagccagtggaatgtcaacctggtgggcagccaggacggctacttcaaaccggatcagcgcgaggcgctgttcgagcgtattcgtgccagcggcgccgcgatcgtgacggtggcgatgggatcgccgaagcaggagattctgatgcgcgactgccgcaaggtgcatccgcaggcgctgtatatgggcgtgggcggcacctacgacgtctttaccggccatgtgaagcgtgcgcccaag

SEQ ID NO: 21823 - DNA, 213 bp, Glycine max
  Peptide Sequence Number=SeqID_113508
atggtccacaattctaacacggctgccaacagccccgtcgtagaagtaacaacagactacgacgaccatggggacaacaccgtcgtagaaaaaatcttgttttacgacggttgtctacccagaaccgtcgtagaagggtcatatcactacaacggtgttttgttgcggacgaccgtcgtaagagacagtgttaatactactacggtcacgtaa

SEQ ID NO: 21824 - DNA, 111 bp, Glycine max
  Peptide Sequence Number=SeqID_113509
atgaagcttcctatggactttgaaagtgtaccaactagttcgggaaactctagctctgaacagaagatacagacaccaaggagcactaactcccgtaatagggaatcttaa

SEQ ID NO: 21825 - DNA, 390 bp, Glycine max
  Peptide Sequence Number=SeqID_113510
atgacctttgtcccttctgccatagccaacccgaatccgcctctcatttgttcttctcttgtgctaaggcccattgataacttcctccagcatcagcctttagcaggatcaaaggggtctaatagaagatggaagatgtggtggatagcagttacaattactatctggaagtccagcaatgagttgatttttcataacaaaccattcgatatctctaagctggctgactcaactcttttccttttgtggacctggttgaggggatgggaaagggactttatgtctggatgctgtaaacctgcagaagaatgccagtttagctatgtgaatccaacgacatggacgaagcccacaaatgtgactaatcagagcaatccaattgactcttga

SEQ ID NO: 21826 - DNA, 339 bp, Glycine max
  Peptide Sequence Number=SeqID_113511
atggcgcctgatgcggtattttctccttacgcatctgtgcggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtatatcccgtattgacgccggcagagcactcggtcgcgcatacactattctcagaatga

SEQ ID NO: 21827 - DNA, 108 bp, Glycine max
  Peptide Sequence Number=SeqID_113512
gtcgactctagaggatccccggccgacactgacactgagagacgaaagctaggggagcgaatgggattagataccccagtagtcctagccgtaaacgatggatactag

SEQ ID NO: 21828 - DNA, 171 bp, Glycine max
  Peptide Sequence Number=SeqID_113513
atggaagacgcacctgtgagcctcgtgtcgccctcctgtcgaaggatggttgtcatcatcaaaaagggggagaatgtgaatcttgcaggtttggatgatgtcaaaaagaatttgcttgaaaatgattgtcatcatcaaaaagggagagaatgtgaatcaggcaggttttga

SEQ ID NO: 21829 - DNA, 429 bp, Glycine max
  Peptide Sequence Number=SeqID_113514
atgctcgtcagggggggcggagcctatggaaaacgccagcacgcgctttttacggttcctggcctttgctggcctttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccgcctgttatgcccttcggctccacatctattgcattttgttcggtgctcagatggttcgacccaatccatctcatttcttatccttgttgattttggccgacctttcgcacgaattgtagttgggtcagggataagtgtccatgcatcatcagaaggaggaatagccgcttcattcccaagaggccaccattgtgcggagtaa

SEQ ID NO: 21830 - DNA, 444 bp, Glycine max
  Peptide Sequence Number=SeqID_113515
ggctacgcgtcctcgcctttagaggactacacgtcctcgcctttagaggactacacgtcctctccatcagagggctacgcgccctcaccttcagaggactacatgtccttgccatcggagggctacatgccctcacctttagaggactacgcgtcctcaccttcagagggctgcacgcgctcgccttcagagggctgcacgccctcgtcttcaaaggactacacgccctcgccttcaaagggcgacaggtcctctacttcagagggctgcacgcccttgcctttagagggctatgcgtcctcactttcaggatcacgaccacaaggtacccagtggacccggggaagtccaacagggccctggggtttccagccctagttagggcctctgtcagtcctacagggtgcccgtcccccccagcaaggtcatgccatcgtgacatag

SEQ ID NO: 21831 - DNA, 75 bp, Glycine max
  Peptide Sequence Number=SeqID_113516
atggcaggagaaggctctgaggaagcctatgtggggcttccttggaggatctttgacccaatgaggtccttgtag

SEQ ID NO: 21832 - DNA, 612 bp, Glycine max
  Peptide Sequence Number=SeqID_113517
atggttatcggttcaaggacgcaaggtgcccctgctttttcagggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggcttaggtggagggcaaagaaggcctcttctgggggggccagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggtgtgggcgttagagcattga

SEQ ID NO: 21833 - DNA, 213 bp, Glycine max
  Peptide Sequence Number=SeqID_113518
atggcgaatcaagaggagtgggttccgtttgcggacgtattagctttgctaatctttggggttgtcctctttccaaacgtggacggtttggtggacctagctgcgattgatgctttccttgcatatcaccatagcaaagagagcccgatgctattcctaccagacataaggcacccatgtccgctccaaagtcatcgctcgtgtgtcagatag

SEQ ID NO: 21834 - DNA, 390 bp, Glycine max
  Peptide Sequence Number=SeqID_113519
gaccccattgatgttgccattgttaaggagttctacgctaacctttatgatcctaaggataaatcacctaagcaggtgagggtgagaggccacttaattaagtttgatgaagatgccctcaacaccttcctaaagacaccagtgatcattgaggaggaggagagcctatctgcctattctaggaggggatttgagctaaattcagatgggctacctttgaaaatcttgaggaagaatttaaccactcttgctcagacctggagtgtcctttcactctccaacttggcacctacctctcatacatcagacatcacactggataaggccaggttcatctacggcatcatccaaaacatggacatgaacttgggatacctcatcttgagttaa

SEQ ID NO: 21835 - DNA, 363 bp, Glycine max
  Peptide Sequence Number=SeqID_113520
atggaacccggcacctatatccgcccgcaccgtcacccgcaaacctgggaactgctgacgccgctgcgcggccgttttgtcgtgctgcagttcaacgatgacggcgtcgtgatgcagcgcaccctgctcggcgaagaaaccaaagtgctggagatgccggcatttacctggcatgcggtgttgtcagtcgatgccggcggcgtggtgttcgaagtaaagcagggcccgtatcaggcgttgaccgaagaggactgcattccgtgggcaccgcaggaaggcggtgaaggcaccgaagcggtgatgcgctggggctgccccctgcaacgcgcccctctcttttataccgtttccaagcgagcgtag

SEQ ID NO: 21836 - DNA, 537 bp, Glycine max
  Peptide Sequence Number=SeqID_113521
atggccccgaggaagcttgcctcaaagaggtccaggaaggacaaggcggccgaaggaattagttccgctcctgagtatgacagtcaccgctttaggagcactgtacaccagcagcgcttcgaggccatcaagggatggtcatttctccgggagcgacgcgtccagctcagggatgacgagtatactgatttccaggaggagataggtcgccggcggtgggcatcactggttacccccatggccaagttcgatccagaagtagtccttgagttttatgccaatgcttggccaacagaggagggcgtgcgtgacatgaggtcctgggtgaggggtcagtggatcccgtttgatgcagatgctatcggccagctcttgggatatccgttggtgctggaagagggccaggagtgcgagtatggccagaggaggaaccggtctgatggggaggcgagtgcgaattatgcgcaccaatatgaccaccctgactcagatatggatgactttgctgctcagcaacatcctgcccaccgatcataa

SEQ ID NO: 21837 - DNA, 406 bp, Glycine max
  Peptide Sequence Number=SeqID_113522
atggaactcggcctcaagtgggaggcgttaaatggcaacttctccaatgtgctcttgggcatcacatttaggcttgagccgttgttgatgagtactttggctataacgtgttccatgcatttgaccaacacatgtaaagccctattatgtcctctcccctcggcgaggatttcttcttcagcgaaggtgagaggaactcgctggcctcctcgagtgatacctctttcttgctgcaaccctctctcccctcggcaaattccttcattgaacctcctcgtccggtgcggggatcaccttgacattttgtgcttcggttacttttgttttccctttagcgtttgcgggctgcgttggcaggctagggggtgcgaacacgcgaccgttgcgggttatgccgctcagccca

SEQ ID NO: 21838 - DNA, 369 bp, Glycine max
  Peptide Sequence Number=SeqID_113523
atgaccgttcgaagccttgggttcgatggcccctatgacatctatcccctacatggaaaaaggccaaggggcggacatgacattcagaggatgtggcggaacattgacattgtccgcgaacgcttgacatttatggcatttccttacatgggtgcagcaatcgctttccatggtgagccagtaataacctgctctaaggattttcctggccatagcatgcccattggtgtgcgtcccaaacgactcatggacttcctcgatcatgtggttcgcctctttggcatccacgcatcgcaggagggtcatgtcatggtttcatttgtacaggatgatgtcactcacaaagaaaccagtagccaatctccttaa

SEQ ID NO: 21839 - DNA, 330 bp, Glycine max
  Peptide Sequence Number=SeqID_113524
acttatcaaggtaatccttgtggcgtctacccagacttatcttccttcattggaagtggcgtctacccagacttatcttccttaaccggaagtggcgtctacccagacttatctgccttcactggaagtggcgtctaccatgacttatcttccttcactggaagtggcgtcatccaaaccttcgtagcctgtatcaaacgatccgccccacttatcaaggtaatccttgtggcgtctacccagacttatcttccttcgttggaagtggcgtctacccagacttatcttccttcattggaagtggcgtctacccagacttatcttccttaa

SEQ ID NO: 21840 - DNA, 318 bp, Glycine max
  Peptide Sequence Number=SeqID_113525
atggcgaaggtctccacggaggccattgcctccctcgcccaatattatgaccagcctttgaggtgctacacctttgggaacttccagttaagacccacgaatttccaaaatagtcaaaatctcaacacaggaattggaccgcggaaagcaagtcgaaaatggggtgcttggaataccaatgaaatgtttggaagaaaaggcgagaaccttggcaagtcaagacaaatgggccccgttcatggacatcctggcactcttgatcttcagggtggtcctctttccaaatgtggatgggttggtggaccgagcagcgattga

SEQ ID NO: 21841 - DNA, 267 bp, Glycine max
  Peptide Sequence Number=SeqID_113526
atggtagcccgtgtaatgttgggacataggtacgagcccgaaatgggtttgggtcgaaacgaaaatggtgtggagagcttggtgaagttcaaggagaatcgcggaaggttcgggttaggatataagcctacacacaccaacgtaaggagaagtgcccaagaaagaaggggtggaagcatgggctaccagcaaggaccgcaagtgaaagggactcccttatgtcacatcaacgagagctttgtctgctcgggctggatgtgtgaatga

SEQ ID NO: 21842 - DNA, 651 bp, Glycine max
  Peptide Sequence Number=SeqID_113527
gcggacaggtatccggtaagcggcagggtcggaacaggagagcgcacgagggagcttccagggggaaacgctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgactggcacgacaggtttcccgactggaaagcgggcagtgagcgcaacgcaattaatctatgaccatgattacgaattcgagctcggtacccatgaagataatctatctagtggattacaaatacaaaattctcagttatctacagtgcaggtgaaacaaggaagtgaccctggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 21843 - DNA, 612 bp, Glycine max
  Peptide Sequence Number=SeqID_113528
atggacctcatcaaggctgctggactgctgaaaactgtcaccaagttgggagattgctatgaaagtctagtcagggaattcattgtcaacattccctctgacataacaaacagaaagagtgatgagtatcagaaagtgtttgtcagaggaaaatgtgttagattctcccctgctgtaatcaacaaatacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcctgcataggattgggactgcaaaactggacattgtctcgacatcagggaaagctgctgcttcaggtgctgtgtccaaggatgatttgattgctgaactcaaggacacatgcaaggtgctggaggcaaccatcaaagccaacacagagaagaaaatggagctggaacgcctgatcaaaagactctcagacaatggagttgatgatggagaagcagctgaggaagaagaagatgcagcagaggatacagaatcagatgatgatgattctgatgccaccccatga

SEQ ID NO: 21844 - DNA, 484 bp, Glycine max
  Peptide Sequence Number=SeqID_113529
gtcgactctagaggaccccttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggattagcagagcgaggtatgtaggcggtgctacagagttcttgaagtggtggcctaactacggctacactagaagaacagtatttggtatctgcgctctgctgaagccagttaccttcggaaaaagagttggtagctcttga

SEQ ID NO: 21845 - DNA, 351 bp, Glycine max
  Peptide Sequence Number=SeqID_113530
atggcaccgaaaaagcttccagccaagaggtctaggaaagacgccattggagagggttgcagtttggccccacaggcaaatgtggactttgatagacacaggtttcggagtgaggaacaccagcgacgatttgaggccattaaagaagggggagtcagagacaagcactcctgggtgaggggccaaaggatccttttcgataaggatgccattaaccagtttctggggcatccactggtcttagaggagggccaatgctgcaagttcagccaaaggcggagtcaacgcctctggcttcacgaggaggctatcagccagttgctgtgcattccggggcaagactttgcctag

SEQ ID NO: 21846 - DNA, 420 bp, Glycine max
  Peptide Sequence Number=SeqID_113531
atgcaccagagtcaaaataccaagaagaactgggtaaagaagttttacttgaaagacccaaagcaggaaatgctcaaacgatcatttgttgaaccatttcaagggttaaagttggcacaaaagcaggacagtgggaaacaaaatatccatggccttcgcagcagaaacattggacaatactcatgtctcgtcttcaaggaagaggacaagctggaggctgtgatggtcgcaatggatggggaagcccttgattggttccaatggtgggaatcttggaatccaaaccacttttgggatggattcaagattgttgtcacccaaaggtttcaagcttctaacctgggaaattcttttcaagcgttgttggcactggaacaagaagagacagtgcaaggattcatagataaatttgagaagtga

SEQ ID NO: 21847 - DNA, 144 bp, Glycine max
  Peptide Sequence Number=SeqID_113532
atggcttcctatggtgacctcaagaagcaaaggaatccattgatgaagaagatccaaggcctagaagctccacatggagctacatcagaaatgcatcaagaagctctatgtcttgcctattttgaacaaaaagctgaaaagtga

SEQ ID NO: 21848 - DNA, 243 bp, Glycine max
  Peptide Sequence Number=SeqID_113533
atgccatcaagggacacggctccccaaaggccccgacacccctcaacagtgtcgagcattagacgtattccttttccttacaagaacagttgcgcagttccatggaggtacgcccctccgggcggtagggaggaagaagccactgacataggctcactatcggccaaagtaaccaacatcaccgggttgagcggcataacccgcagtggtcgcgtgttcgaaccccccagcctgcaaatgtag

SEQ ID NO: 21849 - DNA, 318 bp, Glycine max
  Peptide Sequence Number=SeqID_113534
atggtttcttctggtcctattgatttcattccgaaagaaccttataaagatctattttatcagaagaaaaagggtaaaattctgagggtttttttccccaattatacatactggtcaactaaaaaggagagttggtataatctgttcgctattggaatgtatggatatattcgttatggggagtatgggccgagagaaaatcacttggagcaatttattttggctactaatcacttttacctcttattcatgggttatgtgttcgtccggaggagcgcgtatgcaagaaggaagtttgagcttgatccaaatggctaa

SEQ ID NO: 21850 - DNA, 144 bp, Glycine max
  Peptide Sequence Number=SeqID_113535
atgggactagaagaacttgctgaagggaagaagaatagtctatggaggacgagaagaaagctggagagtaacacttgtaacccttttgaatacgagaatatcccaaaagacacatttaatggccttagtagagagtttgtctaa

SEQ ID NO: 21851 - DNA, 675 bp, Glycine max
  Peptide Sequence Number=SeqID_113536
atggctggaagcgctacagccagggcgaagcagctcaagtctggttgggcctcctcctatggggagggtgtgggaacgtcgcgagttgaatccttggagcactacgttctacggcaagcgtggacagtcggcgtgaccatggccaatatgatgtcgatagtaggtccagctattgatggtggacgtagaggacaagtcatgggctcgggcaagtactgcggtcccagccgtgacttcagtcaccgtatcagcacgctcaagatgctgaccgcccagaacgacctgcagtgcggcacattctgggttttggaggacgtactggcaacctacggaggaggccgagacacaacgcgccgccgctggtgcccagtgtgctaccgcgattgggatgatgatctctcatatgagccgctatcgtggatcgtcgacatccaagctgagtgtgacctgcataaatgcaagctcgaaaccacctgttcaaggtgtggcgcggaccagccgagctcaacagactaccagcgccgtagaagatgccacaaatgcaagcaatcgctttccggtgatggctccgccgcagcgattactggcgacgaggcatggggtcagcaacagcttgcatccataatcgaactttgcgcgacgccctcacaaccccagattcccttcgaaaactat

SEQ ID NO: 21852 - DNA, 219 bp, Glycine max
  Peptide Sequence Number=SeqID_113537
atggcaatatccacaaataatcatacaacaaaggcatacatgacatttagaggtatcatccccttcgaaaaacatattgcggcagtagggactaccagcaataatatgttatcaaagagaaaaactctagatgagggttcattgttatcaagcaagtcagagacccagcatgaccacagattcacctccactccttatgttcccatggaccgggtatag

SEQ ID NO: 21853 - DNA, 144 bp, Glycine max
  Peptide Sequence Number=SeqID_113538
atgaagtcgttgagaggaaaggagatcgcgttggtgaaggtgcagtggggaaacgatgagggtgattctacatgggagttggaagataggatgagagaattgtacccaaaagtaggaatagtgggggcaagatatgcgggttag

SEQ ID NO: 21854 - DNA, 470 bp, Glycine max
  misc_feature (96)..(96): n is a, c, g, or t
  Peptide Sequence Number=SeqID_113539
atcacactgaggtagatgagtttgaggctgaattggagaggcataatttccataaacgcctcaccaatttagtcgatgggagcatagacctggctntggtgaaagagttctatgcaaatttatacagttctgaggaccgtccaccaaagcagtacagagtcagaggtcatttggtgaagattgatgctgacagtctcaacacattcctggagacacctgtgacttgggtccctactctgatcaccgcattatgtagagccagaggggttgtctctgatagcctcacttttgagtgccttagcccgatcattaacttggcctacatcaagaagaactgttggaaccccaaggatctaacagtttctatccgagggatttggagagcgagggctaggccagctgagctcccttccacttctgcggctcctactctagcatccacgtcagcagctccttctgttccagcctag

SEQ ID NO: 21855 - DNA, 288 bp, Glycine max
  Peptide Sequence Number=SeqID_113540
atggcatttctaggagaaactagcagtcagacgattgtcaactcaaggttggctttcatttatccaaatggatcgattattcacaatgatactggggtttacttccaaacttcaactctggtgcccattcgagtaccaaataggtgtgattttgcaagcctaaaaaccagaatacacaatacccttcagctatccgacaaacaatttttggataaaattcactaccggaagccattcaccgatacggtgagttattatgcaccgttggaagaacaccagatggaataa

SEQ ID NO: 21856 - DNA, 309 bp, Glycine max
  Peptide Sequence Number=SeqID_113541
atggcacaacctcctccccgtgagaggactctaagggaaatggctgcacctgatttcacctacgaaagcatgtgcatccaataccctgatgaggatgtcccatatgttctcaaaactaaactaatccatttgcttccaaagtttcatggccttgcaggtgaagacccacacaaacatctgaaagaattccatattgtctgcttcaccatgaaacccccagatgtccaggaggatcacatatttctgaaggcctttcctcattctttagaggggagtgacaaaggattggctttattaccttgctccatg

SEQ ID NO: 21857 - DNA, 195 bp, Glycine max
  Peptide Sequence Number=SeqID_113542
atgaaagcagctggcacgacaggtttcccgactggtaagcgggcaatcatggccagaacacgaggtttaggtcgtgccataggtagagttgtaggcagagatagagctgctgacaaggatgctggcgatgttcccgagaggcgtaggcctactgcctcagctcgtagactacgcgttcatcagatgactacgtag

SEQ ID NO: 21858 - DNA, 306 bp, Glycine max
  Peptide Sequence Number=SeqID_113543
atgacacaacctccaccccgtgagaggactctaagggaaatggctgcacctgatttcacctacgaaagcttgtgcatccaataccctgatgaggatgtcccatatgttcttaaaattggactgatccatttgcttacaaagtttcatggccttgtaggtgaagactcgcacaaacatctgaaagaattccatattgtttgctccaccatgaaacccccagatgttcaggaggatcacatatttctgaaggcttttccttattctttaaagggagtggcaaaggactggcttcaaggtccatcatga

SEQ ID NO: 21859 - DNA, 459 bp, Glycine max
  Peptide Sequence Number=SeqID_113544
atgggaaactacctgcccggatcccagaaaggcccctatgaagcttcacgtttcgtaggatggctttgggcttttctgcagcagcttaggtggaggtttgcaaagaagcagcctccttgggggggccagagcatcagtgagataccactcgaagagctagaattctaccttgtgccaggacctacgggccgagggacagtctcaggtagacagtttctggggcgtaagtcccaaaaggtaacggaggggaagcgttcctcgggccagacggagatccctcgagcagtgctgaaagcggaagcagaagggagcttgagtaacgcaaacgttggtgagaatccaatgcctcgaaaacccaagggttcctccgcaaggccgaagggcgtagtcgatggacaacaggtgaatattcctgtactaccctttgttggtcccgagggacggaggaggctaggttag

SEQ ID NO: 21860 - DNA, 285 bp, Glycine max
  Peptide Sequence Number=SeqID_113545
atgtgggacaccttagccattacctacgaggggtcctctgaggtaaaatgtaataagttgagtcttctgacatgtaagtatgaactctttagtatggaagagggagaagatatccaaaccatgtttggacgcttccaagccattatgaatgagcttcattctctagtgtcgcaacctaccctttggcgggagggcgacgcgaggctcacaggtgcatcttccaaggaaggaaaacgcgcagagtcaccaccagtgtttattcgaggaaaacgtcaaaaaaattaa

SEQ ID NO: 21861 - DNA, 141 bp, Glycine max
  Peptide Sequence Number=SeqID_113546
atgacttcaatggggactagaaggaaagaaggggaaagagtagttcatctcgactcatccaacgggcaagcaagttccacggctagagagggtgtacgaagtgaaggctcgttgagaccttgccttaggaagactttatag

SEQ ID NO: 21862 - DNA, 249 bp, Glycine max
  Peptide Sequence Number=SeqID_113547
atggtgggagcagggcagaggtccctcttaatcctccttttggggtcttgtcatggagttagtttgcacaaagcttgccagtccaaagaagaaggagtgtcgagtcaaccactttggagagccagtacacggaagtcttctttcgtttctgcgttcgggaaggatgcgatgacttttacttcaccccgggcgaggtctcatgtcgccacacgggccatggatggcccagctggtgaaggaaaagaatag

SEQ ID NO: 21863 - DNA, 47 bp, Glycine max
  Peptide Sequence Number=SeqID_113548
atggaagggaagcttaaggaagattttgaccctgttcagctaaatac

SEQ ID NO: 21864 - DNA, 432 bp, Glycine max
  Peptide Sequence Number=SeqID_113549
atgacggtgaaaacctctgaccacatgcagctccggagacgtcacagcttgtctgtaagcggatgccgggagcagacagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgagaaattttag

SEQ ID NO: 21865 - DNA, 222 bp, Glycine max
  Peptide Sequence Number=SeqID_113550
atgtctcatgctaaggatgattgtggttccagtaacggtgatgctggtgggtttgctagtagtcgtaattatattgataagttcagaagtgcttcttcaattccttttcctttgacaattgaagcttgtatggttgaggtagatggtcagatctttggtaaagggtttggattaacatgggaagaggctaaaatacaagtatctgattatttactcatctaa

SEQ ID NO: 21866 - DNA, 330 bp, Glycine max
  Peptide Sequence Number=SeqID_113551
atggtagccataaccctatccaaggttcatcaacctccatttctccaagaatacgactcgaacgcaatgtgtgcttgtcatggagaggccccagggcattccattgagcattgtaggggcccgaagcttacaatgttaaaagaaatggataaagttgatatctttgtccctcatcctcacgcaaacgcatctttgcttattcaactttcaccggaatgtgggtgcaagccattggtctgtttgctcaagcgacctgtgctcctaagtttggacttccaagaccgttcaatcagagattactcgtcttgcacgttggtgggggtgccgtaa

SEQ ID NO: 21867 - DNA, 119 bp, Glycine max
  Peptide Sequence Number=SeqID_113552
ggttggacatgaatcatctctagaccctaggcggcaacaaggagagagaaagacacgtgacctacactccatgcctttctctttccttgtcgttacaccgtgtaaatggagattagggg

SEQ ID NO: 21868 - DNA, 94 bp, Glycine max
  Peptide Sequence Number=SeqID_113553
atggtctcagctctttcaagtagtgatgcttacgtggaatcgacgagcaaggacgaaaaggaatcttcaagtgacgcgacgaggaatccgcggg

SEQ ID NO: 21869 - DNA, 294 bp, Glycine max
  Peptide Sequence Number=SeqID_113554
atggaaaaattcgacaagatgaatttcaaagagaagaaagaaaagaaaggatatatcacttgggaagataatgtcataaattattcaagtgattcagagaagaaaatcataagtctgggtatcatgatgaaagactatgaaaatggagaagagcaaaacaacaaaacgaaggccacattttcccccaagaaaagtgaatatgcgatatatggagacaacaaacaaaggccacttgatcaacaaccccaacaagtaatatcaaatgataccaacaggtcacttgtctttgattga

SEQ ID NO: 21870 - DNA, 816 bp, Glycine max
  Peptide Sequence Number=SeqID_113555
ataaccgtaaggtgtctccgcatgctattagaccctcgagccacgacaacagaagtgagactttttcgcggtctcgtccggaagacgctaacatctccaggaaggatgcaaatgatcacattggtgcggataaccataaggtgtgtccgtgtgctaccggaccattgggtcacgatagcagaattgagactttttcgcggtctcggccggaagacgctgacatctccgggaagggtgtggataaccataaggtgtgtccgcgtgctaccggacccttgggtcacgatagcgaaattgagactttttcacggtctcggccggaagacgctgacatcttcgggaagggtgcagatgaccacattggtgcgaataaccataaggtgtgtccgcgtgctatcggatccttgggtcaggatagcaaaattgagacttttttgcagtctcggccggaagacgctgacatctccgggaaggatgcaaatgaccacattgacccttgggtcacgatagcgaaattgagactttttcgcggtctcggtcggaagacgctgacatctccaggaagggtgacaaaaggtgcgaataaccataaggtgtgtccgcgtgctatcggacccttgggtcactatagcgaaattgagacttttacgtggtcttggccgaaaggcgctgacatctctgggaagggtgcagatgaccacattggtctctgcgtgtcaatcgggcttgggggtgcggataaccgtaaggtgtcttcgtgtgccatcgggctctcgggtcataggatagcaaaaagtgtgtgcgaatggccatcgg

SEQ ID NO: 21871 - DNA, 477 bp, Glycine max
  Peptide Sequence Number=SeqID_113556
atggtggcgcgtgttatgctcaggaacggatttgagcccggaatgggtctaggcaaggactgcctcgagaatgccgacgtggtcgatatcaagggaaatccatacaagtatggattagggtatgaacccgggatgccggggaggaggaacgtgccgtcaagattttgggcggatagggtatggcccggccgtattagccagtgtttcaccagcactggaatggtgtccgaggaggaggtggccgcaatagaagaggagttccctcaagacccaccaagttttgtgcaaccaggccatcccgattcccaagtggggaactggcgcgtgataagccagtcagaagtctataccgctgattcaatatatgagggtcgattctttgaggatcctaacaacgagggtttgacaatcgattttgatcgagatataagccaaacgataaacgaggaagaggaagaggacgtggggatcctctag

SEQ ID NO: 21872 - DNA, 483 bp, Glycine max
  Peptide Sequence Number=SeqID_113557
atgcccccgactgtccctgttaatcattactccgatcccgaaggccaacacaataggatcagaatcctgtggtgttatcccatgctaatcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcagctccctctccggaatcgaaccctaattctccgtcacccgtcaccaccatggtaggccactatcctaccatcgaaagtgatagggcagaatttgaatga

SEQ ID NO: 21873 - DNA, 450 bp, Glycine max
  Peptide Sequence Number=SeqID_113558
atggaactccaacgtcttaatcaaaatgaagaaaccgacaaaaagaagagaagtatagcacttaaagcctcatcatcaatacaagaaggaaatgaagaagaagattcagatgatgaagaagacttctcattctttgtgaagaagttcctgaaatttgccaagagaagaagaatagagaggcgtcagaactttaacaatggaagaagattacaagaagactctcaagtccttatatgttacaaatacaaccaacttggtcacatcaaagctaattgtccttcaaatgaagaatggcctgagaaaagtgataagaaaaggtatgatgaaagaagaaccaagaaggcctacattgcatgggacaacaatgattcatccgatggttcagaaaaggagatcaatcttctaaccaaggattataagagtgatgagaacatttctcaagaagtttaa

SEQ ID NO: 21874 - DNA, 738 bp, Glycine max
  Peptide Sequence Number=SeqID_113559
atggctaagtttgacccaaatatagtcctagagtttacgctaatgcttggcccacggaggagggcgtacaggacatgcgacgccctcaaccagttcctaggtgacccactagtgttagaggagggccaggagtgcgagtttagtcagagaaggaaccgggccgatggatttgacgaggaggccattgcccagctgttatgcataccgggtcaggattttgcctggaccgctgtcgggaggcgggtgcagatcatgcgcaccggcatgaccactttgacccagatgtggatgatgttgctgctcagcaatgtcctgcctagcgatcttaactccgacctccctctgccgaagtgtcagctggtgtatgccatcctgacacagatgagcgtccatgtggctcagttgatcgctgacgccatttatttatttgcaggtatgccacctacctggcaccctctagacccagataagtctaatagggccctagggtttccagcattgatcacgggtctctgcccgtcattcggggttcctgttacacctagtaaggtgattcgaccgccgatcactcgggccttcattgagaagtattgcactcctagacaggcacagggtgatgcaccacaggtcgcagatgcactgccaccacctcatcaggctgatccagctgggtcatttggcatggagcggtatttacaacacttggttcgccagcaggcggccaaccacatggggcag

SEQ ID NO: 21875 - DNA, 669 bp, Glycine max
  Peptide Sequence Number=SeqID_113560
atggcagaggatgttcctcagatgattgaggatgtacctcatatgactgacgatgttcctcagatgagtgaagatgtgcctcaaatgactgcggacgtagatgcgactgttgcagaggacttaggtcatgatggtgctgaggggtcacacgctgatgagggattccctggtgggccctgtgacccatcagttttgacttcatttgcggagcatgtcgcacatgccatttggactggacatgagcgtcctgagctaaagttggtgtcgaacaggaggaaggtgacattgattgggaggccagtgcctgagattgaagggctggttgccgccacaggattaagtcaattgattgggtgttcagttgtaaccagcgatccaagacttatattcgcatttatggagaggtggcacagggagaccgacaccttccaccttctagtaggagagttgacgatcacactagataatgtgtcgtcactcctccatctccctatcagtggcgccttccacagcttcgaggctctttccgtggacgaggcagtatttttgttgatggagttgcttgaggtgtccagtgaagaggctagagccgagacagtacgagcgtgcggggcatatgtacacctctcatgggttcgggagatctatgagatgagatgccaggcatga

SEQ ID NO: 21876 - DNA, 180 bp, Glycine max
  Peptide Sequence Number=SeqID_113561
atggaatacttacttgttggtgatgaacaaaagcgcaaaacggaatcaaaaaatgcgaaaaaggatgaccctagggctgcaaattcatcaatcccgtgggtatggcttttgaaagggggaaaagaagtttttgaacgggtggctcgcccaggcgagcatagctcgcccaggcgagcatag

SEQ ID NO: 21877 - DNA, 147 bp, Glycine max
  Peptide Sequence Number=SeqID_113562
acttatcttctccttgaagtggcgtctcctctctctcttccttctccattccgctgtcatttatcttccaagaagcaaatgaatccattgatgaagaagatcctaggcctacaagctccaatggagcttacatcaatgaggctttga

SEQ ID NO: 21878 - DNA, 498 bp, Glycine max
  Peptide Sequence Number=SeqID_113563
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggaaaagccaaggattgaaagtgcagtttctgctgttgggtctcttccccacccaaccagtacccgctttattgcttatgaagaacttaaagaagcaacaaataattttgaaccagcaagtgtacttggagaaggaggttttggtagagtttataaaggtgtcttaaatgatggaactgctgttgcaattaagagacttactagtggagggcaacaaggtgataaagaatttttagttgaggttgagatgcttaggggtaccgagctcgaattcgtaatcatggtcatagctgtttcctgtgtgaaattgttatccgctcacaattccacacaacatacgagccggaagcataaagtgtaa

SEQ ID NO: 21879 - DNA, 525 bp, Glycine max
  Peptide Sequence Number=SeqID_113564
gtcgactctagaggatcccaccaataccccgtcgcgtatttaagtcgtctgcaaaggattctacccgccgctcgatgggaattgcgcttcaaggcgtctcgtagggctaatccgcctcacgagggtcaccaacggcacggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactcccccacctga

SEQ ID NO: 21880 - DNA, 470 bp, Glycine max
  Peptide Sequence Number=SeqID_113565
atgttcgacgaacgttgcggttgggtgacggccgatccgttgtatctcgggtattacgaccaggaatggggcgcgcccaccaccgacgcgcgcgagctgtttgaaatgctgtgcctcgaggggcagcaggccggcctttcctggatcaccgtgctgaaaaagcgcgagaactaccgccgcgctttccacggtttcgatccgcagcgggtcgccgccatgaccgaacaagacgtggaaaacctgctgcaggacagcggcatcatccgccaccgcggcaagatagaagccatcatcaccaacgccaaagcctatctggcgatggaggcggccggcgagaatttcgttaccttcatttgggacttcgtcggcggccggccgcagctcaaccgctggcaggccctgaaccaggtgccggccaaaaccgagcagtccgacgccatgtccaaggcgctgaaaaaacgcggcttcaa

SEQ ID NO: 21881 - DNA, 330 bp, Glycine max
  Peptide Sequence Number=SeqID_113566
atgcctcgtcaggggagcggagcctatggaaaaacgccagcaacgcggccttttacggttcctggccttttgctggccttttgctcacatgtctttctgcgttatcccctgattctgtggataaccgtattaccgcctttgagtgagctgataccgctcgccgcagccgaacgaccgagcgcagcgagaaacagctatgaccatgattacgaattcgagctcggtacccgaattggtacacacaaaccaattcacagttctatgggtgtgggagaacattatgtttccctagccctctttaatgataactcgatctccccatcgttttaa

SEQ ID NO: 21882 - DNA, 259 bp, Glycine max
  Peptide Sequence Number=SeqID_113567
gtcgactctagaggatccccctgcccctagtggtctagtggccaaggatcgtagccgtgtggctttgtatgtccgcttcaaggtagacggagactatgatgctactgtaggaggaggaggaagaggcgagccaggtggagtagccattgtggaagcaatgacttccaagattattttgatgatgccaaagaatccagagttaagcaagtttcaaagaattaggagtcaaaaagcttcaagaatcaagattcaagaataa

SEQ ID NO: 21883 - DNA, 900 bp, Glycine max
  Peptide Sequence Number=SeqID_113568
ctgaaagagttggagtccaggatggaggagtccgagctacaggcgaacaaggagagggagaccagcaaggagcttagagaagagctaataatgtacaagaaggaggctatggagcatcatgaaaagggctttaacaaggctgctagcggggaggaagaggatgctgaagagcaaggcgatggtcgccatgataagaatgcagtctttgatggcgtgggaagcaagaccttgttgaaatggaggcaagactttggtaatgtaggaggcaaggccatgactaaggacttgtttgccctaggttttgacaagcctgtagagctgcatcaaggcttaccaaggatagaccttgggttttgtgaacctgtgagactcatcaagacttaccaagggcggaccttaggttttgtgagctgttggagaattgagattcaccaagggtggaccttgggtttgacgagcttggtgtatgtagagcccatgtcgtactcttgcatacatgtcacttcgtggagtgacatggtggcgtgctcttacatacatgtcacttgtggaatgacatgtaccggagacatggtggcatgctcttgtatacgtgtcacttgtggagtggcacatactggagacatagtggtggcgtgctcttgcatacgtgtcacttgtgaaatgacacatactgaagacatggtggcatgctcttgcatatgtgtcacttatggaatggcacgtactggagacgtggtggtgtgcttttgcatacgtgtcacttgtggaatgacaagtacaggagacgtggtggagtgcttttgcatacgtgtcacttgtggaatgacacatactggagacatggtgtcgtgctcttgcatatgtggcacttgtgaagcgacacgtactggagacatg

SEQ ID NO: 21884 - DNA, 660 bp, Glycine max
  Peptide Sequence Number=SeqID_113569
atgaaggccgatatggaggccttgaaagatcaaatgacctccatgatggaagccatgttaagcatgaagcaaatgatggaaagcaatgcggccgcaattgccgccaccagtgccaccattgaggcagatccgacccatccatccgccataaaccaagcaaaccaacccatcccagacatagtggctcaaggaggagaggaatgcgtacacctatggcttacccctcccaattatacaccgcccaccatgcacatgcccaacgagaacgctaaccatgccgttcccgttacctttgagggccagcaaccccagcctatagggggcacccatgaagaacctcaggatcatgctcaggttgactttgagccataccctgcatttgccactgagagaccgacatgtagtgtggaaggaagggagaaactcgatctcatcaaggagaaattaagggtcgtcgaaaggtttggtgattacccattcgccgacatggctgagttgtgtttggtgcccgacatcgtcgttcccttgaagttcaagagacgagaagctcttgatgcatttctttcaagaaagcttggccggagcggcggtcatctggtatacaaatctagaagcttcctaaattcactcatggaaggacttgatacctaccttcattag

SEQ ID NO: 21885 - DNA, 648 bp, Glycine max
  Peptide Sequence Number=SeqID_113570
atgggtgttacacgtgtcaacatccctagtgaagtgaattaccaagggcttgggtttgctcaagctcttgtcagccgattgcatgcacatttattgctctcccttccttgcaccataaacctcaaacatgcccttgtctatcattccttgaaacaactcctctaccgtcgggcatgtttccatgtcatgcattgcccccgggtgtatcaaacaagaatctcccttatgcccatcaaaggaaatcatgcccgcttcgtgcagggccctcaatataaaccacctagaggttaccacatccttcatttgcttcggcctctgaggtccaccctcctccatcgcattaaccgccgatcccctatgattggcaaggggatttgtctttatgtttggatcgtcctcttggaatgtcagccaccccgtgtcaatcaaactttggaccttatgtttgagggccacacattgttctatcgaatgccctgggacacccctatgataagcgcaggttgcgttggggttgtaccatcaaaggaaaggagattggtaaattttattgggggtcaccaccgtcatttggttggtgatcaaggatggcagcaagttcgcgtacgacatcaaaatcggggcgaattctgcaagtttcttcactag

SEQ ID NO: 21886 - DNA, 117 bp, Glycine max
  Peptide Sequence Number=SeqID_113571
atggaagatttgtgcctagtacctgacatggtcattcctccgaagttcaaggtgaatggcaaaggaatggagaaggaagagagagaggagacaccacttcatggagacaccacttga

SEQ ID NO: 21887 - DNA, 1062 bp, Glycine max
  Peptide Sequence Number=SeqID_113572
atggctgaaagtcatatacgaggtttagattggctcgccaagttaaaagtcgtcagcgaagagagttttgaggcaccggaagaggacgaagaagtccaagctctcaaaagcgagttaggaaaggcgaaacttgccaaggagaggttcaagttggccgctacacacattcggaaggagtgtgccgggttacgggaagagaatgaaactaccacaagggcccttgaacaagagaccaagagggctcgcaaggaagagtatggccggaataaattttgcggagctctgtggggtagcaatagtgaactcaagctgcgaagggaagagatggaccagtcgcgagcacatagcatggttttgaaagaggagttagttgcctgttcaatgtccaaaagaagcttgtctcagcgtttatgcgagacggagaccaacatgctagctatcatcgccaagtaccaagaagagttaggtctagccacggcccacgagcgtagggtcgcggacgagtatgctcaagtatacgcggaaaaagaggctagaggaagggtgatcaactctttacaccaagaggcaaccatgtggatggatcggtttgctcttaccttgaacgggagtcaagaacttccccgcttgttagcgaacgccaaggcaatggcggacacctactccgcccccgaagagattcatgggcttctagcctattggaaaaacatcataactaaacgcgccacaaggcatccctatcgcaccagatccaaatctagaacgatgggtgatcaagaggagacacaggaacagatgaaagccgacatgtcggctctgaaagaacaaatggcctccatgatggaggccatgttaggtatgaggcagctcatggagaagaacgtggccaccgctgccgctgtcagttcggttgccgaagcagacccaactctcttggcaaccgcgcaccatcctccctcaaacatagtaggacggggaaaggacacactggggcacgatggcagccctcacctgggatacaaccgagcggcttacccttatggattgccgcccaactactaa

SEQ ID NO: 21888 - DNA, 342 bp, Glycine max
  Peptide Sequence Number=SeqID_113573
atgactgtgtgggtcgaagatcgactcaccaaatctgctcattttattccggaagttgacgcccaagtacctaggagtccgtatcagattttgaagaagtgggcctgtagcttatcatatcgccttacctccgagtttacttcgcgaatttgcatcctgtggtttcatgtctctcaactgaacggacaacccagatccatcacatatacttgcagtggacgaggtacaggtgaggataacctcacctataaagcacaacctcagaagatcactgaccgaagaatgaagtcgttgagaggaaaggagatcgcgttggtgaaagtgcagtgggggaacggatga

SEQ ID NO: 21889 - DNA, 180 bp, Glycine max
  Peptide Sequence Number=SeqID_113574
atgacttcttaccgaggccttgaacaacttggcgcaagttatggccaatcagggaggcggtggaggaacaactatgtaccatgggttagatcgcttttagaggaacaactcacctactttcaagagggttatgatcctgaggtgctgagcttggctgaggagattgagaagatcttccgg

SEQ ID NO: 21890 - DNA, 282 bp, Glycine max
  Peptide Sequence Number=SeqID_113575
atgattgacctgatcttagccctgaaagatcgagatatgtggattgaagatctggtacccattcttgaactatttccattcctacttaaccaccggtgtttgtaccccaaaaagtgggagagaaaacttcaatatggcagacagatgaacttaggcgttcaaaacccactccagttgatgaagctagggcagttgttcctaagaatggtctatggccattttgaccaagtgttcaagagttttgtccttgttatccccaaaggcacctacatgaacacataa

SEQ ID NO: 21891 - DNA, 231 bp, Glycine max
  Peptide Sequence Number=SeqID_113576
atggctacagccaggtgggcactcaagcatcccttttatggcattgtgatactacggttgggaatttacacaaacagacccaaaaacatgaatctggggatcccaggtcatgtggctccgcatgccaccggtctcttgggacacggtaacaaaaagtggggtggtcgacaaaagcagggcttttgctcctacgtatcctcaacttgtgatgaggaactcggacctacgtag

SEQ ID NO: 21892 - DNA, 1007 bp, Glycine max
  Peptide Sequence Number=SeqID_113577
atgctagctatcatcgccaagtaccaagaagagttaggtctagccgcggcccacgagcataggattgcggacgaatatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctattggaaaaacaccataactaaacgcgccgcaaaggatccctatcgcaccagatccaaatctagaacgatgggtgatcaagaggagacgcaggaacagatgaaagccgacatgtcgactctgaaagaacaaatggcctccatgatggtggccatgttaagtatgaagcagctcatagagaagaacgcggccaccgccgccgctgccagttcggctgccgaagcagacccgactctcttggcactacgccaccatcctcccctcaaacatagtaggacggggaaagggacacactggggcacgatggcagccctcacctgggattacaaccgagcggcttacccttatggattgccgcccaactattcaccacccatcttgcaagaagatgcgggccacattgcttctcccgtccatgaaaaagagcctcctcagcagcccgacgaagtccataaagaccctcaagattatgctcggagggatttcgagttttatcccccgatccccgaagggccggcaccaggcacgttgcctcaacccaacatcgcagcatcgccaatagttttgtctatggaagggccgcccccggcaactgaagaaaggaggaagctcgatctccttgaggaaagattgagggttgtggaaggatttggggactatccgtttgcagacatgacggatctttgcttagtacccgatgttgttattcccccgaagttcaaagtgccggacttcgacaa

SEQ ID NO: 21893 - DNA, 724 bp, Glycine max
  Peptide Sequence Number=SeqID_113578
ggcttcccggtatcaacagggacaccaggatttattttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgattgtaagggagaagagagatacaaaagatttcagacggaagaagaagaagaagttcaaagagattcagaaatcaattggcaaaaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 21894 - DNA, 588 bp, Glycine max
  Peptide Sequence Number=SeqID_113579
atggctaagtttgacccggatatagtcctagagttttacgctaatgcttggcccacggaggagggcgtgcgggacatgcggtcatgggtaaggggccagtggattccttttgatgcagacgccctcagccagttcctgggtgacctgctagtgttagaggagggccaggagtgcgagtttagtcagagaaggaaccgggccgatggatttgacgagaaggccattgcccagttgttatgcatacctggtcaggattttgctcggaccgctactgggaggcgggtgcggatcatgcgcacctgcatgaccaccttgacccagatgtggatgacgttgctgctcagcaacgtcctgcccaacgatgataactccgacctccctctgctgaagtgtcagttggtgtatgccatcttgatacggatgagcgtccatgtggctcagttgatcgctgacgccatttcgttatttgcaggtatgccacctaccaggcacccgctagacccagataagtctaacagggccctggggtttccagggttgatcacgggtctctaccagtcattcggggttcccctcacacctagtaag

SEQ ID NO: 21895 - DNA, 195 bp, Glycine max
  Peptide Sequence Number=SeqID_113580
atgaagaaacaacaatggaagagaagtggaagacaaaggagaagaggtgagaggaggcgccatccactagggaataagccatggaagaaggagcttcaccaccaagatgagccttggagaggatgcttcaatggaggaaaagaaagagagaagggggagcacgaaattgaaggaagaaaaagggagagaagttga

SEQ ID NO: 21896 - DNA, 251 bp, Glycine max
  Peptide Sequence Number=SeqID_113581
atggctatgatatctcccgagaagatctaccaaccttttttcccaaagtggtatgaccctaacgcaacttgcgcataccatgggaaaactccgggccactctaccaaaaaatgcctggcccttaaatacaaggatcgacccaacgtgaaaacaaacccgctcgccaatcatggagggggagcagttaatgccatcgagtcgggtaggccgcgcaggtctaagcctttaaaggacgtgacgacccccaggag

SEQ ID NO: 21897 - DNA, 207 bp, Glycine max
  Peptide Sequence Number=SeqID_113582
atgtccattttatctatatcatttaacattgtaactgtggtttatggcataaacttggaaatcctgatgagtcataacaacagcttccagaattgccccataccttgcacctacgcttcagagccctacaatgctcaatggaacgctccggggcttctccgtgacaacacacgtgcgttcgagtcgtatctcgagaaatggaggtga

SEQ ID NO: 21898 - DNA, 558 bp, Glycine max
  Peptide Sequence Number=SeqID_113583
atgaaagaaagcctcaagaggataacattaacctccccatacttcaataggaaggaaaatgtagaggcttaccttagattgggaaataagggtctaggcatcttaagagcagcaccttctaagcccaaagatgataaggggaagacaatagaaaagcaaccccctaaggccagtatgcaagaaaagactagctctataaagtgctttaaatgtcttggaacaagacacattacttctcaatgcctcaccaagaaaaccatgattatgaggagccaagacatttatagtagccaatataaagctactacttcaccttcctctagtgaaagtgaagaagcaaaaggggaagaatctagtgaagaaatctacccccaagaagaaggacaacctttaatgtttaaggagaagtgtaaagagacacttgttagcattgccacacctcttgggcttgagtttattcctcaagtaaaggagttgttggatgcgggtttggttcgcaagagcttaaatccttgtgctttgttggtgcccaaaatagtgatcaaggggttcccatga

SEQ ID NO: 21899 - DNA, 1122 bp, Glycine max
  Peptide Sequence Number=SeqID_113584
atgggttctgtcttgatccctgctgtaaaccaaccaacggagggtccgtgtcgccttcgtatatacgtgcgttggggcatttcgctacccgtagacgtcgtatctaagaaggggacaaattccccggacccccgtattcgtaaattgcatctgtgtcatatgcatttcttcaggcattcatccatcccacccatgagatatcggagttttgatttgcaccagcttttgtctcactttaccttccgcaagacttacggaaagatcttagagttgaccatagcagaagtgtccatagaagccattgcatcactcacccaatactacgaccagcctttgagatgcttcacattcggagacttccaattagtaccaaccattgaagaatttgaagaaattctaggatgtcctctcgggggaagaaaaccatatctttcctccggatgtctcccctccttgagcagaattgcaactatggtcaaggattccgcaagaggtttggaccgcataaaacagactcggaacggcatagcgggcctaccaacagaagtacctagaagacaaagcgaggggtatggccaatcaaggagaatggtcccgtttatggatgtgttagctttgctaatttttagggtcgtcctctttccaaacgtggatggtttggtaggcctagcagcaatcgacgctttccttgcctaccaccatagcaaggaaagtccggtggtagctgtcttggcagatctatttgacacatttgaccgaaggtgcgagaagagtagcgcacggatcatctgttgcttacccgccctctgtgtttggttggtttcacacttgttccaacaagacacaagacatccatgtccgctcctgagccatcgctcgtgtactgaaaagaggagaatggattgggaccagctcttggccgggataggaagtagaacaatcagttggttcccccgatggaaggaaggaaaagaaggagtccttttctcatgtggaagatacccaaacattccgctggtaggaacgaggggttgtattaattacaatcccacgctcgctataagacaactagggtaccccatgaggggagcatcgacggaagaaagcatgtctcctttcctt

SEQ ID NO: 21900 - DNA, 570 bp, Glycine max
  Peptide Sequence Number=SeqID_113585
atgcacaactcatccttcttcgagattcttcctcacgctcaacagagaagtgttgcgctcagcagacggctcgctagccaacagattggcttagcgagaagagggaatgctcagaatcagaaaagattaagcgacaatgaaggaagcaggcatgagggaatgctcaacggaatgtacctcaatctcaacggatgctcactagaccagttacaggttcactggggtgacgaggagacggcaatgatgggtcacaagatgcagtgtcgcggaggagggagagggcagttccttgttgaaccaattatcagacttatcaaggtaatccttgtggcgtctaccctgacttccttcaccggaagtggcgtcatccaaaccttcgtagcctgtatcaaacgatccgctcctactcagacttatcaaggtaatccttgtggcgtctaccctgacttatcttccttcaccggaagtggcgtctaccctgacttatcttccttcactggaagtggcgtcatccaattccccgtagcctgtatcaagcgatccgctcctagtcaggttcacatcaactaa

SEQ ID NO: 21901 - DNA, 378 bp, Glycine max
  Peptide Sequence Number=SeqID_113586
atgacaggcacaaagagcagagattcaagaagagggacattacccttcctgtttgagaaaccatatcaacccacaatttctcatttttcgggtttactaataagccaaaagtcgagcagggaagttggagccgtgaagtccacctcgtccacttcaatggaagaacaacaggtagggtgttgcagtgtaaaggattcaggctctataaataggatgggatgctctctgctatcaccaaacccgcttctctattcagaaaaaatagaccatctattcagagcgagtaagggtcatgaagaacaaaattgctttcaggttcgtgtatgcgccgcttcgctttcgatttgcaatggctcgaagtacgctcgtaatatttaa

SEQ ID NO: 21902 - DNA, 713 bp, Glycine max
  Peptide Sequence Number=SeqID_113587
atgaggggagcaccgacggaagaaagcatgtctcctttccttgtgagggatttcggcgcacaaaattccaagactatacaaagaatccataaggcgtgggaaaccccgttaaagaaagatcaagagcttagaggcattcgtaatggcatcattggtggcaccgggagaggacgaagagtccaagctctcaaaagcgagttaggaaaggcaaaacttgccaaggagaagttcaagttggctgctacacacgttcggaaggagtgtgccgggttacgggaagagaatgcaattaccgcaagagcccttgaacgagagaccaagagggctcgcaaggaagagtatggccggaacaaatttcgcggagctctatggggtagcaatagtgaactcaagttgcgaagggaagaaagggaccaatcgcgagcacatggcatggttctgaaagaggagttgatgacttgttcaaggtccaaaagaagcttgtctcagcgtttatgcgagacagagaccaacatgttagctatcatcgccaagtacgaagaagagttaggtctagccacgacccacgagcatagaatcgcggatgagtatgctcaagtatatgcggaaaaagaggctagaggaagggtgatcgactctttacaccgagaggcaaccatgtgggtgggtcggtttgctcttaccttgaacgggagtcaagaacttccccgatt

SEQ ID NO: 21903 - DNA, 344 bp, Glycine max
  Peptide Sequence Number=SeqID_113588
atgcggactgcattcatatgtgctgctcttcagcccccctcattgctgacttcctcgcctggtcatcatgttgcaacaggatcctttccttttgctaacatgttcgcagctggcctcgtagataaaccttctgggggtcgtcacgtccttcaaaggcttggacctgggcggcctacccgactcgacgacattaaccgctccccctccatgattggaaagcgggccatacactattcggtggagtggcccagggttttcccatggtgtgcgcagttgtgtcagggttataccactttgggaaaagaggctggtagatcttttccgggagatatcacagccatctg

SEQ ID NO: 21904 - DNA, 486 bp, Glycine max
  Peptide Sequence Number=SeqID_113589
atggctaccgcaccaaaagaaacttcagctcctggttcatcctctgtaccatcatctccatcatccaccaaagcaccatcacaccaggaacgacctgaattcaatatccaacccatccaaatgattcctggttcagcccctgttcctgagaaactggttcccaaaagacaacagggagtgaagatttctgaaaaccctagccctgcaacaagtcctagggaagtagacccggagatggataagaagatccgtagtattgtgagtagcattctgaaaaatgcgtctgtccctgaagctgatgaagatgtcccaacatcttccaccccaaatgtttctgtgcctgatgttgataaagatgttccaacatcttccgctccaaatgctgaagccctcccttcacccagtgaagaggaatcaacagaagaagaagatcacgccacagaaaagacccctgcaccaccccgcaccagaacctgctccaggtga

SEQ ID NO: 21905 - DNA, 99 bp, Glycine max
  Peptide Sequence Number=SeqID_113590
atgattatgagtgaagaagcaaaaagggaagaatctagtgaagaaatctacccccaagaagaaggacaacctttaatgattaaggaggagtgtaaggag

SEQ ID NO: 21906 - DNA, 564 bp, Glycine max
  Peptide Sequence Number=SeqID_113591
atggagattggcgaagacgaacttttccagccgtcgatggcgtcgagcgggattaactctgcgacgttatcggaagagatcctctgcgccattgagcgtctgctggacgtgatggagaggccgctggatgcgcgcattctcggcaaacagatcatccgcgaaattctttaccacgtactgctgggacccggcggtggggcgttgctcgccctggtcagccgacagacccacttcagcctgataagccgcgtgctcaagcgtattgagagccagtacaccgaaaacctgagcgttgaccagctcgccgcggaggcgaacatgagcgtctcggcgtttcaccacaactttaagtcggtgaccagcacctcgccgttgcagtacctcaaaacctaccggctgcataaggcgcggatgctgatgatccacgatggcatgaaggccagcgcggcggcaatgcgggtaggctatgagagcgcgtcacagttcagtcgggaatttaaacgctacttcggcgtcacgccgggagaagatgcgtcacgtatcagaacgatgcagggagcctga

SEQ ID NO: 21907 - DNA, 144 bp, Glycine max
  Peptide Sequence Number=SeqID_113592
atggacttcatggttaccactaaggagcctgaatttcttagagatgttgatgggacggaacatagttctaattcaattgaacaagatggggtttctgcttcgaattcgaagaattttaattctgttgctgctgagcttatctag

SEQ ID NO: 21908 - DNA, 233 bp, Glycine max
  Peptide Sequence Number=SeqID_113593
gtattgtgaggcaccaaatccctatgataggtggtatgatgaatatgttgagtggtgcaaccctcttttgtaaaatcatccatgcatccaacatcttcatgattcacatacatagggactcattaggtgtcgagggaagaagcctagagtatcaagaacctttggatttgaggtcaaatccttttcaagggggaggggatgatgcaatccaaccccccaagggtattggatag

SEQ ID NO: 21909 - DNA, 628 bp, Glycine max
  Peptide Sequence Number=SeqID_113594
atgaagctgatgcagcgggttctcgaactccacgatcgcgacaagttcgagatcgtgctgttcgaccacagccgcccctatgccctgttgaacaacaagaccgaccgcagcaagtggggcacgatcgtcgacatccacggtgtttccgaccaggaagtgctgcgcctggtgcgcgagcacaatatcgacatcatggtcgacctgaagggtcataccgcagatagccgcgccaacagcttcaacatcccgctggcgcccgtgcacgtcgcatggctcggcttcccgggcagcacgctggggatcgacctcgattacgtcatcggcgaccacctcgtcctgcctgacgtcgccaagccgttctaccacgagaagttctgccgcatgccggagagctaccagccgaacgacccgtcgaaccgtccgcagccgaagccggtgacgcgcgagcagtacggcctggcagacgatgccttcgtattcgcttccttcaacggtaaccggaagatcacgccggaagccattgcaagctggacgcggatcctgaagcgggcgccgaacagcgtgctgtggctgatgagcaattctccgcgcaacgaggagaacctgcgcaaggcgttccgggcatccg

SEQ ID NO: 21910 - DNA, 289 bp, Glycine max
  Peptide Sequence Number=SeqID_113595
gaatttacaagatagtggaactctcaagcgggttgcttggggactggacgtaggcacaagggtactattatctgaattcgatatcgtttacgtcacccaaaaagcggtaaagggaagtgccttagcggattatttggcccagcaacccctcccggatatcggccgatgcaccccgagtttccagatgaagatatcatggccctatgttgaagagaagcagacgcacgaggacatagacaaatggattgtttgcttcgatgggcatccaatgctttgggccacgaagtag

SEQ ID NO: 21911 - DNA, 129 bp, Glycine max
  Peptide Sequence Number=SeqID_113596
atgcaagggtcatgcatgagtgaacatgacatgcaaacgatgaaaatagaatgtatgcagttgtcataccctaatttcgtccggggacctttgctcgatgacatgcgaccattctttggtccttgtgag

SEQ ID NO: 21912 - DNA, 446 bp, Glycine max
  Peptide Sequence Number=SeqID_113597
atggggacaaatccaaaccgcaaaaggttttatcaagtcaaggttaaaggtctagatgtcactagcctcaaggaattaggacgattgatgggacctctccaaaggcaagcctttcgcaaagtgtacgggaagattctagatttggccgcagcggctgtgattggagattcagcaaaagagttggatcgcatgaaacaaactcacaatggaatagtgggcctgccacagaaatacttggaaggcaaggcaagggatatggcgagtcaagagaagtggggcccgttagcggatattttagctttgctgatttttggggttgtcctctttccgaacgttgacggtttggtagacttagccgccattgatgctttcctcgcatatcaccatagcaaggaaagtccagtggtggctatcttggcagatttgtttgacacctttgaccggag

SEQ ID NO: 21913 - DNA, 592 bp, Glycine max
  Peptide Sequence Number=SeqID_113598
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtgtgaggcagtctcaggttggctttggcagaagggacaaagttcagtatcaatctcaacttgtctcctagataagttaaccttagtaggaagcctatcccaaagcaatctccaggcaaatgttaaggctctgggagggattttgataatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 21914 - DNA, 261 bp, Glycine max
  Peptide Sequence Number=SeqID_113599
atgggtgccaagtacctcgaagtggtcaaacgagggtcgcatcctaacaacggatggtccccggatgaaattaggacgcagaatgaccataatttgtctctgcgttttattggaaacgatcgggcctgggcaacgagatacaaaatgaccataatttgtctctgcatgccaccggacacgatcgcctctggatggcgaaaaggtgcgcggaatgaccataatttgtctccgcccacctctcgacttactgtttttgaatga

SEQ ID NO: 21915 - DNA, 312 bp, Glycine max
  Peptide Sequence Number=SeqID_113600
atgacgctaccaaatataatcactgcaatacaatcatcaattacagataatggtgttacgcctataattaatgccctttggtatcgttatcctgtatatcaattcaatggtgaagttcagtatagggcaattcaaattattgatgaagaaggtgtcttgttcatgtttcatacatttctcaatatgacaagtgtaatatgtatgaaacttaaagttgatgttcataattcattatcacctactcaagttaatgacctaagttgggccgacatggagcagaagctggagaataccctgaaattagatgaataa

SEQ ID NO: 21916 - DNA, 345 bp, Glycine max
  Peptide Sequence Number=SeqID_113601
atgacagtcactagggtcaggaaagagtgtgatgtgctgagagacgtcaaaatgactatggtcaaagccttagagcgggcaactaaaagggcccgaaaggaagaatggagcaggaacaagttccgaggggctttatggggcagcagtaacgagcttaagcttagaagggctgagagggatgagtcaagattggaaagcatggaaaaggtgaacctagctactagtcataggcaaaggctggaggatgaacgaacatgcgaaggtatcgactctgcaaatggaaagggaagcaaaagagagggtgatagaatcattgcacagggaagctatgaaatggatggatag

SEQ ID NO: 21917 - DNA, 297 bp, Glycine max
  Peptide Sequence Number=SeqID_113602
atggaaaagtgtcttgtaaagcgaaagaccaaatttagagaagatccaacggttaacgaaggctgggcagcatttttaccgatgcagcttcatatatatatatcagggtgttacactgccagtggtggaggtctcggtgatatgactcctgttgaggctaggaatttgattgagaagatggcttccaactcccaacaatttagtgcaagaaatgatgctattgtccttagaggagtccatgatgtggccacggattcatcttcatctgttgaaaataagaagcttgagggaaaatga

SEQ ID NO: 21918 - DNA, 384 bp, Glycine max
  Peptide Sequence Number=SeqID_113603
atgtcgatctccccctgtggaagtatcagttggtctatgtcgtttcgacatagggatcgcatccacaagacacccagtggacccggagaagtccaacaaggccttggggtttccagctctggttacgggcctctgttagtcctacagggtgcccgttccccccagcaagggatcgcgcccgcaagacacccagtggactcggagaagtccaacagggtcttggggtttctagctcttattacggacctttttctgttctacggagtgcctgtcgcccccagcaaggtcatcaggccccctactaatcgagctttcatcaagaagtactgcgcccccaggcaggcccagggcaaaacaccacagcagcattgggatggccggtag

SEQ ID NO: 21919 - DNA, 81 bp, Glycine max
  Peptide Sequence Number=SeqID_113604
atgtggctaaaaggggtgaagacccctatgatgaacgcgttaagcagaccatctcgcgctaagcgcgtttatccctattga

SEQ ID NO: 21920 - DNA, 282 bp, Glycine max
  Peptide Sequence Number=SeqID_113605
atgaccggtttccttcagttttcccgatgtttcccacaaataaacggttgtggcgactccgcgcattttcctcctttggaagacgcactcgtgagcctcgccttgctcacccgcaaaagggtaggttgcgacaccatgaagtcaggtttttactctcgttgtctggagacattcaagcccaacgacgcacaagattcttctctactgggcgggggggcgatcaagttcgatggcatggggaaatgtcgtggttgttccactttatcgctttcaagacactga

SEQ ID NO: 21921 - DNA, 390 bp, Glycine max
  Peptide Sequence Number=SeqID_113606
atgctttcagcagttatccgctccgcacttggctacccagcgtttaccgtgggcacgataactggcacaccagaggtgcgtccttcccggtcctctcgtactagggaaaggtcctggcacaaggttagaattctagctcttccagagtggtatctcactgatggctctggccccccccagaaggaggccttctttgccctccacctaagctgcgcaggaaaagcccaaagccaatcccaggaaacagtgaagcttcatagggtctttctgtccaggtgcagtcgcccgggcctggtcactgcgaccccctttgtgaggaggcaccccttctcccgaagttacggggctattttgccgagttccttagagagagttgtctcgcgcctctag

SEQ ID NO: 21922 - DNA, 342 bp, Glycine max
  Peptide Sequence Number=SeqID_113607
atgtcagccagtgatcatgccattctacgagacagaacccaccaacccatgaagaaaagcttgatagagctatcattacatgacgcgttattggcagagaacaagttgctttctaagcaacttgagattttaacagaaacacttggttgtaccatatgtggtgaggctcatgaaacaggccaatgtactcccactaaagaaaacactcaagaaatttattatatgagaaataaacagcaacaaggatatactcaaggaggatttttaggcttccagcagggtccatataatcaacaaggacagtggaggacacaccctggcaatcagttcaacaaagactag

SEQ ID NO: 21923 - DNA, 243 bp, Glycine max
  Peptide Sequence Number=SeqID_113608
atggcagtgcaggccaggcaagttttttatgttgaagatccgtctgaccctacttggtccgtggttatacaaggcagaaaatttgatatgatcgactatagtcattatccaccctttgatgtgactgatatgccacctgtcaatgaccaaatacctgtgattgaggccaccgaggaagatgatgttgaacatgcaatgagacatgaccatcatgaagggctatgggaaaataacgacacctaa

SEQ ID NO: 21924 - DNA, 453 bp, Glycine max
  Peptide Sequence Number=SeqID_113609
atgggtcagattctacaggaccaaaccttgtgggagttaaggaatgatggaagaaaagaaataaaaaaaaaatgggacaaaaggattgatcgcgaaaaagatttcttgttcttattagaagatcgtgattggatccacatatgtttgagtggcagtaagggtgacttatctgtcaacttttccactattacacccaaaaaaccaaactctgctttacgtaaagttgccagagtacgcttaacctctggatttgaaattactgcttatatacccggtattggccataatttacaagaacattctgtagtcttagtaagaggggggagggttaaagatttacccggtgtgagatatcacattgttcgaggaaccctagatgctgtcggagtaaaggatcgtcaacaagggcgttctagtgcgtgtagattcttatccaagacttgtatcatttga

SEQ ID NO: 21925 - DNA, 387 bp, Glycine max
  Peptide Sequence Number=SeqID_113610
atggcttctcgtaagagaaaagcaccaacttcagtgtcccaggctaggtatgataatcaaaatttgtatcccaagatgcctgggaccgctacgcagacaatgtctttggctggaggatccttccagaaaggaatgagagaaattgagaggaggaattggcataaggagctcactaacttctctgaagggagcattaacgtggcattagtgaaggaattctatgccaacctttatgaccttgaagataaatcaccaaagcaaacaccagtggtcatcgaggaagaggagagcttgccctcttactccaggttctgcaagttgaggccagattctcaagagcttgcagcccatctgatcgaggtcgtacctgaatcaaataaacattaa

SEQ ID NO: 21926 - DNA, 203 bp, Glycine max
  Peptide Sequence Number=SeqID_113611
cgtatggtgctcagttctctgatgacggtactgattatgcaaaagcatatgcagcagggaatgaaaaagttcaacaagcatggcttaacgtgatttatacgccagttaaaccaattgatttaggtgttgagtacgttaacggtaagcgtgatacttttgacgtgaagcatcataaaaagattgtagttgtccaagatgcttaa

SEQ ID NO: 21927 - DNA, 640 bp, Glycine max
  Peptide Sequence Number=SeqID_113612
gcaagccttccgcaaagtgtacggaaagattttagatttgaccacagcggaggtatttacgaaagccgctgtatccctcgcccaatactatgaccagctgttgagatgcttcacttttggggacttccaaatagtaccgactgttgaagaatttggggagattctaggatgccctcttgggggaagaaaaccgtatcttttctccgggtttcttccttccttgagcaagattgcagctgtggcaagggatatggcgagtcaagaagagtgggtcccgtttgcggatatacaagctttgctaatctttggggttgtcctctttccaaacgtggacggtttggtggacctagctgcaattgatgctttccttgcatatcaccatagcatggattgtctgttgtttacccattatttgtgtgtggttggtttcgcacctattccaacaagacataaggcacccgaaggaaaggagggagttctcttctcatgtggggactacccaaacgttccgttgatagggaccaggggttgtattaactataatcccgcacttgccataagacagttagggtaccccatgaggggagcaccaatggaagagagcctctcgcctttccttgtgagagatttcggcgccaaa

SEQ ID NO: 21928 - DNA, 204 bp, Glycine max
  Peptide Sequence Number=SeqID_113613
ttcttcaagggaaaggttgcggaggagcctcaactgtttgctgtttctggggctgttgttgttgttgctgctggattggtggaggaacgtatgatttgggttgaaccaggatttaaccaaggctctgagtttcttcaagcccatgctaatatcttcacttctgatgaagatgaacttcgtggcttacttcagtgcactccttaa

SEQ ID NO: 21929 - DNA, 394 bp, Glycine max
  Peptide Sequence Number=SeqID_113614
gggttgcaagagcctaagtgaagaacttcgtgactattatgaaggaaggcataggtcagatcttagaactcactcccatgggagagaaaaggaaagaaagcctcaagaggctaacattaacctctcatacttccatgggaaggacaatgtagaggctaacttagattgggaaataagggtagagcaacaacttaaaaggaagtctacttcaaaattttatggctctcactcttatccaaagaaagaccaaggccaaggcatcttaggggaacacattacttctcatgcccaccaagaaaaccatgattatgaggggccaaggacattttatagtagccaagatgaggctactacttcaccttcctctagtgaaagtaaagaagcaaaagggtaa

SEQ ID NO: 21930 - DNA, 643 bp, Glycine max
  Peptide Sequence Number=SeqID_113615
ggccgacgagtcgacgagagccattgcccaactgttatgcacactggggcaggatgctgcccggactgctgcagggaggcaggtgcggatcatgcgcaccagcatgaccaccttgacccagacgtggatgacattgctgctcagtaatgtcttgcctagcgatcataactccaatctccctctactgaagtgtatgccaccgaccaagcaccctctagacctggataagtctaacaggtccctggggtttccggcattgatcacgggcctctaccagtcattcggggttcccgtcacccctaacgcaccgccaccacctcatcaggccgatcccgttggatcactaggcatggagcgttatatacagcacttggttcgccagcaggcagccaaccaccgggggcaggtgcagatacataagtgtctctaccggttcagcctcagtcagcaggggcagggtttcgctccttttgcatgctctactccagagcagtttggggctgaggtcgcatggcctggagattggctcgaggcccaggcaggggaggagcccgcaggatcccccggtgcggcagaggaggcccgtatggatgaagaaatgacggacttgcttggtttcttgggaggaagcggagccacatga

SEQ ID NO: 21931 - DNA, 375 bp, Glycine max
  Peptide Sequence Number=SeqID_113616
atgggtgtggttatgggtgatactgaggaccctccaatgtgttttgcaggggtatatcaccaattgcttgcccttcagtggcatatccgaggcaagactccaagtcggctagattgtggtggggaatttcatgtgtctcccccatgggttgagagacataggaaaacgcaaggatcatgcatgagcaaacatgaaaacaaaagacaggagagcccgaaaaattatctcttcttgcttgcacattcggggatgcagtgccccatgtgtgtagttaagaaggtgatatggacctttcggcttcccgtgacaaaagacgagaccaacatacaacacatgcgtgatgacatgatgcagatgcgcaaagggatcctctag

SEQ ID NO: 21932 - DNA, 429 bp, Glycine max
  Peptide Sequence Number=SeqID_113617
atgaagcactattccactgctgtttccctttctcaccgattggaactcaagggaattcagcctgacttttttactttgaacattctcatgaattgtttctgtcatatgggtcaaatcaatttcggtttctctgtatccgccaagattctcaagaggggttccccgcctcacaccataaccttcacaacactcatcaaaggtctctgtcttaagggacaagtcaataaagcactgcactttcacgacaagctattagcacaaggaattaagttcgaccaagttagttatgggactttgatcaatggagtatgcaagataggagacacaagaggtgccatcaagttggtgagaaagattgatggacgactgactaaacctaacgtggaaatgtacaacacaattattgacgccctgtgcaaatatcaactt

SEQ ID NO: 21933 - DNA, 878 bp, Glycine max
  Peptide Sequence Number=SeqID_113618
aggaatcaacagaggaagaggatcaagccacagaggagacccctgcaccaagggcaccagaacctgctccaggtgacctcattgacctagaagaagtagaatctgatgaggaacccattgccaacaagttggcacctggcattgcagaaagactacaaagcagaaaggggaaaacccccattaagaggtctggacgaatcaaaactatggcacagaagaagagcactccaatcactcctaccacatccaggtggagcaaagttgcaatcccctccaagaagaggaaagaaatttcctcatctgattctgatgatgatgtcgaactagatgttctcgacatcaagagggccaagaaatcagggaaaaaggtgcctggaaatgtccctgatgccccattggacaacatttcattccactccattggcaatgttgaaaggtggaaatttgtatatcaacgcagacttgctttagaaagagaactgggaagagatgccttggattgcaaggagatcatggacctcatcaaggctgctggactgctgaaactgtcaccaatgtttgtcagaggaaaatgtattagattctcccctgctgtaatcaacaagtacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcctgcataggattggcactgccaactgggtacccaccaatcatacttccactgttgccacagggaaagctgctgcttcaggtgctgtgtccaaggatgatttgattgctgaactcaaggacacatgcaag

SEQ ID NO: 21934 - DNA, 312 bp, Glycine max
  Peptide Sequence Number=SeqID_113619
atgtaccctcccttgttctctttgaacaacctagtggatgtaccctccactagaactgatccacaagagatgtaccctctcttgttcttagtcaacaacccaagtagatttaccctctacttgtacaacaaaggatgtaccctccaatgtgttaagacaaagttctcaggcgagggtgatgaggacccactccctgatgtggactctctagaggatgtcatgtcagcatctgaggcagactctacgaaggagagcggccctggagggacagcgactagtggagactcttcatcatggcagacggctccttag

SEQ ID NO: 21935 - DNA, 412 bp, Glycine max
  Peptide Sequence Number=SeqID_113620
atggccacagctgaagccttggaacgagaaaccaagaaggcccgaaaggaagaacacgaccaaagaaaagttttgaggggctttatagggccagcaatagtgagctcaagctccgaagagttaagcgagactgaagggaatatgtgggccatcatcgatgagtgcaaagagaagctaaatctagcggcgactcacgagcaaaggctagaggatgagtacgccaagatatcaacagaaagggaagcaagggaaagggtaattgattcgttgcaccaagaggcaacaatgaggatggaccgatttgctcttactttgaacaggagtcaagaacttccccgattgctagccaaggccaaagcaatggcggacacctactccgcccccaaggagatccacagacttctcagctatt

SEQ ID NO: 21936 - DNA, 431 bp, Glycine max
  Peptide Sequence Number=SeqID_113621
atgacgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataagataccaggcgtttccccctggcggctccctcgtgcgctctctgttcctgcctttcggttaccg

SEQ ID NO: 21937 - DNA, 156 bp, Glycine max
  Peptide Sequence Number=SeqID_113622
atgtcaggtcttgatgccaggatggtggagcataagttgcctttaaagccaaaatgtcctccgattaagatggaagaagaagatagggagaaaaccgcatgcattacatcgtggggcacttttgatgcaatcctactccgcaagggcattggatag

SEQ ID NO: 21938 - DNA, 201 bp, Glycine max
  Peptide Sequence Number=SeqID_113623
atgacaagcaccgaccaagtttggtcattctgcacccatgatacgcggagataccttatggttattcgcacccattcttttgctatcttcttctgcaccttttgttcctccgggaacaacaaagtcatttacatgcggaaatttcatggtcgcccgcgactctcgtcaaccgagaggagcgaaattagtgtcatacactga

SEQ ID NO: 21939 - DNA, 473 bp, Glycine max
  Peptide Sequence Number=SeqID_113624
atgtgccctcctctagaaaaggtaaagagcaaaggtgctccaaaaaacccactgatcaaacaacaaaagtcaacaaaacgtgatctgtcttattgggagtatattgatgtgttacactttgtgcaaaatagtaattcttctgtgaaacgtaatgcatcatcattcgagcaaccaatacagagacaaaatattcgaatgttggatcaatttcatatgtgcatccaggattctattgaaaatattattgatgtcaaagcggatggtaactgtggttatcgaggaatagctgctgtcgcaacctacccttcaataggagggcgacaacagactcacgggtgcgtcttccaagaaaggaaaatgcgcgaagtcgccaccaacatttattcgaggaaaacttcggaaaaactggaaaaggtgtggtctacaaactttaagtgtgaaaggttcgggagttgtatttatgcacggggaag

SEQ ID NO: 21940 - DNA, 300 bp, Glycine max
  Peptide Sequence Number=SeqID_113625
atggtaatcgattaccagagagtaaaaactctttgttacaacaaccaaagtagatgtaccctctactcgtaccacaaaggatgtaccctccaatgtgttaagacaaagttctcaggcgggaagggaagaatcaaaagaattctcagactgtgtcattttgaattctttgaaaagggagaagagagacacaaaagaattcaggagaacaaagtttggaaaccagaaaactcagaaagcttttggcaaaggaagaagaaaaagaagttcaagaagatgttcaaagagattcaaaggttgtaa

SEQ ID NO: 21941 - DNA, 387 bp, Glycine max
  Peptide Sequence Number=SeqID_113626
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtccttgaagtcatgcgccggttaaggctaaactga

SEQ ID NO: 21942 - DNA, 650 bp, Glycine max
  Peptide Sequence Number=SeqID_113627
atggccgcctcgctggaggagtgcgacgcgatgatcgccgcacaaaaggccagcggcaaaatgctctccatcattgcccaaaaccgctttaccgatgccttctggcgcttaaaagcagcgctggattcggagcttgcgggcaaggtttgccacgcgcaggtggactccttctggtggcgcggacactgctactacgacctgtggtggcgcggcacctgggaaaaagagggcggcggctgcacgcttaaccacgcggttcaccacatcgacgctattcagtggatgctgggctttccgtccgaggtggtggcgatgatgaccaacgtggcgcacgacaacgctgaagtcgaagacctcagcgccgcgatcttcaaataccccagcggtgcgctcacccagcttaccgcctcggtcgtgcaccacggggaagatcagaaaatcattattcagggtgagaaggcgcgcatctccgcgccgtggcaggcctttgccagcgtcagcgccgacaatggcttcccgcaggaaacccacgaccagcagcgcgaagcgcagctcgacgcggtgtttaagcagacgccgaagctcgagtggacgctgcacgccgggcagattaatgacctgctttctgccatcgagcacggcacggcacc

SEQ ID NO: 21943 - DNA, 427 bp, Glycine max
  Peptide Sequence Number=SeqID_113628
ttggtgtatgccatcctgacacggatgagcgtcacgtcgcccaggtgattgctgacgccatctatttgtttgcaggtatgccagccaccaggcaccctctggacccggataagtctaacagggccctggggtttccggcattgatcactggccttttccagtcattcgggattcccgtcacccccagtaaggtgatccgaccaccgatcacccgagccttcatcgagaagtactgcacgcctaggcaggcgcaggatgatgcgcatcaagccgcagatgcaccgccaccacctcggcaggccgatcccgctggatcactaggcatggagcgggaggagcccgcaggatcccctggtgaggcagaggaggcccgtatggatgaagaaatgactgacttgctcggtttcttgggaggaagcggagccac

SEQ ID NO: 21944 - DNA, 144 bp, Glycine max
  Peptide Sequence Number=SeqID_113629
atgtctcctccacctctaaaaacctcacaatctctcaaaaaaactctttcaaagctcttcaagatgcctcctttggttttatatggaaatcctgtcagtggcctctcgctgagcgtcaatctcgcgcttagcgcgcatttgtga

SEQ ID NO: 21945 - DNA, 273 bp, Glycine max
  Peptide Sequence Number=SeqID_113630
atgctcaatggaacgccccggggcttctccatgacaagcacacgttgtgttcgagtcgtggggctcggagaaatggaggttgatgagccgtggctggggttgttgcaacgtgcccttcgcgggcgagcgaaggcgaggctcacgggtgcgctttccaaaggaggaaagatgcgcggagtcgccaccaacgtttatttgtggaaaacgtcggaaaaaccaaaggaaactggtcaaaatgaaaattctaagttcaggagttgtatatacgcttga

SEQ ID NO: 21946 - DNA, 753 bp, Glycine max
  Peptide Sequence Number=SeqID_113631
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatgccatctgcctgctgcgcaaaagctaccgtttcgcggcgcactccggcatcggtcagctggctgcggcggtcaacgccggcgaagcgcaggcggtcgaggcggcctttcaggcgggcttcagtgatatcgtgcgccagccgctcaacgatgccgaagcgtatcaggcgatgctgacgcagattgccgaaggctatcggccatttctccagctgattaatcagcgtgccgcaccggccgaggtgattgctgcgtttggccgatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 21947 - DNA, 242 bp, Glycine max
  Peptide Sequence Number=SeqID_113632
atgactagctcgccgcagatcgtcggcaaaaacaactttattttcccagagtggaaagctggcaggcgtcgatggaccacttcccctgcccctcattggcgtcccgcgctcgctaagctcacgcataggcttgagcgcagactggcgctacgaagtgtcgtcgacgagggcgcgagcgagcttaaacgcgttttcacgataagtgaacgaatggcttctaaaacggcgcgagcgatggagag

SEQ ID NO: 21948 - DNA, 617 bp, Glycine max
  Peptide Sequence Number=SeqID_113633
ttgttgagaaatttttgaagaaatacttccccgagtcaaagactgcagaagggaaggctgctatttcatcatttcaccagttccctgatgagtccttgagtgaagcattggagagaattcggggttgtaccatttgtggtgaggctcatgaattaggccattgtattcccattgaagaacacactcaggaagttcattacatgggaaatcaacaaggacaaggatacaaccaaggaggatttcaggtttccagcaagaggaccaccaaactggaggagacactagctcagtttacacaagtgaccatgtccaaccggaagagtattgagtcaaccctgaaaaaccttgagatccaggtgggtcaactggccaagcagttagctgagaagtcatctagcagctttggagcaaatactgagaataatcccaaagaagagtgtgaagcagttatgacaagaagcaggaagcttgtggcggctgaggataaggatgttgttgctttgaaggagcaatttgctttgaaggacactactgataaaaagaagaatgaggtagatggtcaacgtgttggtcttcctactgggcgactgatgctactaaagatgttctctacctaa

SEQ ID NO: 21949 - DNA, 213 bp, Glycine max
  Peptide Sequence Number=SeqID_113634
atgaagaaaaagtgtcccaagtatgccgcatggcgtgtgaagaaagataaatttcttactctagtttgttctgaagttaatttggcttttgtacctaaagatacttgggttgcctatggagccgactgccaagtgatgatgaaaggttcatctttatgggtgatggcaagaaggttgcagtggaagctattgaaacttttagattacagttaa

SEQ ID NO: 21950 - DNA, 672 bp, Glycine max
  Peptide Sequence Number=SeqID_113635
atggggagagtttatgagggatccactgttgttcataacactcctttgttgcctggccaagtaaaagtgagtgtggaggaggttagagatgcagatgctccagttcctgtacccactgatgaggtttccttagtggggcaggcacttcacaccttctttgcttggccaacacatatggtcaagtctttatcacaggtagttgtgtctccggcaaaactacctctgaagcccgatccggaggtcgatgatctgctttatcttatgacattgaccatcgcagagcttttcttgaggccttatcaggttagatgggatgccaccgtgttcggggtcgttaaatccagatttccccctgtacataaagcacaaagacctctccgaaatcgcacacagtggtcaatgtctcagcatatcagtgttacagttgtggattctagttcacaacacgatgtctatcttggagcctacctaaatgggttccactgcagcggacactggcagatggtggtcatcctgcccaaggaacacctagttgtctggttttgttcattgcataataggccagacaactaccttaaggggattattaatagtgctatcaagggtcttgatgatgctccacagcctaaatcaaaggcttctgctaggtggattgtcgtcaaggttgtttaa

SEQ ID NO: 21951 - DNA, 528 bp, Glycine max
  Peptide Sequence Number=SeqID_113636
atgttctgcgcggcgcaggccgggcaattgggccgtcgcgtgctgctgctggataacggcaagaaggcggggcgcaaaattctgatgtccggcggcggccgctgcaacttcactaatctgtacaccgaaccggcggcatatctgtcgcataatccgcacttctgcaaatcggcgctggcgcgttacacccagtgggatttcatcgatctggttaatcgtcacggcatcgcctggcacgagaaaactctcggccagctgttctgcgatgattcggcgcagcagattgttgatctgctgctgaaggagtgtgaagccggccaggtgacgctgcgactgcgcagcgaagtgctgagcgtggctcgcgacgacgacggttacacgctgcagctaaatggctcggcggttcgcgcggacaagctggtgatcgccagcggtggtctgtcgatgccgggactgggagcaacgccgttcggatataaggtggcggaacagtttggcctgcgcgtccatgcgacgcgcgccgcgctg

SEQ ID NO: 21952 - DNA, 264 bp, Glycine max
  Peptide Sequence Number=SeqID_113637
atgcggagacaaaatttggtcattccgcacccctttgccattcaaacacagtcgtgtccgatggcacgcagagacaaaatttggtcattctgcacccttttgtcatccagaggcggcgggcccgatgacatgcggagacaaaatttgatcattctgcacccctttgccattcagacacagtcgtgtccgatgagacaaaatttggtcattctgcaccctttgtcatccagaggcggcgggccgatgacatgcgcagaggtttga

SEQ ID NO: 21953 - DNA, 414 bp, Glycine max
  Peptide Sequence Number=SeqID_113638
atgaagtgctttaaatgtcttggaagaggacacattacttctcaatgccccaccaagaaaaccatgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtaaggaggtaagtgtctcctccaagagtgatcaacgggttcccatgaaccctaagagaataaaggtcattcctgagtggctcactccaccaagtgttgagggaaggagcccagagtatgaagaacctcgggatttgaggtcaaatcctttccaaggtggagggaatgatgcaatcctaccccgcaagggcattggctag

SEQ ID NO: 21954 - DNA, 297 bp, Glycine max
  Peptide Sequence Number=SeqID_113639
atgtttcaaaagaaaatatgcaaaatattcaaaagaaaggcaaaatggtcacttttggggcatttttcagcccctgggcccactaggaagcttagggatgaagtaaccagctcgcctgggcgagttaggttacttctggaggaagcaagcagctcgcctgggcgagctgctgtgcatgagggggctaaggagaagggtccaacacctgaaatcaagaggttttcagtgaaattagtgagaaaaaggagaaagaagaagaaaaatcaaggtcgaggcgcttccgtaacgtttccgtga

SEQ ID NO: 21955 - DNA, 543 bp, Glycine max
  Peptide Sequence Number=SeqID_113640
atgaccaccctgactcagatctggatgactttgctgctcagcaacatccagcccagcgatcataattccgacctccccctgccgaagtgtcaactggtgtacgccatcctgacacggatgagcattcacgtggctcagttaatcgctgatgccatctatctatttgcaggtatggcgcctaccaggcaccttctggacccggataagtccaacagggccctgggatttcctgctttgatcacaggactcttccagtcgttcggagtccccgtcgcacctagcaaggcggccaaccaccgggcgcatgtacagacccatgattgtctttaccagttgagcctcagcctgcagagccagggttttacttcttttccgtgccctactccggatcagtttagggcagaggtcgcatggcctggagattggcctgaggcccgggcaggagaggcaccagcagaggctcccgatgaggcagatgaggcccacgaggacgaggagatgactgatttgcttgatttcttgggagggagcggagccacatga

SEQ ID NO: 21956 - DNA, 264 bp, Glycine max
  Peptide Sequence Number=SeqID_113641
atggcgactccttgcgttttcctcccttggaagacgcacccggaccattgtttgatggcctgcaacctttgcttgaccgcttcgaggtacttaacacccattgtaagattcttcaccgttcttcaccgttcttcatcgttctttgttcgttcttcgtcgttcttctgtcttcaaccgataaatggcagcggaatggagaaggaagagagagaggagacgccacttcaaggagaagatgagtctagaagaagctcaccaccatag

SEQ ID NO: 21957 - DNA, 236 bp, Glycine max
  Peptide Sequence Number=SeqID_113642
agcctcctgagtcctctcctgtccttcttctacacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaagctgcaccg

SEQ ID NO: 21958 - DNA, 312 bp, Glycine max
  Peptide Sequence Number=SeqID_113643
atggcacgtaacgtgtttgctccatgcccctatttaaagggacctatatgggagggaactaaaagggcttttagtgataattcccaaggtggtcatatctctcttgatgcggagtcgccaactgtcgcaacctacccttcggcgggagggcgacacgtgactcgcgggatgcgtgttccacaaaaggaatacgcgcggagtcgccaccaacatttatttgaggaaaacgtcggaaaaaccggaaaagacgcgatctacgaacttttaagtgaaaggctcgggagttgtatttacgcgcggggaaggtattag

SEQ ID NO: 21959 - DNA, 339 bp, Glycine max
  Peptide Sequence Number=SeqID_113644
atgggtgaagtaaaggaggtgcaagagcagatgaaggccaacatggaggccatgaaagagcaaatggccacaatgatggaggccatgataagcatgaagaagataatggaagccaatgcggttacaattgccactaccagcactgttgctaaggtgaacccgacgccccatctgcgcaaagatttgggaagtacgggcggcccccatgatgtgcaaattcaaaacgagcacgctttcccgccatatggcttgcctctcaactatacgccacccaatgtggcgtacactcctaatgagaatgtcaataaagccactcctatactcgttgagagccaataa

SEQ ID NO: 21960 - DNA, 294 bp, Glycine max
  Peptide Sequence Number=SeqID_113645
atgttccatttgttgtctatatttttcaacactcatactccattgtctaagcctttggagcttgtccataagctctctttcatagtaggagggaatgtgcctcttcctgagggcactcttaagatcattccaatactatactcgaggatccccatgaatccttcgttccctaacaagggaagcccgccaatagagagcatacccttgaaagctaagggtagccaatggaacttttctcccttcgctaatatgatggcaggcaaagagttgttcaacctttatttcccaatctaa

SEQ ID NO: 21961 - DNA, 339 bp, Glycine max
  Peptide Sequence Number=SeqID_113646
atgccagctaactttgcagacctcatcttcgccggagaaagaattgagtccggactgagaaaagacaagtttgagtatgcctccaacgttgcccccaacaacaatagaagagcccccagtggtgggcacacggaaaaaggaaggagatacccacgcggtcagcaccgccccaacatggatgaaagcgccccaaaatgcccaaaactcataccagcacaaccatccgaacttttcgatccgagccagaagttccctcccaactcaagtggaagggtctcccgcaacagaaaaaacgtctgcccaacacacagctccagcccctccccggccagccgataa

SEQ ID NO: 21962 - DNA, 405 bp, Glycine max
  Peptide Sequence Number=SeqID_113647
atgggacctctccaaaggcaagccttccgcaaagtgtatagaaagattctagatttgaccgcagcggaggtatttacggaagtcgtcgtatccctcgcccaatactatgaccagccattgaggtgcttcacgtttggggacttccaaatggtaccgactattgaagagtttgaggaaatattaggatgccctcttggggggagaaaaccgtatcttttctctgggtttcttccctccttgagcaagattgtagctgtggtcggggatttggcaaaagagttggatcgcatgaagcaaactcgcaacggcgtagtaggcttgccacgaaaatacttggaaggcaaggcaagggatatggcgagccaagagaagtggggcccgtttgcggatatattagcttgttga

SEQ ID NO: 21963 - DNA, 416 bp, Glycine max
  Peptide Sequence Number=SeqID_113648
agcatcaacattcactttcgagcgtctcgatatattacgggactcaatcgaacatccgagtaaaaagttattgtcgtttgaatttgctcagagcttcgagcttcaacattcaatttcgagcgtctcaatatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgg

SEQ ID NO: 21964 - DNA, 250 bp, Glycine max
  Peptide Sequence Number=SeqID_113649
gattaccttatggttacccgtacctttcatcaaccagggggcaaacgagctcattaatgtgaagagactgacatcgtcatctgcaccttttgtcatccagggacagtttttactctcgtcgtccggaaacattcaagcccaacaacgcgcgagattcttcactgctgggcagagacgatcgggtgcaatggcgaaggaaagtgtcgtggttgtccaactttgtcgttttcaagacactaaagtttgttga

SEQ ID NO: 21965 - DNA, 459 bp, Glycine max
  Peptide Sequence Number=SeqID_113650
atgaccggacacgattggccattggattttttgtttcctacttacaggtacatagggacggatgcaagtggggatagggtcaagaccgaccgatcgttgccccttcccgacgctaaacaagcagagaacgtcgctgcaaggcagcccaagatggccccgaggaaacttgcctcaaagagatccaggaaggataaagcggccgaaggaaccagttccgctcccgagtatgacagtcaccgctttaggagcgctgaacaccagcagcgcttcgaggccatcaagggatggtcatttctccgggagcgacgcgtccagctcagggatgatgagtataccgatttccaggaggagatagttcgccggcggtgggcatcactagttacccccatggccaagttcgatccagacatagtcctcgaattttatgccaatgcttggcctacagaggagggcgtgtga

SEQ ID NO: 21966 - DNA, 302 bp, Glycine max
  Peptide Sequence Number=SeqID_113651
gcggattagccctacgagacgccttgaagcgcaattcccatcgagcggcgggtagaatcctttgcagacgacttaaatacgcgacggggtattgtaagtggcagagtggcccttgctgccacgatccactgagattcagcccttgtcgctttgattcgtccctcccctccaaatcaccaacaaaccctgtcccccccaaaaaaccaatcaatccggtatccctttcttcttctactatgtttggccaaaagaggctaccgttcgtcggctctctctcgttttgcctgcctggtgctaactag

SEQ ID NO: 21967 - DNA, 193 bp, Glycine max
  Peptide Sequence Number=SeqID_113652
atggaaccagctacagaggagttgattaacaaaacacaactctctcccaaaataatcccaacgtcatcacgtcggctcgatggctccacaaaagaatttcacttctcgtactctattgctgtcattctgctcccacgactaaaggttcgtgatcatcataggtaccaaccacacggtacaaaaattgcgaggg

SEQ ID NO: 21968 - DNA, 804 bp, Glycine max
  Peptide Sequence Number=SeqID_113653
atggcacaacctccaccccgtgagaggactctaagggaaatggctgcacctgatttcacctacgaaagcttatgcatccaataccctgataaggatgtcccatatgttcttaaaactggactgattcatttgcttccaaagtttcatggtctagcaggtgaagacctgcacaaacatttgaaggaatttcatattgtctactccaccatgaaacccccagatgtccaagaggaccggggatttctgaaggctttccctcatgggggtagagggagtagcaaaggactggctgtattaccttgctccaagacctttgcccttccatgcagcaacctggagcaattgagcagcctgaaagcttatgctgcaaatatttacaatagacctcctcaacctcagcagcaaaatcaaccacaacaaaacaattatgatctctccagcaatagatacaaccctggatggaggaatcaccctaacctcagatggtccagccctcagcaacaacaacagcagcctgctccttccttccaaaatgctgctggcccaagcagaccatacattcctccaccaatccaacaacagcaacaaccccagaaacagccaacagttgaggcccctccacaaccttccctcgaagaacttgtgaggcaaatgactatgcagaacatgcagtttcagcaagagaccagagcctccattcagagcttaaccaatcagatgggacaattggctacccaattgaatcaaaaacagtcccagaattctgacaagctgccttctcaagctgtccaaaatcccaaaaat

SEQ ID NO: 21969 - DNA, 465 bp, Glycine max
  Peptide Sequence Number=SeqID_113654
atggatgattataagtctttgcaaattgagtttgaaaatttcaaaaaggatcactatgaagaacatatggagttgcaaactgagctttcctatcttaaagatctttttagaaaattgaacaaaggaaagagtgatcttcatcacttgctcagtgtgcaaaagcatactaccgataagactggtttggggtatgacaagcaaactactttttctaataaaactgagtttgcatcctccaaaagggtgaaccaaaacaagatctccaaaaataagaacatagtgcattctaagcctaatgcaaagacctatcattattgcatgaaaagaggacatacatcttataaatgctatgttaggagatttgacattcctaaaggcaaatgtgtttggattcctaaagatttaattgtggaaattaaccctattggacccaacctaaatttggtatcacctctctctaattga

SEQ ID NO: 21970 - DNA, 382 bp, Glycine max
  Peptide Sequence Number=SeqID_113655
atgggtgaagtagagaggtgcaaaagcaaagatttgggaagcacgggcggcccccattatgcgcaaagtcaaaacaagcatgccttcccaccatatggcttgcctcccaactatacaccacccaatgtagcgtacactcccagtgagaatgtcaacaactccactcccatactcattgagagccgacaaccccaaactgatcatgcgcatgtctctcaacccatgggtgatacatatgaaatgccccaccacaatctagccgacttcgagccttgcctcggatatgccactgaagggcaggcaattggtggtatacccctacaaaaccctttggagggccctcagtatcacccccagctacacctcttgcattccacaacaa

SEQ ID NO: 21971 - DNA, 210 bp, Glycine max
  Peptide Sequence Number=SeqID_113656
atgggtgccaagcacctcacaaggaccaaagaaaggtcgcatgtcatcaagcaaaggtccccggacgaaattagggaaagtgtttgtggaagcaatgtttcccaagtttattttgatgatgccaaagactcaagtcaagaatcaagagtcaagcaagtttcaagaataaaagagtcgttcaatcaaagcaagttcaagaatcaagattaa

SEQ ID NO: 21972 - DNA, 459 bp, Glycine max
  Peptide Sequence Number=SeqID_113657
tgtgcggcagctgggattcagctgctgatagccgtcggcgcgctgcactttggcgcgttcgtctttctggaactcgctgcgcagcagcgggtagtcgctcgggtgcagctcggtcaggtgaattttgtcctgcgggcgcagcagctggcgggcgatcagcggcgagccgggatagtagcgcagcgtgccggaacggttgaagttgtgtaccacgctcatgtaggccgccagctcttccggcagatcgtcgcgctgccacagcaagccgatgccttccaggtattcgccggtgcgctcggcgtgttcgccgctgagctgataacggcctgcgcccgagtgggtatccagatacaggaatggcttctctttttccttcagcgactcgatgatcaggctctgaacggtgtgtttgagcacgtcggcgtggttgccggcgtggaaactgtggcgataacttaa

SEQ ID NO: 21973 - DNA, 672 bp, Glycine max
  Peptide Sequence Number=SeqID_113658
gaaaagaaggtttttctggaaaaactcaagaagaccttagaagtcaaacctagacaaaaagattttattacaaacaacaagtttgatgtaagtaacatactcaagagattggaaaactcttcaaccaaaccaacgactatccaggatctccaaacagaaataaacaatctaaaaagagaagtaaaagaacttcgtcaacaacaagaaattcatcagatcattctttctcaacttgaggaagaaagtgattctgaaaacaccaacagtgaagaaaatcaaccagaaaatctagaagacgatatgtttatgggattaatcaacaagattaaaatccaaaaaatttacataaacataaaaataattcttaatgattttgttctagaaacaatggccctattcgacacaggggctgactcaaactgtattttagaaggattaattcctacaaaattctttaagaaaacctcagagaaacttagtacaacaaacgactcaaaattaaaaattaactttaagttatcaaatgcaattattgaaaaccaaggtcttaggattaacacaaactttcttctggtaaaaaaccttaagaacgaagtaatcctaggaactcccttcataagagctttatttcccatccaaatatctaatgaaggaataagtgggatcctctag

SEQ ID NO: 21974 - DNA, 297 bp, Glycine max
  Peptide Sequence Number=SeqID_113659
atggaacacttaaatagattaatatcgaaagatttagttgttggtttgccaaaactaagatttgaaaaagaaaggctagaactcaaagtacttcctgggattacaaatcaagcaatatcaagaaggtgtattcatcatcaagccaagtactacgaggatattgatcaaaagattgtaggaaaggaaaaacacatggctaccaatagactagcgggtgttctgaaaacatatgatgggagatgcatcaaagttcacacatatctctcccaagaaaagcgggcatgtaacctatggtga

SEQ ID NO: 21975 - DNA, 243 bp, Glycine max
  Peptide Sequence Number=SeqID_113660
atggttctgaagcgtgatgtgacatccgagaaagaaggtgtgaatgcaccaccaattcttgggacactattgaatactggaaagattcaagatacagacagtgcttctaaatcacttttgatgagcattgacatcctgagaaagactatgcatcaaaagtggaagcatccttcacaagaagctggacaacgaagaaaggtcattgagatcgaagcgagaagagatggactaaagaggagatag

SEQ ID NO: 21976 - DNA, 171 bp, Glycine max
  Peptide Sequence Number=SeqID_113661
atggaaaatgattccaagaagactctccaactcttagatgctacaaaaagaagatccaagaaggtgtatattgcatgggatgacaatgactcatctgatggttcggagaaggagatcaaccttctatccaaggactatgagagcgatgagaacatctctcaagaagattaa

SEQ ID NO: 21977 - DNA, 405 bp, Glycine max
  Peptide Sequence Number=SeqID_113662
atgatgagcgtgaagaagataatggaagccaatgcggttgcaattgccgctaccagcgttgttgctaaggtgaacccgacgtccccatccggcctcaagcaaatgaatcatccaacctcaaatatggtaggcaaagatttaggaagtacgggcggcccccatgatgtgcaaattcaaaacgagcacgccttcccgtcatatggcttgcctcccaactatacaccacccaatgtggcatacactctcaatgaaaatctcaataactccactccgatactcattgagaaccaaaacctcatcaggcacatatctctcaaaccaaaaagggagagacacatgaaattccccaccacaattctagtgttcgatgtgttaggctaccacgagcaagcagttgggtcataa

SEQ ID NO: 21978 - DNA, 384 bp, Glycine max
  Peptide Sequence Number=SeqID_113663
atgggtcaacttcaacggcaagccttccgcaaagcctatgcgatcgacgtttttctcgcctatcataaccacaaggaaagtccggttgtcgctatgctagccgacctatatgacacctttgaccgaagatgtgaagaaagcaatgcaaggattgtttgttgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaattggttccctcgctagaaggaaggaagaatcaagattctatcttcatgcgaaggatgtccaaatgttcccttga

SEQ ID NO: 21979 - DNA, 324 bp, Glycine max
  Peptide Sequence Number=SeqID_113664
atggcagcaaattatcaacattttggtactagagttgttgaaccatccaggactttttcaagtgcagagaggctggagaataaacttatagagttgacatcccttgtaaggcagctagccattggtcaacaacagaatgtgatgacaaccaatcaaccaaggttatatggtatatgttatgctcttgatcatccaatagatgcatgttccacactccaggaaatagaacaagttgttgatgtttctgccatgcaacctagacaaccattcagacctcaacaacaacaatacaatgcttactccaaaacctacaatcttggttag

SEQ ID NO: 21980 - DNA, 318 bp, Glycine max
  Peptide Sequence Number=SeqID_113665
atgtcctgtaactttatggatttcatggcaacgggtattaaacattttgaagtggtcaaacggaggtcgcatgtcgacaaacaacagtccccgaacgaaattaggagaaggtcttcttggttgcaaatactgaatacaagggaacaacgttccttgagttcattgcaagaagcaggatttgcttcttggttgatcactagacacaaaagaccaacgtctttcgggttcattgcaagaagtgggtataacttcttggttgttatcactagacacaagggaccaacgttccttggggttcattgcaagaaacgggaataa

SEQ ID NO: 21981 - DNA, 1623 bp, Glycine max
  Peptide Sequence Number=SeqID_113666
atggctcattcatctcataaactctttttccttctgctttcaatcttcttctcacacacctgtgctgtaaactcttccaatgcttccacaacacttcataccaatctctcttccttaaaatctttctgcacaaccactccatacccagaagtttgttccaattcattgaagctatccatctcaataaacataagtccaaacataatcaactacctccttcagtccctccaagtagcaatatctgaaaccacaaagctctcaaatctcttccacaacgttggacactcaaacatcatagagaagcaaagaggagctgttcaagactgcagggaactccaccaatccacattagcttctttgaaaagatcactatcagggatccgttcctccaactccaagaacatagttgatgcaagagcttacctcagtgcagcactcaccaacaagaacacatgtctagaaggactagattctgcttctggaataatgaagccatctctggtgaaatctgtgatcgacacttacaagcatgtcagtaactctctttcaatgctccctaagccagagatgggggcacccaatgcgaaaaagaataacaagcctttgatgaatgctccaaagtgggcatcaagcagtgaccaaaggctctttgaagactcagatggggaaaattatgacccaaatgaaatgcttgttgtggctgcagatggaactgggaactttagcaccatcactgaagccatcaactttgctccgaataacagcatggataggatagtcatctatgtcaaagaagggatttacgaggaaaatatagaaatcccaagctataagaccaacattatgatgcttggcgatggaagtgatgtgactttcataactggtaacagaagcgtcggtgatggctggaccactttcagatctgcaactctagctgtctttggtgatggttttctggcacgtgatattgcgattgaaaacagcgcagggccagagaagcatcaagcagtggccttgagggtaaatgcagacctaacagctttctacaggtgtgcaatttatggctaccaagacactctatatgtccactcctttagacaattctatagagagtgtgacatttatggtaccattgattacatatttggaaatgcagcagtgattctacaagaatgtaacatcatatcaagaaaaccaatgcctggtcaattcacagtaatcactgcacaatctagagatagcccagatgaggacactggtatctcattccaaaattgctcaatcatagcaactcttgatctctattccaactctagcagcttcaagagctaccttgggaggccatggagggtgtattctcgcactgtttaccttgagtcctacattgatgacttcattgacgcaaagggttggacaaagtggtctaatgagcaaggattgaacactttgtattacggagagtatgacaactatggacctggttccggcacagagaagcgtgtgcaatggtttgggtaccatttgatggattatggtgatgcctataatttcacagtttcgcagttcatcaatggagatggttggcttgatactacgtccgttccttatgatgatgggatttga

SEQ ID NO: 21982 - DNA, 345 bp, Glycine max
  Peptide Sequence Number=SeqID_113667
atggcttctccacctgcctctcctcctcttcctcctcctcctcctcctccttccgacgcatcggttttgccatcttttgtgaatcggacactcaaagcctcacgtctacgatccttgtctactagaccacctggtgctgagagaccagtggtccatgttgatcctgctaccagcaaggccaacggtccccataggaagaaattaaggacatatttggggattgtggcgcgtgataaggtggatgtcacgtatgagaactggaaggaggtccctactgctcagaaggacttgatttgggaggatattcaggcatttttctttttttatttgatgttctttaattaa

SEQ ID NO: 21983 - DNA, 1068 bp, Glycine max
  misc_feature (7)..(7): n is a, c, g, or t
  Peptide Sequence Number=SeqID_113668
atgactntgatactcaaacagtacataaccctcaaagctctaagccaccttgcaagcaaaagaggttgtccaatgttgaaggaaattctctcatgtcaagggagattttctgatgtcgaggttaatagccttgttaacgtgttcgccaccgttgccacatccttgttgagtgccagtgtggaggccactaatgctattgtgatgccgcctcctcctacttcggctccatcgattccactttcttccgtgttggcggcgacactaccttccttgtcatctcatcccatgtctccttgtatcacctgtactcctccaacgaagctgattcactatgggggaatagaaaatattatcaagggtagaccttgcataccaaaggtgaacctagggtttaacgagcctaagatcggagtcctatttgccctgggctttgataagcctatagagctgcatcgaggtttaccaaagatgaaccttaggttttgtgaacctgtgaaactcaccaagaaaggaccttttgacaagcctgcgcgtactggaaatgcggtgtcgtgcttttgcatacgtgtcactcgtggagtggcatgtactgaagatgtggtggtgtgctcttgcatatgtaatactcatggaatggtatgtaccaacgatacgatggcgtgctcttacatacatctcactcatggaacaacacttactggagacgtggtagcatgctcttgcatacgtctcactcgtggagtggcatgtactagaaacatgagactcaccaaggatggactttgggtttacgagcctagcacatgtgccatgctcttgcatgcctgtaactcatggagtggcacgtactggagacgtgatgagtttggagaattaaccaaggcagaccttgggtttgatgaacctagcacatgtgtcatgctcttgcatacctgtcactcgtggagtggcacgtactggattcatggtgcgtttggagaattgaccagggaattgtccgtcttgggttttggagagacttaccaaagttggaccttggatttgatgagcctagcgcacatttcgtaa

SEQ ID NO: 21984 - DNA, 429 bp, Glycine max
  Peptide Sequence Number=SeqID_113669
atgaatgacttggtgttgagtcttaagaatccagggataaaggtgaaagatattgtggctgagtattctaaacaactaaaagcgttaggtgccacgatctttgagctactgtcaaaggctcttggccttaatccttcctaccttgaagaaatggattgcactaaagcactttatgttatgggtcagtactatcctgaattccctgaacctgaattaactcttggaatttcaaaccacactgattgtgacttcataacaatacttttgcaagatcagataggtggtcttcaagttcttcatgagaatcattgggttaatgtttctccagtgcaaggagctcttgttgtaaacattggagatattctgcatataacttctgaaattgtttactatgtttttttacaaaagataaatggccttgagatatga

SEQ ID NO: 21985 - DNA, 339 bp, Glycine max
  Peptide Sequence Number=SeqID_113670
atgcatgatgaaggactacaaccatctcctcaatcatataaattcacaccacaacaacattatcatcaagattatggctacaatctgcatttctacagtgctcgtagagaagactttttgagcaacctcataggtatagatcttctaacactagaaaacatacatgcaaagtatgtccatatttttgtttgcatcctttcaccaaactattatcggcagttcttcaacaagaacatagacaggcattctccagataaaacccttgccttgttgcacaaaccaagaaaaccaaaaattatcgatgagatcactggtctaatgcatgatgaatctgtgtag

SEQ ID NO: 21986 - DNA, 192 bp, Glycine max
  Peptide Sequence Number=SeqID_113671
atggcgccccactcacctcttcttcctccttgctctccgataacgacgacctcttccactcgccgcaaactgacctccgcgacaactcccgcatcatcgtcatcgtcaagacaacatcagctcagtgctctgctccagccagaactcgctgctccaggtgcaaaaattgttagatattggcaattcttttaa

SEQ ID NO: 21987 - DNA, 162 bp, Glycine max
  Peptide Sequence Number=SeqID_113672
atggctgtggaaatgggaactggggtcccttgggtgatgtgcaaggaagacgatgccccagatcaagtgaagtgtagggtgaattcaagctttggaccttttaaccatgaggggaaggtgcagcattgggaagtgactgagatgggttgggagagatggtag

SEQ ID NO: 21988 - DNA, 342 bp, Glycine max
  Peptide Sequence Number=SeqID_113673
atgtgggagaccagtcagggtcacagtgttttgcgagaatgctccaaccatatgggatcaacatatataggctcaaaggagcactcaaaccgggtgacccccaaggcctacactccgaagagtccgtcaggacctctccctcctgattcaggaaaaagctacgatgcgaagggtatttctctcaactccgatattatttcaaaattcccaatggggaggatgctcggaattgagttacgaacctggtgcttaaatttcacgatgatccaacggagaatgagtttgaaatcgtcgttttctgagacaggtttggtggtctgcggtaaaaagagaggattttga

SEQ ID NO: 21989 - DNA, 168 bp, Glycine max
  Peptide Sequence Number=SeqID_113674
atggtgtgtcttccaaaaaggaaaacacatgggagtcgccaccaacgtttattcaaggaaaacattagaaaaaatcgaaaagaggaaatgagggcacctggtggacttgcaactcgcccaagcgagctggagctcgcccaggcgagttgttacttcaccttgaagtaa

SEQ ID NO: 21990 - DNA, 471 bp, Glycine max
  Peptide Sequence Number=SeqID_113675
atgggggagaagcttgccacccagctcgcccaggcgagcttagcttgcccaggcgagcaaggttgcttcctccagaagcaacagccttctggaggaaggagctggaaggcccaacaacattctgcccagcgactacaatgccaatctccccctgcagatgtatcagttggtctgtgccgtcaagacatagggatcgcgcccacaagacgcccagtggacccaaagaagtccaacagggccctggggtttacagctctggttgcgggcctctgtcagtcctacagggtgcccgttcccccagcgaggtcatgccatcgtgacatagggatcgcgcccgcaagacacccagtggacccagcctggggatggccggtagcgggcaacagacgcaccgccatcacctctagagttcacctcagctcatccacaaaaaggttagagcgttgcttacgacccatggccgaccaatag

SEQ ID NO: 21991 - DNA, 1290 bp, Glycine max
  Peptide Sequence Number=SeqID_113676
atggcaacacccccaggatcccctcaacattcagatatgcctttggaggctacatctaggaagactagacaatcgacccagttgagaacgcgtgaaaaaattcctattatccactccaattggaatgatgtaccagaatctttaaaaaacctagcttgggatgacattttgggaaaatttgacatccctgaaggtgataaggctaaaaagaaggtgatgtcaacggttgctaccagatgcaggcaatttaagtcatctctaatgacaaaatatgtttatgctgacaatgacgataataaaaaagatgatccttctgttaagtatggtattgatgcaacaacatgggcaaaatttgcaaaaagccgccaaacccctacctgggaatatggaaaaaggatcgggaaattcaaaaatacaattactacaccacttactgtctcgtggggcacggttattggccggccagagcatccaggtcacgtacgtgaggaacagttgagaaaagaagtagaggaagaaaacaaaacttacaagaagcgtggaggaggaagcaccaaggggagttgtgctgaagttgacacaattccatcagctaaagagccttttgatgtgcacgtggatactatgggctttgcatccaccatacacaatgtcccttatgcagatgatgtggttagggtgagtgttgtcaaagtttaccacagtgacgctcaggtcccttttttgacatcagagattcaatttgtgaggcaggtcattgagacattcgttggggttacatctgcaggaatggacatttcagtgcttgcagttgatccattgggagaattggttaagaacctttttgatgtttaccaaaagcctattgagttgccatgggatggggcaaaatttgggatacctaatgtcaaagagggttttttcatcacacacgcaaatgtaaccgagataattttaggtgacaaatgtttgaacatatccatacgacagttgtggacgatggcacattggcaacttactgttctatgtccatgggacaatattgttgtttggttatgttctctacgtaagaagcctgatgttaacatcaagggtgaaattaatagtgcaatgaagacattaaccagtagtttggaaggaaagggagatcaagttgtacctcgatggattgaaccaaagcaacaagggattctaggtgctcagctagtggcaccaacaactggtttgaggccaccagttcatggaagttctacccaggctgatggcactcaacaacacaatcagcaatag

SEQ ID NO: 21992 - DNA, 117 bp, Glycine max
  Peptide Sequence Number=SeqID_113677
atgaaggttttgaggtttaggaatggaggaacggtgcaaggaagaaggagctgcgtaagagattctaaaaacgtgatatttataaagcaggatgcgtggccatctgttctagtgtaa

SEQ ID NO: 21993 - DNA, 99 bp, Glycine max
  Peptide Sequence Number=SeqID_113678
atggaaatcctagcagaacaatcaaaggaaaaacttgaggagtctcatggaaccgctagagatgccgttatcactattggactacactcggatccttaa

SEQ ID NO: 21994 - DNA, 135 bp, Glycine max
  Peptide Sequence Number=SeqID_113679
atgctgaaaaagggttttgctctgctccttcagaatcaaaatcaaagcctctttattggaaagtcgatagcccgcactctctcctatccatcttcaaggaagaaaacaaagactgctggtggttatgttggttaa

SEQ ID NO: 21995 - DNA, 201 bp, Glycine max
  Peptide Sequence Number=SeqID_113680
atgggggttgtcatggcaccttttctgatcaaaattctagatgtggtagcagtggttccaacagaggtcgtggaggtggccgttcctccaatacttgggttaatcccaatgctaagtccaccgttccaagtcccaatcagcccagggccatgctcacaaactcctcctctcatggtaatggtgcatttagctccactttga

SEQ ID NO: 21996 - DNA, 609 bp, Glycine max
  Peptide Sequence Number=SeqID_113681
atggtccaagagtgggtcgtgacacaaggagaggtttgtgcttatggactttattcttttcacaacctcaagcttcaaggaaacctttctctgttgatgttcacttctgcatctattccaaatgttgagtttcctacttcagctgctactgtcaataatagctccaatattgtttcaaattctgatgttacctcttccagtagtgctaatgtttggcatgctaggttaggacttcctaatgatcatgattatgcctttactacagttgtttatctaattagcaggcttgccactgcttctctcaagtttgttgttccttttgatactttgtttaataaagagcttgattatcattatcttagaatttttggcataagtcctaacctttctccatcttttattgcctctattcctcaaacatctcaagcatcacctgttaattcaagctttgcgcctcccgttcctccaggtgctgatgtttttcatgatccttctctctataagtctgtaattggtgcattacaatatgctactctcactagacctgaaattagttttattgtcaataagatttgccaatttatggctgctcctttggattctcactag

SEQ ID NO: 21997 - DNA, 105 bp, Glycine max
  Peptide Sequence Number=SeqID_113682
atgaaggaaaatggatttgaaaaggtgaagcttttcgagcttgaacatgaggcaatgaaggctcttgcaaattctgatatccagacaaagaaacatgtcacctga

SEQ ID NO: 21998 - DNA, 582 bp, Glycine max
  Peptide Sequence Number=SeqID_113683
atggcggaaccatcaaagaagcgcaagggttcttcgagtagaagccaacgacactccgaggctcaggatactccaattccttcctccatttcctcatcctcattgttctcatcagaaaaagaacgaatacagtacacaaacctcttctcctctcgttctatcattgactctaagttcatagatatggatttcttttctgatgagagtttcgaatgcattcaagcatttcaaaactcaaatctcattccctttatgtctctaaaattgcatgtgtattctgaattggtctatgggacaaagatggtcattgaccaatccctcttctatgatttgactcaattatctagcgaaggtgtaccatttgaaggtacactggatgatgattggaaatttgatttttctatgcatgatgcccaccggttcgatggactccaaacctatgttggtgaaaggtttgatgctttggaacgacaagtggacatgcgattcgatacaatggactcaaggatcacaaaggttgaagaagatgtcaccatcattcgcgactgccttgatttacctccaccaccaccatcagtttaa

SEQ ID NO: 21999 - DNA, 249 bp, Glycine max
  Peptide Sequence Number=SeqID_113684
atgtcgagaaggtggtcagggatgaagtgctcgatgagcttgctggttttgaagggggagagcttgaaggggtcaaaaagagtcgttgttgttgagaacgagagagccagaatcactactaaaaaatatacatttaacatcgctaggtcattgccattgtctttgaacaagcttcgttggtttccttgcaagcattccattggcacgaaagcagtctttgctcgttattgtactcgcaatctcaagtaa

SEQ ID NO: 22000 - DNA, 651 bp, Glycine max
  Peptide Sequence Number=SeqID_113685
atggcccgcaccaaaaaaattggtcagatgatgtctaaggcagcaaaggaaattgctgagaagattgattcgttggaggagcaagcgtcacagggttcgttcatcccccatggatgtcaggatgtcctgactgctgccattgggcgaccagaacaccctggtcgtgtgcatgctactagagccagtgtgaccattaagcaatactttggaccggctcaacggacctctcacacttcttcctccatcgctcccgaagaactagagcaactgactcaacaaatcagggaccagctggaggaccagatgcaatctcagttccagtcacagatgcaatcacatggacttgcacagcctccggagcttgaggttggtccctcagctgctcatgtcagcacaaaggggagttgtgttgatccctcaacgaccgatccagacgtttatgagggatccacaaccattcacaacatccctttgttgcatgatcaagggaaggttggtgttgaggaggcacttaacacctttcttgcttggccgacacatctcgtcaagcgtttatcagaacagggaaatgtgtctccagcaaaacctacagataggtcgcatcctgaggtcgatgatcccctatatctgatgacattgaccatctcctag

SEQ ID NO: 22001 - DNA, 279 bp, Glycine max
  Peptide Sequence Number=SeqID_113686
atggaggataacttgaagattgcatgtgaggggttaacggggtgcactactctgggtaatataatgggtcatcttgaagcatcgatcactgacaaagacctttcacccccaagtggtgcttgcaaatttgaagttggaattgaggtggtagagcaacttgatactagcccttcacctgaaccaacaacaactaaacccaatccaaacaggcccagtcttgggcatcagaccctgggcccaagaagtccttggcagtggaaactaggcaaccaaacttaa

SEQ ID NO: 22002 - DNA, 1545 bp, Glycine max
  Peptide Sequence Number=SeqID_113687
atggaactttcctcaaagaaagagttactatctcgaatagtatcaacactaacgcccaccatcacactcatcttcttcttccttgtgctttctccgagcctgtgcacatcactcggaagcaccaacacagttggatcggagttgctgaaggttgctccttctgaatttgaggggacagtgagaaccgtcgttgatgtgttgcaagaagtcacctctattctctccgagttcggttctggcttcggcgattcacgtctttctaacgccgtttctgactgtcttgatttgcttgacatgtcctctgatgaactcgattggtctgtctccgccacacagagtcccaaagggaagcacaacagcacagggaacacaagttcggatttgagaacatggctgagcgcagcacttgcaaatcaagatacatgcattgacggattcgacggcacgaacggcatggtgaagggtctagtatccactggtataggccaagtgatgtccttactccaacaacttctcacacagggccaatacccttcatgggttaaaacaggggaaagaaagctccttcaggcaaatgtggttagttttgacgctgtggtggcggccgacgggacgggaaactacaccaaggtgatggacgcggtgctggctgcgcctaattacagcatgcaaaggtatgtaatacatataaagagaggggtttactatgagaacgttgagatcaagaagaagaagtggaacctcatgatggttggagatggcatggatgccactataatttctggtaacagaagtttcattgatggttggaccacgttccggtcagctacttttgctgtgagtggcagaggattcatagcacgagacattaccttccagaacacggcaggaccagagaagcaccaagcagtggcactgagatcagactcagacctctctgtgttcttccgatgtgggatctttggttaccaagacagcctctacactcacaccatgcgccaattctacagagagtgcaaaatcagtggcacagtggacttcatcttcggtgatgccacagcaattttccaaaactgccacatctcagccaaaaaagggttaccaaatcaaaagaacacaatcacagcacatggtagaaaaaacccagatgaaccaaccggtttctcaatccaattttgcaacatttctgctgattacgaccttgtgaactcggttaatagctttaactccacccacacgtaccttggtaggccttggaaaccctattctaggacaatattcatgcaatcttacattagtgatgtgttgaggccagaagggtggttggagtggaatggtgattttgctttggacactttgtactatgctgagtacatgaattatgggcctggtgctggagtggctaatagggttaaatggcaagggtaccatgtgatgaatgattctagtcaggctagtaatttcacggtgtcacagtttattgaggggaatctttggttgccttcaacgggtgtaacgttcacggctggattgggggtagtatga

SEQ ID NO: 22003 - DNA, 474 bp, Glycine max
  Peptide Sequence Number=SeqID_113688
atgactaaggaggagatgaaaagaacttgggagaagtggttgccaaggggggagattgttagacacaggcccaaagcaaacgacaaagctttaaacactcgcggaactagaaagcctttacttccaattccatgtggcaaaaggagagactctgctcctgagccgcttctagaaccttccattgtccaagaagtttcattcgacgacgacaatgaagaagaacaattccttgatgaatttgaatacgaatttgcctactattttgaacaaggtgtacaagaggacagattggtgcttttgaagggtgttagtggtgctttcaggcctggtgttctcacagctttgatgggtgtaagttgtggcgtccctaaattaatgactggtttagaaggaaactcctcactacagagtcctgaatggccagttcacaactctattcggagtcatttctttcttaccgctcataatctctaa

SEQ ID NO: 22004 - DNA, 975 bp, Glycine max
  Peptide Sequence Number=SeqID_113689
atggagcagttcattgataacttgccgccgatggatctaatgcgatcggagaagatgaccttcgttcagctcatcatccctgtcgagtctgcgcaccgcgccatctcctatttaggcgaactcggccttctccaattccgcgacgtaagttttctttcagatccaacctcgcttcctctagattccgattttccttcgcttcttttcttcttcgatttcgtgtccgaggtctgtgctaatactattgtaggaaatgcaatgttaagggggatatctggtggacaaaggaaacgtgttacaacaggagagatgctggttgaaccagctaatgctttactcatggatgaaatatctactggtttggatagctcgacaacttaccaaattctaaactcgctcaagcaatgtgttcacattctcaaaggaacagcagtcatctctttgaattttaatgaaatatctattgatctggggataaaaccttctggggtttttgataaacttctgaaacattgttttctgcagtctgcactagaaattctcatttctgagggcagaggaagctttctctcctttctcaagagtagaggatgggctacatctctatctgcaggtgttggggaagaaggaatttatgggtcatctattgcttatgtctttgtcatgtccatacacctcactgactctggtgtagaaaagatgcttgatatcattggctttgtctatcaataccttaagttgttgagccaagattctccacaagaatggatatttaaggaacttcaaaatattggaagcatagatttcaaatttgtggaagagcagcctgagatgattatgctgctaggcttgcagggtcatacggagaaagggaaaggggagaagcttgatccgtgggaggttgggggaaagaggggtcatgggagaagagagggagtagggattgttggagaggagaaagtgatgttagcataa

SEQ ID NO: 22005 - DNA, 273 bp, Glycine max
  Peptide Sequence Number=SeqID_113690
atgaagttgaagaaaaagaagaagatgaagatgaaaaatatgatgatgatgatgatgacgaagaagaagaaggcaatgaaatggatggagttaagggtgttggtggtggtgctcggagcaaaaagctttgttttgcaatgtgctgctgctatggctttgtggagaagaaattactcaagaaatagagaaaataagaggaaaagcttgaggaatcttaggaaattgctagagatgctgctatcgctgtcagaatacccacgtgagcccacttag

SEQ ID NO: 22006 - DNA, 333 bp, Glycine max
  Peptide Sequence Number=SeqID_113691
atgggaagaggagagaagaggaacagacgtgtgaggagagaagaggagcagctaatgagtggagagaggaatagacgccgtggaaagaagaggaacagacgcgtggggttaaaaattaaaatggcccgcattcaaagacggttttgggaaaccgcctttgaaatattcgcaatatttacgcaattgccatcgttatacggtttttccagtagtgacagttttcctctcatgcttatcgctacttttcaaaaagaactgcatatcgttattgtcgccatagccatagccattgttgtcactatcgccactgtcatcgtggccaaatcaatttga

SEQ ID NO: 22007 - DNA, 1899 bp, Glycine max
  Peptide Sequence Number=SeqID_113692
atggatcagcccaggttggcagtttatgtcgatcccgctaccgggagagcatcgggacctatgcgtgaaaagttccacagctatctaggggtagtcacgcgagaaaagtctatctttacattgacagaatgcaaagtaactaatgtatgtatgcaagcaaaggttgatatcctagaagccgcaaaggtgaagacgaaggatgttgttacaaaatatggactagatccgaaagcttggaaacaatttgaagcaacccggctgacacctaactgggagggtattaggaaacgagcacaatcaattcaaaaacacaacaactgccctcacctactttcacgtgggggatatgatttgcttgagaagaaattattagacgagaaaagaaaaagactagaagaggaagcattgttgactgaaaatccagcaagtgttaacgaccccccatctccaattaaaagacatgttaagtggaaggttgcttggaccagggcttatggcaatatgacatctgagtcgacacaggaaatagcagataaaatagactccttagaagagcaggttacgcagggatcctttgtaccccatggtcggcaagacatactgaacactgctattgggcgacctgaccatgggggtcgcgttcgtgcagcgggctcaggtgtcactattactcagtactacggaagggcaacaaggacatgcaacaactcgtccacatccatcactcaacaacaattagatgaagttgttgcaaggcttagggaagacatgagtggtcagattagggaagaattgaggagtcagattaaggaagaattgaggactcatctagaagaggaaaataaaaggagcttggaaagaatgacaatggcattgaaagaggctattaaaatagagttgtcacataaaggatccccagagtcactcctaattcaaccggacatacaacaattaggtgtgcgtgtcaacactaagggaagtaatgctcaaagtaatgtccagccttcacgggaagatgatgctgatgtcataccaaagatgggactgtatgtgcagcgtgaggatggtacactagggttggtagccatggggaaaatgatggatggggattcagtcatacactctatggcttatgcagatgatgttgtatgggtaaatgtggatacagttatcgatcctaacgttgagatcccctatggcacctcaaaaattcagtatgttaagcaggccctcgatacatttgtagcttggcccacacaccttgttaaagttgtattagatgaggtaacacatgaagataagctggctaatgtggacgcagatgatccaatgcgtggcttgataaagtacaactttgatatttacgacaagccagtggaattcaaatttgatgggagtaaatttggaattgtagatgcacctacatcgatattcctaacatattatgatgttagtgaaataatagcaggagacaaaagtttgaacatatctgtacaacaattatggttgatgtatatgcatgagtggagtcaaaccttgggtcaaggttccagctatgcattccttgagccacagtcgttggtggtttcaaaggatacacgtggcgaatgccaacaatatcttgaaagatggcttaaggaatctgaccgagaggtgtacgttggaccttacttccatcatgtaatgaccaaattaaagacgagttcgtctcctgaaagtaaggcagttgcacttaagtggattgaagttaagagtcacgttcaaaccggatgttatgaatgtggatattatgtgatgcattggatgtggaacatcataaccagcgacatcaagagtgattggtccatgtggtttggtgatgagacaccattggacaaggacaacatcacaacaatttaa

SEQ ID NO: 22008 - DNA, 243 bp, Glycine max
  Peptide Sequence Number=SeqID_113693
atggtggtcattgtgcccaaggaacacctagttgtctggttttgttcattgcataacagtgctttaaaaggtcttgatgatgttgcacagcctaaatcaaaggctcctgttaggtggattgtcgtcaagggtaatagacaaaaaggaagtactgagtgcggctactatgtcatgcactggatgtccaccatcattttaggaagttttaggaatagctgggaagtgtattttaacgatccttga

SEQ ID NO: 22009 - DNA, 693 bp, Glycine max
  Peptide Sequence Number=SeqID_113694
atggctttcctcataatccaacttctagaggaggaggaagtggttcaactggttttggttgaggaaattcagcatggataccctcctggtcataaatattataagcatcaaggtccatcaatcaataatgtaaatgctgtaaaagaggaaaatgcaaatttagatgtagagcagaatcaagaggcgcaaggttcagatgtcaaattgaatgctcaacaatacaaagccttaatgacattactgcaacaacaaggatcttcaactcacaatagttcacatgtgaatcagattggcaccatgactggttctagtcatgtactcacaggtaatgtgtcatcaataagttgtagtatgagtaaggcagatttaaatgaagaagtttacatggtgattcctcaaggtatgaatccagaaaagccaggtttagtgtgcagacttcgaaggtctttgtatgggttgaaacgagccagtaggcaatggtatgccagactcctttcacctgaggttgtcaacttgatccacaacaagaagcttcaccaagagacgcttgaagggttgaagactgctttgtgtgctactcaagctctgcttatggacgcagaacacaaacaaggagaacttgtcttggagggctccttcaacatctctagtgaaagggaatatatggcagggaggatgaccaagaggccatga

SEQ ID NO: 22010 - DNA, 486 bp, Glycine max
  Peptide Sequence Number=SeqID_113695
gagaaggtattggaatatgtgaatctgatgatctggctaggggctaaagggttccctccattcactaagcaatcatcacaggagatcctcttgaacaatcttgggttcaccattcttgcagaagcaaacatgccacagtggaagtggatgtcactaggagcacatccagaaacacaattgttaacaatttgcactatgaactgtgggattcctggtgtagaagtttggctttgtgagatgcttatgtctttgcttgtgcaaatgcagaaggagaatgaagaagaccaccacaaggaggaagaaggcattttagccctttcaccaacattactggatgccccaaccaaattgttgggtgcccaaagcaacactcataatccaaaggtgcatgaggatgtcggagggaagacggagttcctggaggctcaacaactctactttgctccccgccaacttgccctaaccaatggtagatgtaggttgtga

SEQ ID NO: 22011 - DNA, 2118 bp, Glycine max
  Peptide Sequence Number=SeqID_113696
atggagagggatgacaaagtaattttggagcagttgttggcatcactagacgcgctggccatcttttttcttccttcggcaaatgatcctctcactgccttggatggtgggaccatgccactatctgttgctactttaaccgttggagaagggggtcaacttgctggtgaagttggtcctcttgctgttgctattgaggttgcccctagtgctccttcctttgttttggtaaagaggaagagggatgatgctactaagcagtcgggccgcaagaagtcgaaggccccgatgagcctctgcaccctgaggcaggttgcagggttggggcccactgtgggttgcctcacaactgtgcaagatgtgcctccggctctaccggttgtcgaggctcttgctgctgtaactcctactgctgtaactcctactgcttcacctcctctcgcggctattgttcaggaggattatcctgctactgttgaagttgctgtgttagccactcaagctgagtctgttgtggtgctgtcatcaaccattgtggcccctttactaagtatcggtgtggcaaccactggtgctcccatggtgctgcccccttcttcgttggctctagtggtcctccctgctgttgttttggcgactatggcgtcaccttctttgtccttgcgccttcgcttctccctcaattatttatacacctccagtgatgctgactcactgtggggtgtgacttacaagctggagcagaagaccctgactgactttgtgttagccttcgacaaaaatctcatcaggtcgactggggtgcagaatgctactgactctaccaaggtgtttctccaaagaagtttggcaattctggaggagaacagactgtggcaccaagaggcgaagatggacctcagttgcaaagtggagagcatgatgggtgaaaaggaagggcttgctaagaggattgctaagttagaggctcagcttagggaatcaaaatccagattgaaggagtccgagctgcaggctgccaaggagaaaaaggccaacaaggagcttgaagagaagttgctcttgtataagaaggaggctgtagagcaacatgaaaaaggctttcataaggccgtcaggcaggtcggtttctttgtgaaggaccttgacttaggtctcttcaatcccttcaaggatgtgaatgagggtgtgttgcttgatgaggaggagattgatgcgaagaaggaggctggtgatcaaaggcaggttgctgcggagctaggcgatgatgcccgtgtcttgccgaatagtggggtgacagttcgcttggtggaacttggacccttgacgatggtcgttgaagttgctgcatgtgagcggaccaagggggtaccttgggtttttgtagaagtatttaccaagggccaaccttgggttttcgtaccaagggcggaccttgggatgagacttagtaatggaaagggcttcactaagggtgaaccttgggtttgtcgagccttggaccaggaacgtgtttgcctaggttttgtcaagcctgtgtcgaggcttaccaaggatggaccttggattttgtggacctataaggatcgacaagcgtggagcttgggtttgatgagtcttgtgtgcagcgtaggtgttgtgctcttgcatacatggcactctccgtgggtgacatgtatcgatgatgaactagcttgctcttgcatacatgcctcttatagaatggtaggattaaccagggaattgtacgacttgggttttgagcatcgtgctcttgcatgcatgctagtcgccgtgggtggcatgcactggagatgtggtgatatactctttgcatatatgtcactcactgatgctcttgcatgtatggcattcgctgtgggtgtcatacactggagacttggtgatatgctcttgcatatatgtcacttgccgtgggtggcacatactgaagtcataatggcttgtaaagatgctcgtgcgtgcatgccacttgccgtgggtggcatgtactggagtcaccaagattatatgctcttgcgtgtgtggcagtcaccatgtgtagcacacattagagtcgtaatgcttgaagaaaggcccaccaagggtggaccttag

SEQ ID NO: 22012 - DNA, 183 bp, Glycine max
  Peptide Sequence Number=SeqID_113697
atggatgcctcagagccttacactgggacaatgagaggcaccatgcataagcctcgagcaaacctaggggcagatcggaaattctcacccgatacctcagagccttacactggggcaatgagggggcactgtgtatgggcctcaagcgaacctaggggcgaatcaaaatttctcacccgatag

SEQ ID NO: 22013 - DNA, 129 bp, Glycine max
  Peptide Sequence Number=SeqID_113698
atggttggagcattctcacaaaacagcgtgaccttgactagtctccctatgattttacctagagtagatggttatgtggatgactatgaagaacctcatgctagaggacacaggaacacaatgctctga

SEQ ID NO: 22014 - DNA, 264 bp, Glycine max
  Peptide Sequence Number=SeqID_113699
atgcctacaaatgaagatgctacaaatttggcgatggaagacccattcttaatgatcgtcttatggtttcatccatctaaggttgcggcaaaggctgtcactttgtccattaggcaacaatttggtcagccttggcctacatggggagcaattccaaaagatcatcaggaacttttttccagcattttaagagataattggtttggagacccgagcaagagaatgaaattaaaaaaagcttttaactcgaaagcctcccattga

SEQ ID NO: 22015 - DNA, 327 bp, Glycine max
  Peptide Sequence Number=SeqID_113700
atgggttttaattgttcctttaacctaaaactacgtaaccagcccaaagaagctatagcccacatatatgcgcagaacctccatttttgttcgttgtgctttctctcgttttctctttttcatgcggcattgcatcttgttcgtgagggtagcaacgttgaggtcaacagtgaaggtgaaggtaccggcatcgagcgttgcggtggttggtggcggcaaacgaggtacgcagaacctccatttttgttcgcagacgtatggacatccttccagatcattttgatccggaagcctcttacggatcaagttgatccggaagagtattaa

SEQ ID NO: 22016 - DNA, 366 bp, Glycine max
  Peptide Sequence Number=SeqID_113701
atgtcggcgctggtgctgtcgaccttggggaagcgaattgaccaggcggggaagaagaagtacgtgaagcagatccttgaggatgttgattctcaaattataggaactctgagtggtgatggcgatgaggatgatctgaacgtggagattacgaaggtgcatgcttgtcttgtcgacgaagagaacgagctcggtgagacccctctattcacaactactgaaaaaggtcacctagatgtggtggagttgagcctctcagatgttgacacgtggcagtcaacgtctgagcttaacggtcaacgtccaattgaggtgtccgagaccaacattgcagaattttacaaaatagggggacccaatttgtga

SEQ ID NO: 22017 - DNA, 762 bp, Glycine max
  Peptide Sequence Number=SeqID_113702
atgaagacttctccaaatacttcttcaccaagcagagatagagacacctcttgcatgatatctggtcctcccatactgaaccgagaatctccgcgaggtctacaccctaagctaaaagcttggcatgggctaattcggcacaaccttcctctgcacacacaacgccacgggacacccattcacctgcaagtcaatcccaaagcagaagccgctctgcacggaggactacgacgacgtatgcaccacctcttcgagcaccccaacgtcgttcgcatccacgacacctacgaggacaccgcctccgtggaggcttgccactggcttggggtcatgcatagggacctcaagcatgagaactttctctttgatactgttgaggagggtgctaaggtcaaaactattgattttgggctctccgtgttttataagccaggtttggttgctctctcgttagatttggtttttgtggaggatgccgagggagagggcttggtcgtgggttttggtggaggtggggattccgatgatgtctttgagttttccttggcggaggagctcgccgatgcagtcgacggcgtgcttggcagtggagccagtgccgaggccgaggaccatgccagacttgacatactcgacgaccttgtaggtggcaattttcttgaggtcgtcttcggtgaggatgacgaaggaggggggggggtggatactgttgaggaggagaaaaaagaattagggttttttgtaactaaagagacaaattaa

SEQ ID NO: 22018 - DNA, 399 bp, Glycine max
  Peptide Sequence Number=SeqID_113703
atgcaccttcgtaatctccacgttcagatcatcctcatcgccatcaccactcagagttcctataatttgagaatcaacatcctcaaggatctgcctcacggtgcccacgtcgcccctctacgcctccaggtggagctcggtgtcgttgtggcgccccgtcacctgcttcacgtacttcttcttccccgcctggtcaattcgcttccccaaggtcgacagcaccagcgccgacatcgtcgtcgacgatggagatggcgatggggatatctcagaaagcgggttctggaaacttgttgggggggggggtccttctctccttgcccttcagctccgggacctgatacaagcaagcaaaagggtcatcaaaaaatgaaaagtttagatagaaggagagactaa

SEQ ID NO: 22019 - DNA, 504 bp, Glycine max
  Peptide Sequence Number=SeqID_113704
atggagcttggggattggtatacgttgtacccatatctggcgatcactctcatctgtcatccatgtggttgtgtaagaccaccaatacctatgaggctcagtggcattgttgggccttgttatgtgtcaagtaccaatgtcagagaagaccatgatgatctcatgcctccttcatataaggaggatgaggatgatccttctgaggatccatcaaagatattgtcataccctaatttcgtccggggacctttgctcgatgacgtgcgaccattctttggtcctcgtgaggcggttgcttctggaggaagcaaccctgctcgcctgggcgagctgggcggcaaccacctcccctattttgctataaataggggaggaaatgaagaaggaagggccgaggcgcttccgaaacgtttccgtaacgttttccgtgaggaatctcgcaaaggtttcaaccgttcttcgacgttcttcattcgttcttcatcgttcttcgatcttcaacgg

SEQ ID NO: 22020 - DNA, 330 bp, Glycine max
  Peptide Sequence Number=SeqID_113705
atggcaggagaatggagaaggaggaaaggtgattggagacgccactttgaggagaagatgagtcaagaacaagctcaccaccataggaagccatggataagagcttggaggaaggagaagatgactatagttcagcccactaatccaagatcaaattcaagattctccactaagtgtgcttgggtgtcgattgcatcagaggtggagggcatggatgtcgagggaggtgccaaggagggggtgggtaagggcggtgcaagacttgagggtgaaggagaagaggtgagggtagagtggacagggcagaagacagaaatggcttttgaatga

SEQ ID NO: 22021 - DNA, 768 bp, Glycine max
  Peptide Sequence Number=SeqID_113706
atgagtgtggggtccaaaaggattgactttgtagatgcttcaacctcaaatgaacttaagggtaacattataatcgactcaggaacaacgttgaccattttgctagaaaacttttacactaaattggaggcagaagtggaagcacatatcaatttggaacgtgttaatagcactgaccaaattctaagcctttgttacaagtctccaccaaataatgcaattgaggttccaattattacaacacattttgctggtgtggacattgtgttaaattctttaaacacttttgttagtgtttttgatgatgcaatgtggtttgctttcgccccagtggcatcgggttccatctttggaaacttagcacagatgaaccacttggttggatatgatttgctgaggaagactatcaagaaagcgaacccagaggccgaatttaaggaaatttcaaccatggtgattgcaaaggaaaaacttgaaactgagtcaatgagtttgttggaagacgagcaaaagcagaggactgcgatggaattgcttgaacaatacatgcaattcaaacaagaggcagaaaaagatggaaagaagaataagaaagagaaggatccattgaaaccaaagcaccccatgtcagcttatttcttgttcaccccattgtggaattgtgtcgacaaaagcggggcttttgctcctacgtaccctcctttggagaggaaatcagacctacgtagttctttcttaagcgtgaatcaagcgattcttttactttga

SEQ ID NO: 22022 - DNA, 205 bp, Glycine max
  Peptide Sequence Number=SeqID_113707
atggcttctccacctgcctcgcctcctcctcctcctcctccttctcctcctcctcctcctcctcctccaccttcaaatgcatcagcttcactgtgtgtcgtgaagcagacacgcaaagcctcacgtctacgatccttgtctgccagaccacctggtgctgacagaccagtggtccacgttgatcctactgccgataaggccgacg

SEQ ID NO: 22023 - DNA, 643 bp, Glycine max
  Peptide Sequence Number=SeqID_113708
atggtttgtattaaaaatcaacataggtcacttattaggaaaataactttaattctgataagagaacaacacaaaatactcaaagaactgtatctaagttttgtccttttcaaatatggtgataggggagcatctcatgttgagctacattggcctactcgtttgaagattatacgaggaatcgcacatagaatgcattatctttacacagtacttggttcctcggatcttccacacaagtatctcaagtccaacaatgttctccttggaccagacaatgaaccaatgcttatagattatgggttcagccacatggttaacccttcaaccattgcacaaacactattcacttacaaggcaccagaggcagcacaacaaggccagatactgacagggaggttcccttctcagtatctcaaaaatggaaagggtggggctgatgtggtgcaatgggtggaaactactatctctgagggaagggaatcagaggtgcttgatcctgagattgcaggctctaggaattggcttggtgagatggagcaactcctccacattggtgctgcttgcactaaaagcaaccctcagcagcggttagacatggcaaaaactgttataaggataatggagattaaattcgagtgtg

SEQ ID NO: 22024 - DNA, 1080 bp, Glycine max
  Peptide Sequence Number=SeqID_113709
atggcagtgaaaaatgctttgaaattaaacatatatgatgaccttgtaactgtaaggaagacttgggaggatactaatgaggagagagcaattgtactttacaagcctgatgcacaaccacctcaagcaaatggaagcaccacattggaaggaagctcaaaagttcatcttctgaaagtcctagagacacgtaagtcagcattgcagaaagagcaaggcatggcatttgctcatgttgttgctgctggttttgacattgactatataccgcctttgatgtcatttgttgaatgctttggtgcatctcgcatgaaggatacatgcacaaaattcagggatctttggagaagaaaacatgaaactggacaatggcttgaaattgaagctgctgaaatgacgtgcaatcgctcagacttttctccgtttaatgtttctggcattatacttcccagtatggcctctgcatcccatactgaattggactcggagagtaatgggaaagcaagttcagtggacttcttcccaacttgggtgattgataacattcttactatcccaattaagcagtttgattatcatgatgtgctagtttggagattcactgtagatggagtttactctgggaagtcaagttatcaacttgcattgaataaagaagaaaatgctgcaaagggttccagcgaagggtgcggagatggttggaagatttggtcatcgaatgctattccccattctatcattgagagggttccaaattctctgcctttgcctcctcgaaccctacagattcagagtcgtacaagaacaggttttggggtcatctttagggatgaaaatgtgtatgtattagtgcctgttgctaaattcatgaaagaggagtttgacgtgcatctcaccgtggtgtctgccatcatcgtcattggtgtccgccagctgaccgtggggtccgccatcatcgtcattgttcgtggcaaagtgcaaccctacgtcttatctcctggggctaccattgtgcttacattggggaaggagttgaaagaagctgatagagcttcttgctccaagttccttcacctttaa

SEQ ID NO: 22025 - DNA, 192 bp, Glycine max
  Peptide Sequence Number=SeqID_113710
tgtaatagacaaaaaggaagcactaagtgtggctattacgtgatgcattggatgtccactataatcttaggaagtttcaggaataacttgaaaacgtattttaatgatgttagaccattggaagcagagagattgaagacacttcgcatccagtgggcactgtattatctcaaagttaaaaatcaaacttag

SEQ ID NO: 22026 - DNA, 327 bp, Glycine max
  Peptide Sequence Number=SeqID_113711
atggatcctgctcctgacaaaaccatgcacaaggaggcacatgccaaatgggaggtcaaagatgcacaggtcatgacttggatcataggctctgttgagcctaatatcatcctcaatcttacacccttcaacactgcaacaaagatgtgggactgttccgaaatagtgtactactgcgaaatttatcagcaagctcagcagaaattcccaacaagagctttagccttccatgacaagttatcacctttcagctacaatagggggttttggaagcaaaattcatattacacagtggtggggatgtctcctccacctctaggaacctag

SEQ ID NO: 22027 - DNA, 687 bp, Glycine max
  Peptide Sequence Number=SeqID_113712
atggcgatgaacatgactgaaggaaataagccgaggttgaagaggaggatgcggtggacagcagtaatgctaagtggagccggtaacggtacggggtgttgtggcatgagtgcggggtgtggcagcgaagttggcatggtcatgggggcggtgagcgtgggtgacagagttggctggagcagcaaagtcagcggcagaggcagtagcgtggtcggtatcgggacgactggtggcggtgactgcagagggaaggaagacggagaggagtgtgggagggagaagagtaggggtggctggttctcggaggcaattttcgaagaagtgcatccaattgggagtcgaggtggcgttgagccacatcaactttggccaaggcggcctcaaggcgtggaaggtagtcgagaagccatggaaggcagccatggaagctccatttggcgagtagtgtgggtggtggtcgtgaaaggtggtctggcagctatggaagctttgtggtctggcagaggttgtggtagtggaagttggcatggcagccatggaaggcaaccatggactctcaacaaaagcaccaaattgttacgtgcagcgaaaatggtagctggtttcgagggtccagcacctccagaagaagaagaagagaagaagatagcgcttggaattcgaggaccaagctgcctcctaaagtaa

SEQ ID NO: 22028 - DNA, 447 bp, Glycine max
  Peptide Sequence Number=SeqID_113713
atgtctacctttgaacaacatgctaccaacgcctctatccattttcctgaaccagagccttattccaccactaataccttcacgtctatgatgaatgctatcaagagtgtttcatgggtcctcgcaatctcatcgaaggttaggatactgacaaaacggctaacaagctgtttaatcatgagaaaaacccttgtcccatcacttgtaagggtattggctacctacaaggatgagtggaaggattggggaatctatgacatgatcatgctttgctttgtccttccaaaagctatggttggtccaaccctgcttgatgtggttgccatcttgagcctgccaatctatggtgaggagctactgtcactatatggaaaccactattccaccactcccaacactcatggcattaagttctccaaagatgacttggatattccaaattcatga

SEQ ID NO: 22029 - DNA, 381 bp, Glycine max
  Peptide Sequence Number=SeqID_113714
atggaagaaacagaggttgataagaaaatcgccatcacttttgatcatcctacactcgaaatgatcaaacacttgaagcctatatatgttagagcccagataaatggtaaaaccttgttgagagtgtttgtggatgaaggagccattttgaatatcatgcctttgaccatactaaagaagccaaaatcacagttggacccaaaaccatgtatcatgccttcttcattgaagatgccaagccagcttattctgtgttcacttgatccaacaaacggtatcagagccaaggtcatgagttcgattcccaacaaggcaattgttgagggggagattgtttttcaggttgtggcatcaattgtcccatggcgaaggcccaggtga

SEQ ID NO: 22030 - DNA, 603 bp, Glycine max
  Peptide Sequence Number=SeqID_113715
atgcaatcacaaggacttgcactgtctcctgaagttgaggttggtccttctgctgctcatgtcagcacaaagaaaagttttgttgatccctcaaggcatgaaccagaaatgggtgactcagataaatgtgggctgtatgtcaatgaaaatacttcccgtctggttgtccttggaagactttatgaagggttgacacccgttcacaacatcactttgggaaatgatcaagtaaaggtcaacattgaggaaactcgagatgttgatgctcacattcttgtacccactcaagaggttcagttagtggcgcaagcacttaacaccttcattgcttggctgacacatcttgtaaagcgtttgataaacagagctgagggaccagcgaaacctgtagataggctggatctagatgttgatcccctatacctgatgacattgtccatcccgcagctttttctcaagccattgcaggtgtcgtgggatgctaccatgtttggggtgtataatgataacttccctttatacataaagcatgaagatctttctgaaataacacacggtggtcaatgtctcgacatctctgttatacaattgtggattctgtaa

SEQ ID NO: 22031 - DNA, 387 bp, Glycine max
  Peptide Sequence Number=SeqID_113716
aagtactgctcgcagagacagggccagggtgatgtaccacaggccgtggacgcgccgccacctcatcaggctggcccagccggattgtttgatacagagcggtatttgcggcatttggttcgccaacaggcggccaaccaccgggcacatgtacagactcatgattgtctgtatcagatgagtctcagcctgcagagtcagggctttacttcttttccgtgccctaccccggaccagtttagggcagaggtcgcgtggcctggggattggcctgaggcccaggcagcagaggcaccagcagaggctcccgatgaggcagatgaggcccgcgaggacgaagagatgacaaatttacttgatttcttaggagggagcggagccgcatga

SEQ ID NO: 22032 - DNA, 210 bp, Glycine max
  Peptide Sequence Number=SeqID_113717
atggaatggaatctgtcacgcaggcacgcgctcagtgcgtcatcaactcgctcaatgagtcatttgtcaccttcccggcttagcgcgagtttggcgcagagcagaaattcacttaatcgcgctaagtgcgagaatggcgctaagcgtgacgttgaggagcttccttgctatggaaggctaaatcctcagttggggattcttgttgagtga

SEQ ID NO: 22033 - DNA, 498 bp, Glycine max
  Peptide Sequence Number=SeqID_113718
atggatacattgcaaagtgatttgaataagcctttctatctggggtgcaacaagtcgttgacgctattgtcaacggtgttaagtctggttaatgtgaaggccagatatgggtggagtgacaaaagtttcagttcactgcttcaagttcggccatttcccgtgcctacgtccagtcctcaagcgacccacatgagatttttcactatgtctgtaaatcctttacagtctttgaacattgctaaagttgatgtctcgctaagcaagctcaatgcgcttagcgagtgtcatccgataagcaaggtatcaacgcgcttaacggataggagaaatctagaaggaaatcgatcacgtaggcacgcgctcaatgcatcatcagctcgcttagcgagtcgtttgtcaccttccaggcttagcgcgagtttggcattgagtggaaattcacttactcgtgctaaccacgacgtcgaggtcaatgagccctttttaagcctggaatag

SEQ ID NO: 22034 - DNA, 336 bp, Glycine max
  Peptide Sequence Number=SeqID_113719
atggaggagaagaaaaagaaacaattggaggaagtagctcaatccaaaagcactgacattgtcattgatcctccatctcccatcaaacgacacgtaaagtggaagatggctcacaccaagaaatctggtcaaatgacgtctgaggtagcaaagaaaattgctgacaagatttccctatctttgcataagtgttgcaaaatagtccttccgttaaattttaaagtaacgctgttagtgaggtcaatttcagtgccacgtgaactatccaacgtggcactaaaggatgacatggcatggcacgtggatgttccgcttaaaagatgccatgtcatttga

SEQ ID NO: 22035 - DNA, 801 bp, Glycine max
  Peptide Sequence Number=SeqID_113720
atgccctggtctctgattacctccatcccctgggttttagagaagcctccacccgccaagtggaagggtaagcttctccctgaaatagacaagggcagtggagagggtaaagaattgtgctctttggtcgttgatattgttgtgagcctcctgaggtgtgcaaccgcgggtttggctaaaaaggatgcccatttcaggaaggtgcttttgttggtggaggaaagattggattccaattcgtatgagaagttgcacaagatgttagtaactcatttgggcaagtgcactttaaatttattggggagtacgccatttccagatagatacttggtgaccttgttttggtgtacaacgttgactgaatatgtgaaatctcccatcaaagatcaagtctacaagattgccctcagggtatgctcattattgtttgcactgagggataataactccttgtatatcatggatatactagaatccatagttcgcgagtgcaaggttgaggaggaaaacacaggaaccaactttgttgaacttgtatattactgtgcaaataaatgtcaaactgcaaatgaaagtttttgtagtacatttgcagcatatttgaacaaaatagcagaacatttcaaacaaaaaacaagaaaatactacagcgtttcggatcttgagattgtcgacttcaaagttctgaccagaatgaaccaatatgagattagggaagtcgagaatacaactaaggagaagatggagatgactacacctgttttcacaagtaagatggagattactacacctgttttgtga

SEQ ID NO: 22036 - DNA, 444 bp, Glycine max
  Peptide Sequence Number=SeqID_113721
atggatgagattttggactgggttgagaaggtaaaggttcaatgggttcaactgatagtaaatgtagaaggtgtcaaagttgggcaaaagtggaaagataaggtgggaaaaggtaatttgaggaactgcaaagttagcagtaacggtgccaagtgttctcagccattgcattcctataaccacattaaccctctttatagggttgatgaaaatgtgtgggattgtgatagggaggggaaccaatgggacatagaagtggagaaaataggagtggtggtgacaaggctttgtagtgtagtattgaggctagtggtggaagaaatgttacctagggttgcaggtgtgaggttaggagatggggatgatgtagaggtagccatggctgaaagtttctccatgatatcatccatggtttcaatcagcgtagcatgtcttcaatcctag

SEQ ID NO: 22037 - DNA, 123 bp, Glycine max
  Peptide Sequence Number=SeqID_113722
atggcggattcgaagacagtctataaccaatgtagaatgtcgctaataactgatgtagaaggaggtgaaaagtgtggtgtacataataatataatatcgattaaaggtatgtttgaattttag

SEQ ID NO: 22038 - DNA, 456 bp, Glycine max
  Peptide Sequence Number=SeqID_113723
atgacacgtatgcaagagtactgtgtgtgcgccgcacacggttgcaacaacaagcagatgttacgccctgtcgtcaatgcactctctaacggtcagaaaaagggctcggggcttgacaagccacatcgacttgcaattcactcacactcgttgaggttaccacacccaacatcggacaacactcgtccacacttgggggctcgacaaactcgtcaccctctgcctgtcaagactactcatcgacaaactagttcctctgtctgtcctctcaacaaagctcatcctcaaagccaatgtgtaaggttgtgcaccatctcctggttgttaaaatccatagccattcccgaggatcaatcgagtgaactgtactattctgtaggggccattgcagttggaaaccatccatattatgcatattgtagagtggcaagtaaccgaagctggagtttgacttga

SEQ ID NO: 22039 - DNA, 144 bp, Glycine max
  Peptide Sequence Number=SeqID_113724
atggcatctaaggcaacacgcgaaattgcaaataagatttcgaagatgcaatctcagagacttgtactgcctcttgagcctgaggttggtccttctactgcctgtgtcaacacaaaggggagttgtgtcgatcccttgaagtag

SEQ ID NO: 22040 - DNA, 513 bp, Glycine max
  Peptide Sequence Number=SeqID_113725
atgaccgacaacgagtccaagtggggtgtgagcttcagaagagtgagtgcgagtgggagtgtgggcaataagagagaggagttggagcaccatgaaagtgaaagctttaaactgagagtgggagtgagagtggtggttcaaaccaagaatggaactgttgcagtagcttctgcgtttgctggacataaggaagctatacagcaaagggaccacaaatttttaagaattgctgttgaagaagcctataaaggggtagactgtgaagatgggggtccctttggtgctattatagtatgtaatgatgaaatagttgctcgatgtcacaacatggttctgaggaacacagaccctactgctcatgcagaagtcactgttataagaaaggcagaggcagcaattgctattggattcgatgacttcatttcagatgcattgcgaggcactggattctaccagaaagcacaattggagattaaaagggctgatggcaaagcggcaaacattgctgaagaa

SEQ ID NO: 22041 - DNA, 264 bp, Glycine max
  Peptide Sequence Number=SeqID_113726
atgagtagctcatcaaggccgatgccgaggagagagagtccatggggagtcaccagagagtatcatcctaagctcaaagctcaccgctgcaatgaccatgtcgaggatgttaagggtgttgcccttgctcctacgtatcttcaggaaatgagggaatttgggactatggcagcttgccaaagcgagctgatgtttagtcctaaagaaattggctcacccaggcgagctggttcctttagccctaagcaatttgggggacattga

SEQ ID NO: 22042 - DNA, 150 bp, Glycine max
  Peptide Sequence Number=SeqID_113727
atgggatcaggttcacttgctgcaatgtctgtatttgagtctaagtacaaggaaagtttgagtgcaatttgtgaagggaggcctgctatggcagcgccattgaccacaatggcatgtttatatggtggaatattggccttctggcattga

SEQ ID NO: 22043 - DNA, 1965 bp, Glycine max
  Peptide Sequence Number=SeqID_113728
atggcgttccaggatttcgacatgatcaccgagaggcggagaaacgagcagaggctcaagatgaagaagaagatcctcatcagcgtcgtctccgccgtcctcctcgcgtgcgtcgtaggcgccgcggcattcgtcgttgtccaaagaacaggcactaatgcaaagcacgctaccccaatgccacagaacaccgccacgccgcacgtggatcagaactccaggatggtgaaaatgatctgtggatccgcagaatacaaagaaaaatgcgaaagcacgctcgaagaagccctaaagaaggaccccaaattggctcaacccaaggatcttatcatggtgtcaatgattcttgcggagaaggaggttaccaatgccttcgatggaactgcaaagatgatgggcaatgcgtccgaggaagagaagggtgcgtacgaggattgcaagggtttgttcaaggacgccaaggaagagcttgagctgtcgatcaccgaggttggcgacaacgacgcggacaagctctccacaaagggtgctgaactgaacaactggctcagtgcggttatgtcttaccaacaaacctgcattgatggtttccccgaagggaagatcaaggatgatttcaccagcatgtttactaactctagggagcttgtgagcaattctcttgcggttgtttcgcagttttcttccttcttttcgatcttccaaggcgccggggggattcatcttccttgggagactaccagtgatgatgcactggcacctactgcttctggttctgcttctggtgccggtgctggtgctggtgctgggtctgtgttcggttctgatccctcttcttttggtcttggttatgcttctgctcctgctggtggtgttgctcttgctcctggtgttgctcctgctcccggtgctgcccctggcccagttccttctttgcctgctggttcaattcctgcatggacgggctcagttcctgtttgggccggcccatccgagttcttgggatcaaatgaaaagcccacacctaatgttaccgtggcccaagatggcagcggaaacttcaaaaccatctctgaagctttggctgccatcccaccacaatacgacggaaggtacgtggtttatgtcaaagaaggagtgtacgatgagaccgtgacagtgacaaagaaaatggtaaatttaaccatgtacggtgacggacagcaaaagagtatcgtcactggaaacaaaaatttcgtggatggagtcaggaccttccaaactgcatcatttgttgtacttggagagggattcttggggaaagacatgggattcagaaacacagccggtgcagagaagcaccaagcagtggccgcaagagtgcaagccgaccgagccatattcttcaactgcgccttcgagggctaccaagacactctctacgcccaaacccacagacaattctaccgcgactgctacatctctggaacaatcgacttcatcttcggcgacgcctccgcggtgttccagaactgcaccatggtggtaagaaagccactggagaaccagcagaacatcgtgacagcacaagggaggctcgacaagcaggagaacaccggcttcgtcctccagaaatgcgtgatcaaggccgacaccgacttggtacccctcaaagacacaatcaagaactacctcggaaggccgtggaaggagtattcaagaaccatcatcatggagactcagattgatgacctaattcaccctgatgggtttcttccttgggaagggaactttgccctaagcacactttactatggtgagtacaacaacaatggggctggttctagcaccactgctagggttaattggcctggccgcaaagtcatcaatagggatgaggctaccaggtacacggttgaggctttcttgcaagggacatggatcaatggcacaggtgtaccagctcaactaggcctgtacagttaa

SEQ ID NO: 22044 - DNA, 312 bp, Glycine max
  Peptide Sequence Number=SeqID_113729
atgattagtcatatcagtgagaaggctttggttgctagaaacagtgtgaatgctatggatatggaggcatctttgtggcaccgaaggcttagtcatatcagtgagaaggggttaaattgtttagccaagaaggatatgcttacaggattgaagaatgcagatttgcagaaatgttgtcattgcatggttgatgtttgtggccctttgaaggtgaaatcctttagtggtgttgatatgatgactaagacattactaacaggaaagtttgaagcttgctgtgagatcgttggtttggcagtcatctccacatag

SEQ ID NO: 22045 - DNA, 246 bp, Glycine max
  Peptide Sequence Number=SeqID_113730
atggccagcagtagtggtggtggaggacgctccctttttcttcttcgacgattctgccatttgatgaagttttatcgaatttcaatcgggagatatgaaggtttgaagattagggaaaaagaggcacgtcgagaggagtgtggctgcgcagcgctactggtttacgtggctatttatagaagatggcattatgtaatcgattacaaggatgctgtaatcgattacaagctatctgttcccgtgtaa

SEQ ID NO: 22046 - DNA, 282 bp, Glycine max
  Peptide Sequence Number=SeqID_113731
atgcccaaggatttcacaatgtataaggttgataatctgagagaacatgttaaggccaatggtctttccaaaagaattgaactagttattgcttcccccttgttaaggtataacttcattggacctatgaccaagagtaagaccaaacagtcaatgggtaccctccaacaaatggtaggagacatacttagcaaggcccaagtagagaaggatgaaggcccaagtggagaaggacgaaggcccaagtggagaaggacgaagcccccgagtggagaaggatga

SEQ ID NO: 22047 - DNA, 558 bp, Glycine max
  Peptide Sequence Number=SeqID_113732
atgaaaaaagaaaaacatgtctcctatagtagtcataactcttgcaagagcctaagtgaagaacttcgtgactattacgaaggaaggcataggtcacatcttagagctcactcccatagaagagaaaaggaaagaaagcctcaagaggctaacattaacctcccatactttgatgggaaggacaatgtagaggctaatttagattgggaaataagggtagagcaacaacttaaaaagaagtttacttcaaaatcttatggctctcactctcatccaaagaaagaccaaggtcaaggcatcttaggggtgacagcttctaagcccaaagatgataaggggaagacaatagaaaagcaagcccataaggctagtatgcaagagaaaactagctctataaagtgctttaaatttcttggaagaggacacattacttctcaaagatccagcctccatagaagcccaacaagcaaacttccatcagttaaggtggaggtaaagcttattgagggtgacaatgttgctaaaaccatcgtggacctttcagaaatcttaatataa

SEQ ID NO: 22048 - DNA, 246 bp, Glycine max
  Peptide Sequence Number=SeqID_113733
atgttcctcgtattcaatagtgctttgaaaggacttgatgatactccagaacctaaatccaaggctgctgctaggtggattgttgttaagtgtaatagacaaaaaggaagcactgagcgcgactattacgtcatgcactggatgtccacgataatctcaggaactttcaggaataattgggaaacgtattttaatgatgttagaccattggaagaagagatattcaaggcgcttcaaatccagtga

SEQ ID NO: 22049 - DNA, 435 bp, Glycine max
  Peptide Sequence Number=SeqID_113734
atgatgcaatcctacctcccaagggtattggatagaagactccaagaggattgggctagagcggctaaagaaggccctagggttctcatgaacctcaggctaagctctagcttctcaagaaagcttctcaaggaggtgagcttagctattagagggtgcctttcgcatggtggtggtgctagtggcgacattgtccttttgtcattgatgaggtggaaggcgtcaatgaccttccagggtctgacaaaaccccatcagggtagggttgtgaaagggagacttagagatttgcaatggagcatggcggttgttcgagaaatgaaaggatggaaacttgcggcggtgactgaaattgggctatttgggatctttaactcaatgtctatgaaactttttcagggttggagatctttgcatcaccgttttatctactaa

SEQ ID NO: 22050 - DNA, 780 bp, Glycine max
  Peptide Sequence Number=SeqID_113735
atggatgagaagagaaagaaaaaattggaggaagttgctcaatctggaagcactaacaccgtgattgatccttcatctcccatcagacgacgtgtgaaatggaagatagcccgcaccaagaaaactaggcaaatgacgtctgaggcagcagagaaattgttgagaagattgattcgttggaggagtaggcctcacagggttcctttgtcgcccatggacgtcaggatcacaaaggagaattgtgttgatacctcaaggaatgatccagacacaggtgactcagacaaatacaggttgtacatcaaagaaaatcctccctgcctggttgccttaggaagagtttatgagggatccacaaccgttcacaacattcctttgctgcatgatcaagtcaaggttggtgttgaggaggttggagatgcagattctcctattcctatacctactgaattggttaagttattggggcagacacttaacaccttccttgcttggtcaacacatcttgtcaagcatttatcaaaacaggttatgtggaatgctaccgtgttcggggtgtttaatgaaaacttccccttgtacataaaacatgaagatctgcctggaatagcactcagtggtcaatgtcttatcatctctgttatacaattgtggattttgccagacaactacttcaaaggactaattaacagtgctttgaaaggacttgaggatactccacaaagtaaatccaaggctggtgctaggtggattgttgttaaaacaaaaaggaagcactga

SEQ ID NO: 22051 - DNA, 382 bp, Glycine max
  Peptide Sequence Number=SeqID_113736
atggagcaacgatatgaggaggagctcagaaagttgaaggctgaccatgatcagttggacgctcgtgttagacgtccccagggcgacgagcattccacttacacattgcctaagtgcacccaaggggactcacagtcaacactcaagatgatccaagcaaatctatacaccaatgacaatgcaatcctgcgtcatgtcttcctaacctccataaaagaggcgacattgatctcgtacggtggacttcctccaaggtccatcgacaacttcgacactctttcgagaattctatcggagcaatcggaggaaaaacttgagaaatctcagggaaccgctatagatgccgctatcgttgtcggaagacacgtgagtccgcttagag

SEQ ID NO: 22052 - DNA, 240 bp, Glycine max
  Peptide Sequence Number=SeqID_113737
atgcagagcttgcaggatgtggtccagcaacgactagttatgagtgtggaggagtttctatggaaggttgcctggctaggagtccaaccttttcctttgggagggggtgaggcctccgcaacccaagagcctcagccagaccaggaggatgactcttctgaaggcactcccactccacctgagccatttatttttgaggatgatccagtgatcatagaggcttgtataaagcttgattga

SEQ ID NO: 22053 - DNA, 282 bp, Glycine max
  Peptide Sequence Number=SeqID_113738
atggctcagtccaacttttctcgcctaggcttcccatctttaatcacagccttatgcaggtcaaggggagttggatatgatgctcttacttcctacaggagcctgaggccggggcaaggaaaaccaggtccagagcagctggtgttccctcttctccagcatcaacagccccatctgcccaaagctcccagacttcagatgctaagttgcagagtttgtttgagggacagattctcaatatgtagagcttacaagaattggcccaccagaggccaatcataa

SEQ ID NO: 22054 - DNA, 294 bp, Glycine max
  Peptide Sequence Number=SeqID_113739
atggtcactacatccctcatgtacatacacaacatacatcatcataatgacattttcaacatcaacaacatctcatctcaatgtcattatcaacatcaacatcatcttgtagaagcaaagattcatggtgaatcaaaggtgattcaaaggtgttttgattataacaatgatgatgacaaaggtgatgacaaaaaagctcaaagatcaatcaagaacagctcaagtgaatctagaacaattcaagagttcaagataagaatcaagaagaattcaagactcaagaagaaagtctag

SEQ ID NO: 22055 - DNA, 576 bp, Glycine max
  Peptide Sequence Number=SeqID_113740
gaacgaggataagggctacgtgggagtacgtgagctcatttggaggtgggcaacaagggatggtgggttatacgtgatttgtggatgtggagaattgttgtgcaccattgcccgaccgccacctagtaccacatgtgatggaatggtacctggagatatgtcgcaggggtcaggagaccttggggacgtcaggcgagctcctgacagtcaacagataaaaggaacaaagaccacaaagcaaggaggcttgtgtggtggctgggccagctgtgaatcttgtgtgatatatgggttatggcctctggtaatcgattaccaagggcttgaaaacgaggtcaggaagctaggagagcttctggcttcaaaggggaattggaagactgtggaggtctctggtaatcgattagcagtctgtgtaatcgattacacagaggaatgggtcactggtaatcgattaccagagtgtacccctttcttttctttcttgtacatcgtgatggcggcgcagctaatccatgatcgagtggagatggagtgcctagagggagcttgggagaccctcgaaggcaacacgag

SEQ ID NO: 22056 - DNA, 318 bp, Glycine max
  Peptide Sequence Number=SeqID_113741
atgggacaccttagtgatcaaggggttcccaaggaccctaagagaataaagatcattcctaattggcccactccaccaagtataagggaaatctggggctgccatgacttaacaaacttttacaaaagtgtgagggaaggagcccagagtatgagaacctcggatttgaggtcaaatcctttccaggtggagggaatgatgcaatcctatcccgcaagggcattgggtagaagactccaagtagattgggctagagatccaagggtaggccctagggttctcatgagccttagggtagatttcgagcccatgggttaa

SEQ ID NO: 22057 - DNA, 621 bp, Glycine max
  Peptide Sequence Number=SeqID_113742
gccaagcatgcgctggccggcagccgcatcgcgctgggcgcgcagaacgtggacgttaacctgtccggcgccttcaccggtgaagtttccgccaacatgctgaaagacgtcggtgcccagtacatcatcatcggccactccgagcgccgcacctaccacaaagaaagcgacgaagtcatcgccgagaaattcgccgtgctgaaagaagccggcctgatcccggtgctgtgcatcggtgaaaccgaagcggaaaacgccgcgggcaaaaccgaagaagtgtgcgcgcgccagatcgacgccgtgctgaaaacgctgggcgcaccggcgatgaaaggcaccgtgatcgcctatgagccggtctgggccatcggcaccggcaaatccgctacccctgcgcaggcgcaggccgtgcacaaatttatccgtggccacatcgccaagcacgatgccgcggttgccgctgaaatcatcatccagtacggcggttcggtgaacgacaagaacgccgcggagctgttctctcagccggacatcgacggcgcgctggttggcggcgcctcgctgaaagccgacgctttcgccgtgatcgtcaaagccgctgccgcagcgaaaaaagcctga

SEQ ID NO: 22058 - DNA, 723 bp, Glycine max
  Peptide Sequence Number=SeqID_113743
atgaaagaagtgctgctttgtgcacttgggatggctaaaagcgaaaaaaagccggtggccattacctgtaccagtggttctgcaacagttaattattatcctgctgtaacggaagcgttttatcagaatgtccccctgttggtgttaactgccgacagaccagtggatttcgtggatatttttgatggacagacgatccgtcagaataatatttttcatcagcattcctatggagacttccagcttttagaggataaagaagaaaatgcagaggatatcaattttgaaatgattaaaaaggcgattgagctttgttttgaaaaacaaggtcctgtgcacatcaatattcctcttgaagaacctttatatgaattggtttctgaacttcctacttttccaaccgtggaaaaaacgattaaaaagaaagaatatgaaattccttcgaatcttgtagcggattggaatacttcacaacgtatcatgatcctggtagggacaaaggattatattcctgagcttgaaaatcagctgtcacaattggttaaaaaccacacagcggttgttttgagtgaggcgaattcaaatgtataccatgaaaaattctttagatttatagaccgttatatctttaattttactgaagaagattataaaaaatatgcaccggatttattgatcacggtagggcagaacgtagtttccaaaaaagtgaaacaattttaa

SEQ ID NO: 22059 - DNA, 147 bp, Glycine max
  Peptide Sequence Number=SeqID_113744
atgaggcttaagaatcaaggaagtcactcagtccattatgcaagccaccaagggaatcaaggagctgaaaagaaatttgtgaagaagcatgataaaggcaaagggtcattaaagataaatgacgactctttgcaaatccagaaaaag

SEQ ID NO: 22060 - DNA, 321 bp, Glycine max
  Peptide Sequence Number=SeqID_113745
gaacgtcctgatttgaagttggtgtcacatgggaggaaggtgacattgattgggaggccagtgcttgagattgaaggactggttagtgccacaggattaagtccactgattgattgttcagttcttactggcgatcctggactaatatccgcatttgtggagaggtggcacaacgagaccagcaccttccaccttccggtaggagagttgacgatcacattggatgatgtgtcgtcactccttcatttgcctatcactggcgcgttgcacagttttcatgctctttctacggaggaggcgagatttttgctgacagagtag

SEQ ID NO: 22061 - DNA, 231 bp, Glycine max
  Peptide Sequence Number=SeqID_113746
atgctttacggcgcccttaccaaacccgtgctagagctagagtcatgggtgagtagaggaggtgcaagagcagatgaaggccgacatggaggccatgaaagagcaaatggaggccatgatgagcatgaagaagataatggaagcccaatgcggttacaactgccgctaccagcactattgctaagaaatgggaaagttggatcatctagaggaaaggctcagggccattga

SEQ ID NO: 22062 - DNA, 350 bp, Glycine max
  Peptide Sequence Number=SeqID_113747
ccagcccgcatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagtagatatgggatcaagtttagcatatgacaccggaatttggggtgaatcctacaggcttttcgctgcaaaattcatttcttggttggtgttttttttggaatcattcacagcatgggtttctccctctttctcaccctcttcatttgccccagttttctcagtcatcctagtaggatga

SEQ ID NO: 22063 - DNA, 213 bp, Glycine max
  Peptide Sequence Number=SeqID_113748
atggaggccataaaagagcaaatggccacaatgatgaaggccatgatgagcatgaagaagataatggaagcctatgcggttatagttgccgctattagcgctgtcgctaaggtgaacccgatgctcccatctggcctcaagcaaatgaatcatccaacctcaatatggaatgggaaagttggatcatctagaggaaaggctcagggccattga

SEQ ID NO: 22064 - DNA, 429 bp, Glycine max
  Peptide Sequence Number=SeqID_113749
atgaaaaagaagttacttcagactgtcgacgagagattgaggcagtttaaattagacctcacgagaaaatgggcccttgtagccaatcaggacggtgtggacgacactgtctgtgagaaatatgacataagcaaggaaaaatgggcccaattttgccagactcgtagagacccttcttgggaggatgtgcggaaaaaggcattggccatccagaaacagaacactgccccccatgttttgtctcgtgagggttatgaatatttggagcagaagctcctggctgagaagaccaagaagaagttggaggaagcgttgatggcatcatcgaccctccatcccccgattcctttgaggagcagccggacacagggatgcttcatcccccgtggacgtcaagattattttcacccgcttctaatggacgtctag

SEQ ID NO: 22065 - DNA, 291 bp, Glycine max
  Peptide Sequence Number=SeqID_113750
atggcatcaaaagctgcaaattataataaactcccctcacctatcgtgaggtccccagaaagacttagaagtcaggattacctcggagaagctacaaaagagaggattgagggatttttctccacgaaatccttgaggtggattctgaggattctgattcaattaaaatgttcctcttggtgtggtggttcagcggcaagcagcagtgactcgtggtggccactggtggtcgtgggtggtggagaagaaggtgttagggtttgggtgggtgtttggagaggaggagagtga

SEQ ID NO: 22066 - DNA, 356 bp, Glycine max
  Peptide Sequence Number=SeqID_113751
gattgacggggcgaactgctagttttcggatacgagatatccaccctagtcactatggacgcatttgtccaattgacacgtcggaaggaatcaatgttggacttattggatctctagcaattcatgcgaggattggaaattctttggcacttaatcgagatattcaggaggaacagactgttccagcccgataccgtcaagaatttcttacgattgcatgggaacagggacaaattttagcggatggtgctgctacagttgacggcgaactcgctttgggaaaaaacgtcttagtagcttatatgccatgggaaggttacaattctgaagatgctgtactcattaatgagcgtctg

SEQ ID NO: 22067 - DNA, 243 bp, Glycine max
  Peptide Sequence Number=SeqID_113752
atgttggtgcgcatgatccacactcgtctttttgcagcggcacaggtgaatcttgccccggaaactactggccccttaaccgggagcgcaagtctcggtgaagcatctaagggcaaaggaccttatattctcttaagtcctctaaaggtgataggtactagtacccaagggttcacctttatgagaaagcaagagatcgactcatcgagagggccagtcatccaacaagattggacacgagat

SEQ ID NO: 22068 - DNA, 540 bp, Glycine max
  Peptide Sequence Number=SeqID_113753
gtcgacggtatcgataagcttgatgcacgagctaaggaagctaaaatggagaaaaaaatcactggatataccaccgttgatttatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaacgtttttatcgctctggagtgaataccacgacgatttccggcaggttctacacatatattcgcaagatgtggcgtgttacggtgaaaacctggcctatttccctaaagggtttattgataaaatgttttacgtctcacacaatccctgggttcatcatgccgtttgtgatggcttccatgtcgcagaatgcttaa

SEQ ID NO: 22069 - DNA, 576 bp, Glycine max
  Peptide Sequence Number=SeqID_113754
acccttgttgttgtggaagaaggggaaacactttgtggatattccagatttgtactgctaaggcctgatcctcaggagttggctgctaagctttgtatccctgggagggaatttgagcttaacgctgacgagcagcctttgaagattctgaggaagagcatgactactctagctcagacatggagtgttctttccttctctaaccagattcctatctcccacacatctgatgtcactcttgacagagccaaactcatttgtggcatcatcatgaagatggatatgaatgtggggtacctcatctcccaccagatctccctcatagcacaacatgacacatccagactaggattccctgccttgatcacaacattatgtaaggctagaggagttcagttagattcgaggtccctggagagcttgagtcctgccattaatttggcttacattaagaagaactgttggaatcttgatgatccaacaataacttttagaggacccaggaaggctaggggtgagagatctgaggccccttccacttcagcatcagaggcattagcaccttcttcttctaca

SEQ ID NO: 22070 - DNA, 463 bp, Glycine max
  Peptide Sequence Number=SeqID_113755
atgttggtgcgcatgatccgcactcgtctctttgcagcggcacgggtgaaatcttgccccggtatgcatagtagctgtgtgatagcctccctctctggttgtgctcgcacaggtggcgctcctccaatatcagggggtggcccctctggtgaggaaccgttaaaaggaaactactgcccactgaaagtgaggacgcgtagtcctctaaaggagagggtgtgcagccctctgaagttcaggacgtgtcgtcctttcaaggcgaggagtgtagtcctaacggtggaaggccctctgatggtgaggacgtgtagtcctctcaaggcgaggacgtgtagtcctctcaacggtgaggtacccaaggtgagggcgtgtaaccctctcaaggcgaggaccactggtcctctgaaggtgagggcgtgcagccctctgatggtgaggacgtgtagtcctctcaacggtgagg

SEQ ID NO: 22071 - DNA, 417 bp, Glycine max
  Peptide Sequence Number=SeqID_113756
cacgccctcgccttcagaggactacacgtcctccctttcagaggactacacgtcctccctttcagaggactagacgtcctatccttcagagggctacacgtcctcacctttagaggactacacctcgtccctttcagaggactacaggactacacgtcctcgtcttcagaggactacatgccctcaccttcagagggctacgcgccctcaccttcagagggctacacgccctcaccttcaaaggactacacatccacgccatcagaggactgcatgtccaggccatctgaggactacatgtcctcgtcatcgaaggactacacgtcctcgccttcagaggactacacatcctcccctttagaggactacatgtcgtcgccttcagaaagccgcacgccctcgcctttagaggactag

SEQ ID NO: 22072 - DNA, 720 bp, Glycine max
  Peptide Sequence Number=SeqID_113757
atgtcctcacatcagaggactacacgtcctcaccttcagaggactacgcgtcctcaccttagaggactacacgccctcgccataagaggactacacgtcctcaccttcgtagggctacacgccctcaccgttgagagggcttcacgccctcgccatcagaggactgcatgtcctcaccctcagaggactgcacgtcctcactttcagaggactgcacgtcctcaccctcagaggactacacgtcctcaccctcagaggactacacaggacttacacgccctcgccatcagaggactacacgtcctcaccttcgtagggctacacaccctcaccttcagagggcttcacgccctcgccatcagaggactgcatgtcctcaccctcagaggactgcacgtcctcaccttcagaggactgcacgtcctcacccttagagggctgcacgccttcacctccagaggactacacgtcctcgccttgggtactagttaccctcaccttcagaggactacacatcctcgccttgagaggactacacgtcctcaccatcagagggctgcacgccctcaccatcagaggactgcacgtcctcgccttcgtagtgctacatgtcctcacatcagaggactacacgtcctcaccttcagaggactacgcgtcctcaccttagaggactacacgccctcgccatcagaggactacacgtcctcaccttcgtag

SEQ ID NO: 22073 - DNA, 288 bp, Glycine max
  Peptide Sequence Number=SeqID_113758
atggctccgaagaagctctccacaaagaggtccaggagggacgcccaagtggaaagctccagtgcccccatggagttcgacagtcacaggttccggagtgccgaacaccaacagcgttttgaggccatcaagggatggtcattccacagggagaagcgcgtccagctcagagaggatgagtactcggacttccaggaggagatagcatgcaggcattggacacctctagtgactctcatggccaagttcgaccctgagatagtcctagagttctacgctaatgcctag

SEQ ID NO: 22074 - DNA, 723 bp, Glycine max
  Peptide Sequence Number=SeqID_113759
atggctccaaagaaactctcgaccaagaggtctaggaaggatgccactggagagggttccagtgtggccccacaagcagatatggattttgatagacaccggttctggagtacggaacaccagcaatggtttgaggccatcaaaggctggtcattcctcagagagaggcgagtccagctaagggacaaggagtatgtggagttccaagaggagatagcccgaagacaatgggctcagctcgtatcacccatggctaagtttgatcctgagatagtcatagcctacagacgaaggagccaaagacatgcgctcctgggccagcgctgtgagttctcccaaaggaggagtcaggcctccgacttcgaggattacgcctctgagatacccagtggacccgaagggtttcttgctctcatcacaggcctctgtcagttctatggaatggaggaaggtgtcgggtcaggcaccccagcagccaaaggaataccagcagcagctgcagtagatgcgccaccgccgcctctagaggaggacctcagtcctttcccttggcctacccccgagcagtttgaggccacggtggcctggcctggggacaagactgatttcaagacacaggcaggacctacaggagctctggggatgacgaaggagctcaggaggataacaacatggctaacgtgttggacttcgtcacttgataaggctgagttgcacgactga

SEQ ID NO: 22075 - DNA, 246 bp, Glycine max
  Peptide Sequence Number=SeqID_113760
atgcagggttgcctaagctaccggaagccaattgattctgaaagatggatctatgttggagatggttttcttccaattcagatattgttggaactagttcactcttggagctcgaccaagtcaaagcatattgacatcaagttcctagttgttcaggaaatggtacagagtggacagatttccatagaacacttagggacaaactccatgatagtagatcctcttactaagggacttccaccctag

SEQ ID NO: 22076 - DNA, 207 bp, Glycine max
  Peptide Sequence Number=SeqID_113761
gccagcaaagcccttctaccgcagcggggcccacaggcctatgccaatctcttagggcaggttctctttcatccgtctttcctaggtgcgcatctccatctactaaaaggtatccgagaggggcacaatgcaggctggagatcatctggtaaggagaatccccaggctttagatagtttagagggactaggcaatgagcccggataa

SEQ ID NO: 22077 - DNA, 420 bp, Glycine max
  Peptide Sequence Number=SeqID_113762
atgctcgaaagttttcaacaacaagatcaaatgtcaattctggaattgtacatagaaaaggatgtggctggtggttctatgtttcattttgcaaattctcttacatcatgtggaaaaactttatctaataatgaggcacaatcgccaagaaatgtgagcaatttacatgagtctttagacgaagatgatagtgttgacaatatatctgatacagacgatgaagtcactgacatgattcaaccagtaagaattgttcacccagcagaaggtgtagaaggaattcaaaaatccatttttggaatgatgctttgcatttataacaatatcaactggagtcatcctgatgaggaggacatttgtggtttggagatgccatccaattttaatgttggcaagaatatatgttggcatggattttga

SEQ ID NO: 22078 - DNA, 222 bp, Glycine max
  Peptide Sequence Number=SeqID_113763
atgcaacatctgatgaagcttctcgaacatgatcaatacattcattggcatagattaaaggatgaagttgtggtgcgtgatctattttggtgtcacccagatgcagtaaagttatgcaatgcatgtcatctggtgtttttttttatagatagtacctacaaaacaaacaggtttcgtatcgataagaatgtgaaggcgaagtgcaaatctttaatcggttaa

SEQ ID NO: 22079 - DNA, 678 bp, Glycine max
  Peptide Sequence Number=SeqID_113764
atgtcctacacttcaaaggactacatgtcctccacatcagaggactacacgttctcccctttggagcactacatgtccttgccttacgagggctacacggcttcaccttcagaggactacacgccctcaccttcagaggattacacgtcctcaccttcagaggactacacgtgttctcaccttcagaggattacacaacctcgccttccgagggctagacgccctcgccttcagaggagtacacatcctccccttgagagggctacacgccctcgccttcgtagggttacacacccttaccttcaaaggagtacacgtactcaacatcagaggactatacatcgtcgccatcagaggctacacgtcctcgccttcagagggttacacgtcctccacttcagaggactacatgcccataccttcaaaggataccttcataggactacacgcccttggcttcgtaaggcttcacgccctcaccttcagaggactacacatgctcgcctacagaggactacacgcctttgccttcgtagggctacacgccctcaccttcagaggactacacatcctcgttttctgagcgatacatgccctcgccttcagaggactacacgcctaacctttcaggggtctgcacgtccttgccttcagtgggctacacgtccttgcctttag

SEQ ID NO: 22080 - DNA, 397 bp, Glycine max
  Peptide Sequence Number=SeqID_113765
cttcggttactgcaaagaaagggatggctcttgggtaaagaagaatgctccaatacaagctgctgaagatcgctctccatcaccacattctcagagagatgactcttcatctcttttgcacagtattcttgaaaggtttgatggacttcaaacctatgtaggtgagaggattgtcatcatcaaaaagggggagattgtggaagcaatgctttccaagattattttgatgatgccaaagactcaagtcaagaatcaagagtcaagcaagtttcaagaatcaaagggtcattcaatcaatgcaagtttcaagaatcaaagagtcattaaatcaaagcaagtttcaagaatcaaagagttgttcaatcaaagcaaatttcaagaatcaagattaaagtga

SEQ ID NO: 22081 - DNA, 372 bp, Glycine max
  Peptide Sequence Number=SeqID_113766
atgggtctgtacatgtgcccggtggttggccgcctgctggcgaaccaaatgccacaaatactgctccgtatcaaacgatccggctggaccggcctgatgaggtggcggcgcatctgcggcctgcggagcatccccctgggcctgtctctgcgtgcaatacttctcaataaaagctcgggtgatgggcggccgaatcaccttgctaggtgcgacagggaatccgaacgactagcagagtcctgtgatcaaggcgggaaatcccagggtcctgttggacttatccgggtccagagggtgcctggatggtgtacaccagctgacacttcggtagggggaggtcggaattatggtcgctgggctggatgttgctga

SEQ ID NO: 22082 - DNA, 192 bp, Glycine max
  Peptide Sequence Number=SeqID_113767
atggtagccataacctcttctaggtttcctcaacctccatttctccgaggatacgactcgaacgcaacgtgtgcttatcatggaggagccccggggcattccattgagcattgtagggccctaaagcataaggttcaaggtctaattgatgcgggctggctgaaatttgaggagaattgcgtagagaagtga

SEQ ID NO: 22083 - DNA, 282 bp, Glycine max
  Peptide Sequence Number=SeqID_113768
atgaagaagattttccttctttgtacagacacatttcagagggttaccataggaaaaccgagagaattcattgacaggccatcagatctaaatatttgggaagcaatagaattaggaccacaagatatacccaagtcctatagtgctacaagatgtcaagcacaagtcactacaaggcccaaaaacctagagatgaagtgcatagaagaagataggaaaagaaaaatccagtatgatctcaagaagccaaaaacatacattcgccctaggaatagacaatga

SEQ ID NO: 22084 - DNA, 126 bp, Glycine max
  Peptide Sequence Number=SeqID_113769
atgaatttgagggggagactgctgctgccgatgatgactggtattccgctgtgcttgattactctgataatgaaagttgctgatcccacttgcataactgctcgtacctgctcaggaagtgtctaa

SEQ ID NO: 22085 - DNA, 321 bp, Glycine max
  Peptide Sequence Number=SeqID_113770
atgccgatctccccctgcggaagtatcagttggtctgtgccgtcccgacatagggatcgcacccacaagacacctagtggacccagaaaagtccaacagggccctggggtttccagctctggttacgggcctctatcagttctacagggtgcccgtaccccccggcaaggtcacgtcatcatagggatcgcgcctgcaagacacccagtggacccgaagaagtccaacagggtcttggagttgtcaagctctaattatgggtctctgtcaattctacggagtacctatcacctccagcaagggcatcaggccccctactaa

SEQ ID NO: 22086 - DNA, 204 bp, Glycine max
  Peptide Sequence Number=SeqID_113771
atggcttcgaaaaagctttccccgaagaggtctagaagagacgccgcagcggaagggtccagtgccacccctgagtttgatagtcatcgtttccggagcaccgagcaccagcagcgcttcgaggccatcaaaggatggtcgttccatagagagaggcgcgtccagcttagagaggatgagtatatggactttcagaggagatag

SEQ ID NO: 22087 - DNA, 213 bp, Glycine max
  Peptide Sequence Number=SeqID_113772
atgatcctttcatcatggcagaacaagctagacaagtattttatgtgcaagacccttgtgatgaaaggtgaagatgatgatgcatacatggacacgtatgttagtcctttgtccacacaaatcactctcaacgttgttggagaagaagaagctgacgacgttcatgctaaccataatgatcatgatgaaggagaattaattaacatcgtctaa

SEQ ID NO: 22088 - DNA, 522 bp, Glycine max
  Peptide Sequence Number=SeqID_113773
atggacaaattgcttttcttaggaacacatattcgttaccacgaaaaggataatgatatcccttcaacacaacataggtcatcgaaaggatctcgaagacccaccaacgcacgaaagccgggatctttcagaaaatggattcctattcgaagggtgcataaccgcatggataagctcacactaacccgtcaatttgggatccaattcggttccttaggaggtatcgggaaggaattttggaatagtggcagtaagggtgacttatctgtcaacttttccactattacacccaaaaaaccaaactctgctttacgtaaagttgccagagtacgcttaacctctggatttgaaattactgcttatatacccggtattggccataatttacaagaacattctgtagtcttagtaagaggggggagggttaaagatttacccggtgtgagatatcacattgttcgaggaaccctagatgctgtcggagtaaaggatcgtcaacaagggcgttctagtgcgttgtag

SEQ ID NO: 22089 - DNA, 310 bp, Glycine max
  Peptide Sequence Number=SeqID_113774
atggctaaaatcgttgtccgtgagacactggtacgaaggttgaacaatatatttgtcaccaatgccaggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaggctgcaccg

SEQ ID NO: 22090 - DNA, 213 bp, Glycine max
  Peptide Sequence Number=SeqID_113775
atggacaacttcttcgccccccgttttcaccatgggcaaatattatacgcaaggcgacaaggtgctgatgccgctggcgattcagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 22091 - DNA, 494 bp, Glycine max
  Peptide Sequence Number=SeqID_113776
catcgggggtttagggcgtttaaagagatttcatctttccagggtcagctgagatggggtcatatggttgtcacagttcgaccgaagagggtggtacgccagtttggttacatccagagcatccctccgccgcctgttagtgcacgattgtcacacgatcagatagatgacaggtggatgcagtttgcggatcacttactacctgcaggtcagctttgtctagtgcctggacaggtatctgcagattacatggagtggtttttccgcatatctcacccattcatgacaccgacccaggcaggtgaccagcggagggatgcaccagctgtagaccctgaggactacatacagccgcccagcccccaggttccagttgcatttgacccccctccacatgtggatgattacgagggatatgaggcgattgcacagaggttggagcgtgtgctcaaccttaggatagtcactgcaggcacggagttatatgacattat

SEQ ID NO: 22092 - DNA, 555 bp, Glycine max
  Peptide Sequence Number=SeqID_113777
atggggaaccacccaagaccaaactttaatgcaggtgggtattctggatttcaacatggccaacaatttaatcagcaactgggacagtggagaactcaccctagtaatcagtttaataaagaccagggtaggccatctaataggccacaacaacaagggcctaatctctatgacagaacgacgaagctggaagagactcttgctcagttcatgcaagtatccatgtccaatcaaaagagcacagagtcagccatcaagaatctagaagtccaggtgggacaattggcaaaacaactggcagaccgaccgtcaagcagctttggagccaacacagagaagaatccgaaggaggagtgcaaggttgttatgactagaagcaaaatggtgagcatgaatgaaggtaataagaggatgggtgaagaaaaacaacaactgatgactgaaccaaaaattgccccagtcgtggaacctttgagtgagactgaggaagaagtagaagcaaaagatgatcagcagaaggagataccaataatagtgagtgaaaagaataagtag

SEQ ID NO: 22093 - DNA, 613 bp, Glycine max
  Peptide Sequence Number=SeqID_113778
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggaacttgacaaaacaaacaaagaaaaacagtcgctgctcagtaagataaagaaattggaagcagaaaaacaggctggtgctgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 22094 - DNA, 242 bp, Glycine max
  Peptide Sequence Number=SeqID_113779
gtaagcgctgctttatttgccctcttcaagtccacaaccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 22095 - DNA, 246 bp, Glycine max
  Peptide Sequence Number=SeqID_113780
atgattgaaaatatgtgtgcacttcaaagcactggtacttgggatttgttaccttttccccctgggaaatccacagatggatgtcatttgttgtataccattaagtttgccccgatggtaccattgatcaattcaagcctcttttggtaccaaatgatatacacaagtgtacagatgtacatggagcaaccacaaggatttgttgctcagggggagtcctctactatggtttgtcaacttcagtag

SEQ ID NO: 22096 - DNA, 168 bp, Glycine max
  Peptide Sequence Number=SeqID_113781
atgactcacaatgcaaactacaaaattttgaaagagttggcaccaacttctaaagctttggtaatccaggatgtccaaggaattaatgaaacattgggcttaatccggattttggttgtggacttgaagagggcaaataaagcagcgcttaccttagttaatttctaa

SEQ ID NO: 22097 - DNA, 312 bp, Glycine max
  Peptide Sequence Number=SeqID_113782
gaagagggccaggagtgtgcaccaccaccacctcatcaggctggcccggctgggtcatttgacatggagcagtatttacggcatttggttcgccagcaggcggccaaccaccgggcacatagccagggcttcgcttctttttcatgccctactccagaccagttcagggcagaggtcgcatggcccggggattggcccgaggcccaagcaggagaggcacccccagaggctcccgacgatggagaggaggcccacgaggacgaggagatggccgatttgcttgacttcttgggagggagtggagctacatga

SEQ ID NO: 22098 - DNA, 263 bp, Glycine max
  Peptide Sequence Number=SeqID_113783
atgtgtccccttcctccttggtctaatgaagaaggggacacatttgagactttgagtgatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 22099 - DNA, 900 bp, Glycine max
  Peptide Sequence Number=SeqID_113784
atgtgtgtgatgaaatggccccaaggaagcttgcctcaaagaggtccaggaaggacaaggcagccgaaggaactagttccgctccggagtatgacagtcaccgctttaggagcgctgtacaccagcagcgcttcgaggccatcaaggggatggtcgtttctccgggagcgacgcgtccagctcagggacgacgaatataccgatttccaggaggaaatagggcgccggcggtgggcatcattggttacccccatggccaagttcgatccagaaatagtcctcaatgagttttatgccaatgcttggccaacagaggagggcgtgcgtgatatgagatcctgggtaaggggtcagtggatcccgtttgatgcagatgctatcagccagctcctgggatatccgttagtactggaagagggccaggagtgcgagtatggccagaggaggaaccggtccgatgggttcgatgaggaggccatcgcccagttgctatgtataccggggcaagattttgcccggactgctgccgggagacgggtgcggatcatgcgcaccaacatgaccaccctgactcagatatggatgactttgctgctcagcaacatcgtgcccaccgatcataattccgacctccccctgccgaagtgtcagctggtgtatgccatcttgacgcggatgagcgtccatgtggctcagttaatcgctgatgccatctatatttttgcaggtatggcacctaccaggcaccctctggacccagataagtccaacagggccctgggatttcctgccttgatcacaggactctgccagtcgttcggcgtccccgtcacacctagcaaggtgattcggccgcccatcacccgagcttttattgagaagtactgcacgcagagacag

SEQ ID NO: 22100 - DNA, 594 bp, Glycine max
  Peptide Sequence Number=SeqID_113785
atgagcgtctcgatatattacgagattcattcggacatccgagtaaaaagttattgtcgtttgattttgctcaaagcttctgttatgaatttcgagtgtctcgatatactacgggacacaatcggacatccgagtaaaaagttattgacatttgaatttgctcatagcattcgttgtcaattacgagcgtctagatatattaaaggggggggttcggacatccgagtaaaaaggggagtatctttttattttgctcagagcttctgttttcaatttcgagcatctcgatatattacaggactcaatcggatatccgagtcaaaagttattgtcgtttggatttgctacgagcttccggtttcaattacgagcgtctcaatatgctacgggacacaatcggacatccgagtaaaaagttattgtcgtgtgaatttactcagagcttccgtcgtcaattacgagcgtctcgatatattacaggattcatttggacatccgagtaaaaagtcattgtcgtttgattttggtcagggcttttgttctgaatttcgagcatctcgatatactacgggacacattcgaacatctgagtaa

SEQ ID NO: 22101 - DNA, 129 bp, Glycine max
  Peptide Sequence Number=SeqID_113786
atgagggcagtagcagagaaaccaggaggaacagagggagctgaaaggaaattggaggaaggtatttgggaaagtgaaggtgtagaggctgaaacaggaggagataggtcaggattgaggctgaaatag

SEQ ID NO: 22102 - DNA, 165 bp, Glycine max
  Peptide Sequence Number=SeqID_113787
gttagctcgcttgggcgagctgagctcgcctgggcgagcaacccctgcacgaaatgggttaaaaaggggaagggggaaggtttctacaccaaaaactcttcccccccccccccccccctcattcaaaaagaaggctacgggaatcaccaattttgcagcccctag

SEQ ID NO: 22103 - DNA, 819 bp, Glycine max
  Peptide Sequence Number=SeqID_113788
gttcccctcatgattattctttgtgttctttcgggcctcgaatccgggtatacgttgcacatgatggatccagcaggaggtcagcctgctgccaatcctgcagcggagcaaccctcaaacgtgccttcaggcgcatcgacctcgggctggagaagtttcgaagaaggtgttttgttagaatcttcaaacgaatccagcgaagcgagcgtgaatcagcagcctgtgattcccgaacttgaacctccgcttctcgatgacaacacccggcgagcagagctcgctgttcgattgagggcgaattggtgggggatcgcttataacgagcgaatcctcgactccttcgtccggagtcaacttgcaatcgaaaggcacatagaggccgcacttgtggcggacggatattccccgcaagggcatgcgctgagtgaaaacgcttacgcgggttatctgaccaaaattgccaattttgccggcaaaatgactacaggatcatcggtctactctacctcaattcaccatttcgaactttatacagaaggtttttccgtaccagctccttctacctataccgctgttgaagcacctaaaggagaatttggtgtctttctggtcagtaatggaagcaatcgtccctaccgtcgtaaaataagagcacctggctctgcccattcacaaggactcgattctctgtccaaacatcacatgccagcagatgtggtcaccatcatagtggatgagatcggtcgagtggtctccgttggagatgggattgcacgtgtttatggattgaacgagattcaagctggggaaaatggttga

SEQ ID NO: 22104 - DNA, 471 bp, Glycine max
  Peptide Sequence Number=SeqID_113789
atgctgccatactattttcagattccattaggagcgattttacccattgttgatcctgtggtagctgtgtctccgccaaaaccacctccgaagcccgatctggaggtcgatgatccactttatctgatgacattgaccatcccagagcttttcttgaggccttatcaggttagatgggatgccaccgtgttcggggtcgttaatccagatttccccctgtacataaagcacgaagacctctctgaaatcgcacacggtggtcaatgtctcagcatatcagtgttacagttgtggattctgcatctcactgaaacatgtatgcgagcggggaattctgatatctatggattcctcgagccacagtccattcagaggtctaggcaatcgcagtttgaatctgaaagttacataaagagttggatgcagagttcacaacgcgatgtgtatcttggagcctacctaaatgggtaa

SEQ ID NO: 22105 - DNA, 618 bp, Glycine max
  Peptide Sequence Number=SeqID_113790
atgatttccattgcccagtctaattcttgcagacttgggtttcctgctttgattaccgccttatgccgagcccgaggggttgtctctgacagcctcacatttgagcgcctgagcccggccattaacttggccgacatcaggaagaactgttggaacattgatgatctaacaattgctttccggggtgctaggagggcaagggcgaggccaactgatattccatctacttctgcagctccaacatctacttttgcagctccttcagttctagctcatgttgactcgcagcgctttgaagccatgcttcaaaatatccatcagggatccatcctatcagtggagcagtttttagagagggtagcctggcctggggcccaaccttctcttgatagggaaagtgaaggtcccacagcccaagtaccccaacaggcaggggaagaacaggcgagaccagagactgctgctactcctgagagatcccttgagggcacatcagagcctcatactccagtggcaaacttcttgttccccaattgcaattactttttgttcatttatgtctcaaggaaatttcaatgggggtttatcggaaagcgcaccggatcgtcaagtatttaa

SEQ ID NO: 22106 - DNA, 227 bp, Glycine max
  Peptide Sequence Number=SeqID_113791
gattgacggggcgaactgctagttttcggatacgagatatccaccctagtcactatggacgcatttgtccaattgacacgtcggaaggaatcaatgttggacttattggatctctagcaattcatgcgaggattggaaattctttggcacttaatcgagatattcaggaggaacagactgttccagcccgataccgtcaagaatttcttacgattgcatgggaacag

SEQ ID NO: 22107 - DNA, 789 bp, Glycine max
  Peptide Sequence Number=SeqID_113792
gccggcgttctccagggcgacgtcaaggacgttctgcttctcgacgtaaccccgctgtctctcggcatcgagaccctcggtggcgtctttacccgtctgatcgagcgcaacaccacgatcccgacgaagaagagccagaccttctcgaccgccgacgacaaccagcaggccgtcaccatccgcgtttcgcagggcgagcgcgaaatggcacaggacaacaaactgctcggccagttcgacctcgttggcctgccgccggcaccgcgtggcgttccacagatcgaagtcaccttcgacatcgacgcgaacggcatcgtgcaggtttcggccaaggacaagggtaccggcaaggaacagcagatccgtatccaggcttccggtggcctgtctgacgccgacatcgagaagatggtcaaggacgctgaagccaatgctgaagccgacaagaagcgccgcgaagccgtagaagccaagaaccaggccgaaagccttgttcactcgacggaaaagtcgctcaaggattacggtgacaaggtttccgaagccgaccgcaccgcgatctccgacgcgatcgctgccctgaagtcctcgatcgaggctaccgagcccgacgccgaagacatcaaggcaaagacccagacgctcatggaagtgtccatgaagctcggtcaggctatctacgaagcgcagcaggccgaagccggcacggctgacgcgtctgcaggcgatgacaatgtcgtcgatgccgactacgagaagtcaagacgacgaccgcaaaagtccgcgtaa

SEQ ID NO: 22108 - DNA, 465 bp, Glycine max
  Peptide Sequence Number=SeqID_113793
atgtttaaaccggaactcctttccccggcgggaacgctgcaaaatatgcgttacgctttcgcctatggtgccgacgctgtctacgcgggccagccgcgctactcgctgcgcgtacgtaacaatgaattcaaccacgagaacctgcagctcggcatcaatgaagcgcatgccctgggcaaaaaattctacgtggtggtcaacatcgcgccgcacaacgccaagctgaagaccttcatccgcgacctgaagccggtggtggagatggggccggacgcgctgatcatgtcggatccgggtttaatcatgctggttcgggagaacttcccggagatggatattcacctctccgtacaggctaacgccgtaaactgggcgacggtgaaattctggaagcagatggggctgacacgcgttatcctctcccgcgagctttcgctggaagagatcgaagagatccgcacccag

SEQ ID NO: 22109 - DNA, 171 bp, Glycine max
  Peptide Sequence Number=SeqID_113794
atgaagaatattccagattcgggagttgtatttacgtttgaggaaggtattagtacctctcatgtcgacaaaagcggggctcttgctcctacgtacccttcatcgaagaggaaatcagacctgcgtagttctttcaaaagggcgaatcaaacgattctttttacttggaag

SEQ ID NO: 22110 - DNA, 456 bp, Glycine max
  Peptide Sequence Number=SeqID_113795
atgcctcaaatcaagtgtgcacgtgacttcaaaaggtcgatgaggggatgcccttgctcttacgtatcctcaagtgcaatgaggaattcatacctacctagttctttaaaaacaaaaagggctattaaggtgttggatcttgaacgatctcaagcaaagggtcactttggggtagttgtagctcgcctaggcgagctgaaacttagtgctgaagcaatgagctcacccaggcgagctggtttcttcaccatgaagctatttggtggcctaagtgagccagaagctagcctgggcaagctagggtccaggaaaccaaggaaaagacccttttgccccctttttttggtatttttcgcattctttatcaaaacattgaaagatcatctgtttcgcactgtaactggcgttcaacactgtaagtcaactagcaaggatcaaaagatcaacgaacgatag

SEQ ID NO: 22111 - DNA, 343 bp, Glycine max
  Peptide Sequence Number=SeqID_113796
ggattgcacccacaagacacccagtggacccaaaggagtccaacagggccctgggatttctagctctggttacgggcctctgtcagtcctacagggtgcccgttccccccagcaagggatcacgcccgcaagaaaccccgtggacccgaagaagtccaacagggtcctggggtttctagctctagttacgggcctctgtcagttctacggagtgcccgccgcccccaacaaggtcatcaggccccctattaactggattttcatcgagaagtactacgccccaggtaggcgcagggcgaggcatcacagtagtgggcaacaggcgcaccgccaccacctctag

SEQ ID NO: 22112 - DNA, 279 bp, Glycine max
  Peptide Sequence Number=SeqID_113797
atgggtgaagtagaggacgtacaagagaagatgaaggccgacatggaggccatgaaagagcaaatggccacgatgatggaggccatgatgatcatgaagaagataatggaagctagtgcgattgcagttgccgctaccagcactgttgctaagacacatgaaattccctaccacaatctagccaacttcgagccttgcctcggatatgccactgaagggcaagcagttggtggtatacccctacaaaaccctttggagggccctcagtatcatccctag

SEQ ID NO: 22113 - DNA, 340 bp, Glycine max
  Peptide Sequence Number=SeqID_113798
tctgagcctggctagtaagactgatgaaacttccattgttgaaaaactaaggaaagaagtagcatttcttactaatgactttgggaagttcccggaaagttcaaagactctcaccactttatcaaaattgcatcaacatccccacgataagtcttacctgggctttgaaaagggaacaacttccttcgagtcattgtctgctttagacaaatgtgacttctatggaaaaggccaaggtttaagttggtataaggacaatggttgctcacgacacatgacaagggaaaggtctatgttcctagacctaaagccacatgaaagaggagtagttgccttatga

SEQ ID NO: 22114 - DNA, 454 bp, Glycine max
  Peptide Sequence Number=SeqID_113799
atggggacaaatcaaactggcaaaaggttttatcaagtcaagattaagggcctagatatcaccagcatcaaggagttggggcggttgatgggacctctccaaatgcaagcctcccgcaagacgtacggaaagatcttagatttgaccatagcagagatatccccagaagccattgcatcactcacccaatactatgaccagcctttgagatgcttcacgaaaccgtatcttttctctggctttcttccctccttgagcaaaattgcagttgtggtcagggatccggcgagaggattggaccgcgtgaagcaaactcgaaacggcatagtgggcctaccacagaagtacttagaaggcaaggcgatggatatggtgaatcaagaggagtgggtcccgtttatggatgtattagcattgctaatctttggggttgtcctctttccaaacgtagatg

SEQ ID NO: 22115 - DNA, 327 bp, Glycine max
  Peptide Sequence Number=SeqID_113800
atggataagagcttgaaggaaggagaagatgagtggagggagacggagagaaagagcacgaaattttacgcctcaaatgagcctatggactcgaaatctatcttaaggctcatgagaaccctagggccttctcttacatctctggtccaatcttcttggagtcttctatccaatgcccttgaggggatttcgctccaattaaagcattcctctctgagcggtggttcggcgacaagcaacagtggctcatggtggccaccaatggtcatgggtggtggagaagaaggtgttagggtttgggtgggcgtttggagaggaggggagtaa

SEQ ID NO: 22116 - DNA, 570 bp, Glycine max
  Peptide Sequence Number=SeqID_113801
atggctaagtacaatctcgagatggtcatggagttctatgccaatgcctggcccacagaggagggagtcagcgacaagtgctcctgggtgaggggccattggatccccttcgatgaggatgccattaatcagttcctggggcatccattggtcttggaggagggccagtgctgtgagtttagccagaggaagagccaagcctcaggggatcacacctcacagacacccagtggacccggagaagtccaacaggccctggggtttcctgatttgatcactagcctttgccaatcctatggagtgccggtaggtgcagggtcaggcaccgcagtagccagccgcaggtgcaccgtcgccccctctacaggagacactgtccctggggtccatctccgctcacctggggagagccaggacaccaggcctttcctgtggcctacccccgagcagtttgaggccacagttgcttggcctagagatgagcctgattttgagacagggcaggacccacagaggcccctggggacaacgagggagctcaggaggatgatgatatggctgatgtgctag

SEQ ID NO: 22117 - DNA, 162 bp, Glycine max
  Peptide Sequence Number=SeqID_113802
atgaggataagggctacgtgggagtacgtgagctcagttgaagagtggtacctggagatatgtcgcgggggtcaggagaccttggggacgtcaggtggggtactattgcccaaaaccaagcttgaccaatcccgacccaacccgggcgtagtcagtcagtga

SEQ ID NO: 22118 - DNA, 726 bp, Glycine max
  Peptide Sequence Number=SeqID_113803
atggcatcattggtggattggctcgccaggttaaaagtcgtcagcgaagagagttttgaagcaccggaagaggacgaagaagtccaagctctcaaaagtgagttaggaaaggcgaaacttgccaaggagaagttcaagttggccactacacacatccggaaggagtgtgccggattacgggaagagaatgccactaccgcaagagcccttgaacaagagaccaagagggctcgcaaggaagagtatggccggaataaatttcgcagagctctgtggggtagcaacaatgaactcaagctgcgaagggaagagagggaccagtcgcgagcacatagcatagtcttgaaagaggagttagttgcctgttcaaggtccaaaaggagcttgtctcagcgtttatgcgagatggagaccaacatgctagctatcatcgccaagtaccaagaagtgttaggtctagccacggcccacgagcgtagggtcgcggacgagtatgctcaagtatatgcggaaaaagaggctagaggaagggtgatcgactctttacaccaagaggcaaccatgtggatggatcggtttgctcttaccttgaacgggagtcaagaactttccccgcttgttagccaaggccaaggcgatggcagacacctactccgcccccgaagagattcatgggcttctcggctattgtcagcatatgataaacttaatggcccacataattag

SEQ ID NO: 22119 - DNA, 624 bp, Glycine max
  Peptide Sequence Number=SeqID_113804
atgaggggcaccgtgcatgagcctcaaaggactacactcctcgccaacagagggctgcacgccctcaccttaagaggactgtgtgtcctcactttcagaggactgcatgtcctcaccttcagagggctacacgccctcgccatcagaggactgcatgtcctcaccttcagagggctacacgccctcgccatcagaggactgcatgtcctcaccttcagagcgttacacgccctcgccatcagaggactgcatgtcctcaccttcgtagggctacacgccctcacctttagaggactacacgtcctcgccaacagagggctgcacgccctcaccttgagaggactacacgtcctcgccaacgtagggctacacgccctcacctttagaggactacacgtcctcgccaacagagggctgcacgccctcacctttagaggactacacatcctcgccttcagaggactccatgtcctcaccttgagaggactacacgtcctcgccttgagaggactacacgtcctcgccttgagaggactacatgtcctcaccatcagagggctgcacgccctcacctccagaggactacacgtcctcgccttgagagggctacggggatcctctaga

SEQ ID NO: 22120 - DNA, 618 bp, Glycine max
  Peptide Sequence Number=SeqID_113805
atggagggggagcagttaatgccgtcgagtcggatgatagatcgaggccggctggaagtcggcgatgaggggagtgaagagcagcatacacgtatgcagtccgcagatgagagaagttttggaaggcctaagcctttggtggtatatttcaccagagactcagctcctcaaacgccccaacacccctcgatatttaaacctgttccgtttccgtaccgaaatagccacgcagttccgtggaggtatgcgcctccaagcgaaaggaaggaagaggccactaacatcagcttgttgtcagccaaggtaaccaatatcacggggctgagcggcgtgacccgcagcaatcacgtgtttgcaccccctgaccttccgacacaacccgcaaacgttaaagggaaggcaaagatggtggaagaacaaaatgacaaaacgaccctcactctgaacgaggatattccagtgaaaggtcttctggagaaaagggatggctgtggcaagaaagacgtatcgctagaggaggcaggcgagttcctccgcattattcagcaatgcgagttcaaggtcattgagcagctcaacaaaccctggccaaggtctctcttttggaactactcatga

SEQ ID NO: 22121 - DNA, 483 bp, Glycine max
  Peptide Sequence Number=SeqID_113806
atgccgatctccccctgcggaagtatcagttggtctgtgccgtcccgacataggggtcgtgcccacaagacacctagtggacctggagaagtccaacagggccctggggtttctagctctgattacgggcctctatcagtcctacggggtgctcgtaccgcccaacaagggatcgcgcccgcaggacacctagtggacccaaagaagtccaacagggtcctggggtttccaactctgattacgggcctctgtcagttctacggagtgctcgtcacccccagcaaggtcattaggccccgcattaaccgagctttcatcatgaagtattgcgctcctagacaggcagagggcaagacaccacaacagcctggggatggctggcaacaggtgaccaagtccaaggccaaaggcaagcaaagtactaggtccgtgaccgacaagtcatcaggcgtccagctcaagacgttaaagaagcgctactag

SEQ ID NO: 22122 - DNA, 162 bp, Glycine max
  Peptide Sequence Number=SeqID_113807
atggcttcctatggcgtggcgtctccaatcatgtttctccttctccattctactgccataaaacttcaagaagcaaagggctcgattgataaagaagatccaaggcctacaagctccataagagctacatcatgtggtatcagagcatcttcatctaggtga

SEQ ID NO: 22123 - DNA, 213 bp, Glycine max
  Peptide Sequence Number=SeqID_113808
atggcacgcagcgtgtccgcttcgtgcccctattcaagggacctatatgggagggagctaactaggcttttagtgataattcccaaggtggtcatatctctcttgatggtctctagaggtatcatccccttcgaagaacatactgcaacagtagggactactagcaacaatatgttttcaaagagaaaaactctagatgagggttcactgtaa

SEQ ID NO: 22124 - DNA, 282 bp, Glycine max
  Peptide Sequence Number=SeqID_113809
atggggatcacacccacagagacacccattggacctgaagaagtccaacagggccctggggtttccagctctggttacgggcctttgtcggccctacagggcgcccgttcccccccagcaagttcatgtcgttgtggcataggtaaggagtgcctgtcgcccccagcaaggtcatcaggcccccccctaccaatcgagctttcatcaagaagtactgcgcccccaggcaggcgcagggcgaaacaccacatcagcattgggatggctggtagcgggcaatag

SEQ ID NO: 22125 - DNA, 357 bp, Glycine max
  Peptide Sequence Number=SeqID_113810
atggtgggttacacaccttcaagctttgcggatttggtcttcaccgacgaaaggatcaaagtgggtctggaaaaaggcaaatctgatcatcctgctttgatgaatgcaaaaactggggcaaatgaagaggatgggaatgagggagaaacccttgctatgactgccattcctacacggtcaaatttcccatcagcccaacaatgtcattactcagccaataacaatccctctcacccaatcatccacaaaagccatccccaaatcagccacaaggcctacttgcttaccacacgcctaatgcccaaacaccatcttcagtgcaaaccaaaaaagaattttgcagcaaaaagcctgtag

SEQ ID NO: 22126 - DNA, 357 bp, Glycine max
  Peptide Sequence Number=SeqID_113811
atggcagcacagttgatccatgatcgcgttgtgatggaatgcctagaggtacatccggagcaacctgcacacacacttcagcagcctgtggagtggatactacctacacctactccatatcgactagttgagccggttcaagtgatagaggtgtcatcctctgaagaggatcttgaagaggacccagaggagttacctcctgtacctgctatggacgcccctgacttaccagaggatgatgaggacccactccctgatgttgattctccagaggatattatattagcatctgaggcagactctacagaggagagtggccctggagggacaacgaatagtgacgactcttcatcatag

SEQ ID NO: 22127 - DNA, 411 bp, Glycine max
  Peptide Sequence Number=SeqID_113812
atggagatgatgcaaaagaccttacatggcatgcaaatgggagaaactgcgatagaatgctccgtcatccagctgattcctcctacatacgggaatttgagcggttacagtgttaagggccatcgtggatgccccatctttgaagaagacacaagttacatacaactgaaacatggtcttccagcgggttcaacacctaaatgtggtatttggaaagacctaaaagaaggaaaaaaactcatcagtgggctaaacacgcatccaccgctaagcgcgatagaagaatctggaagagcatcaatatcaaggccgcatgctaagcgtgagatcagtgtgctaagcgcagtagttgtcttcagccaggatcaacgcacgactagcgttaaactcaaatccacttacttgcgctaa

SEQ ID NO: 22128 - DNA, 240 bp, Glycine max
  Peptide Sequence Number=SeqID_113813
atgggagatcacttggaagacatgattcgtgaccttggacaagagtcttttcagcaagcacacgcccctgtgtgtgaagcattgcagagtgatttaaagaagcctttgtatatggggtgcaagaattccttaaccctattgtctgtggtgttaagtctggtgaatgtgaaggacaggcatgaattccaagaaatgtccaaatgccctatctgtgggacttcacggtacaaagtgagatga

SEQ ID NO: 22129 - DNA, 495 bp, Glycine max
  Peptide Sequence Number=SeqID_113814
atgcaagagaagactagctccatgaagtgctttaaatgtcttggaagaggacacattacttctcaatgccccaccaagaaaaccatgattatgaggggccaagacatttatagtatccaagatgaggctactacttcacctacctctcgtaaaagtgaagaagcaaaaggggaagaatctagtgaagagatctacctccaagaagaaggacaacttttaatggttaaggaggagtgtaaggaggtaagtgtctcctccaagagattagctaagaaggaaatacattttgaaataaagacaaatattaaagaaatttcccctctattgcaacctacccttttgcgggtgagcgaggcgaggctcacgggtgcgtcttccataggaggaaaatgcgcggagtcgccaccaacgcttattgaaaggaaaacgttagaaaaaccaaaggaaaccggtcatgaagaatattccagattcaggagttatcattacgtttga

SEQ ID NO: 22130 - DNA, 900 bp, Glycine max
  Peptide Sequence Number=SeqID_113815
atgcctaataacccacctaagtttgcacaactatatatttatgatacagacaatgagatcatcaacagactttcgcaaaacccgttagtattcatacttatgtcacacatgatgcatgatatgcttgatgaacagattatcattgcaatcaaagacatgcttgatcatcacaatcactatgctcaaaagtttcgaatggcaagggacaaattgcattctgctgtagttccagacttgaagatgaaactcattagtcaaagacaaacaaacggaaggttgtataacttaccaactaccactgaagttgctgccttgattgttggcgatgaacactcagctgataaaagagatattataatagaaaaacagtccagacttctgaagagaatacatgaacttcatcctgcatatttgcctttgcaatatccacttttatacccaaaaggagaagatggttacagactaaatatacctcacaaagatcatgccaatatacatgctgcaaagaggaaacaagtcacattgcacgaatatttttcttaccgcctacagtcaagaactgatgaagcacagactatacttcattccagaagattatttcagcaatggattgttgatggatattgtatgattgagtctcaaaaactaaactatgtcagccagcatcaacaacaactcagggttgacaaatacatcaatttaattggctctaatgatcatcctcaaacacttggtagggacagaggaaagagaatcatactgccaagtagttttgtcggtggtcaaagatatatagagcaactgtattttgatggtatggcaatttgtggacatcttggatttccagacttattcttaacaatgacatgtaatccaacatggccagaaatacgacgcaag

SEQ ID NO: 22131 - DNA, 495 bp, Glycine max
  Peptide Sequence Number=SeqID_113816
atgcacgtcctcgtctttagagggttcctcgccctcacctttagaggactactcgtcctcccctttagaggactacatatcctcgccttcagagggctacatgcccttaccttcagagggctgcacatcctcacctttagaggactacacgttctcgccttcaaaggactacacgtcctccactttagaggactacacgtcctccccttcagaggactacacatcctcgccatcagagggctacacgtcctcaccttcagaggtctacacgccctcatagggctacacgccctcacattcatagggctacacgtcttcacctttggagggctgcacaccttcgctttcagagggctacacgccctcgccttcaaagggcgacacgtcctcgacttcagagggctgcacgccctcgcctttagagggctacgcctcctgactttcagtgggcttcacatccgcaccttaagagaatttaaggtccttcgcccttaa

SEQ ID NO: 22132 - DNA, 420 bp, Glycine max
  Peptide Sequence Number=SeqID_113817
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcgtgcttttgccgttacgcaccaccccgtcagtagctga

SEQ ID NO: 22133 - DNA, 894 bp, Glycine max
  Peptide Sequence Number=SeqID_113818
atgtggatgggtggggtggacctggcagcgatcgacgcttttctcgcctatcataaccacaaggaaagcccggttgtcgctatgctagccgacctatatgacaccttcgaccgaagatgtgaaaagagcaatacaaggattgtttgttgtactccagctctttatgtatggttagtttcacacctttttcgccaagaggtgaggcatgcttgcctgctagaaagccactgttcatgcacagagaaaggaggggcaaattgggaccaactcttagcaaacaaagaaggagcatctgtcaactggttccctcgatggaaggaaggaagaaccaaagttcttatttcatgcggaggatttccaaatgttcccttgatggggacgaggggttgcatcagctacaatcccgttcttgctataagacaacttggctaccctatgagaggggcgccactagaggatgagctcgcacctgtcatttcacaaggcttcaataagaccaacatggagacacttcagaaggtccgcaaggcatgggaggtgttgcaaaagaaagacaaggaactcaggggcagtaacaatgggcccattggtggctatcgtaagtggttaaaagcccacgtgcaaggtttggattggctcccgagtttgagaaccgctaaaaggaaggaagttgaggcaccggaggaagacgaagaggtgcaggtccttaggacggaactcaagcaagctcaaacagtcaaagaaaggtacaaatcagcagctcttaaaatccggaaggagaatgccgaactgagagatataaatatagctaccaccaaggctttggaacaagagactaagagggctcgtagggaagagcacggccggaacagttccgaggggctctgtgggtag

SEQ ID NO: 22134 - DNA, 852 bp, Glycine max
  Peptide Sequence Number=SeqID_113819
atgcgggccaccggagaaggctccagtgccgccttggagtttgatagtcaccggttccaaagtgccgagcaccaacagtgcttcgaagcaatcaagggatggtcgttccatagggagaggcgtgtccagctcagggaggacgagtaccctgactttcagggtgagatagcttgcgggcattgggcaagactagtgatccctatggctatattcgacccagagatagtcatagaattctatgccaatgcctggcccactgaggagggggttcaggacatgcgctcgtgggtgaggggtcactggatccccttcgatgcagatgcccttagccaattcttgggcaacccactgattttggaggacaaccagcagtgtgaattcagccaaaggaggaaccagacagacagtttcgatgaggaagccatcgcccagctgctatgcatactggggaaggattttgcccggaccgctgcggggaggcgggtgcggatcatgcgcaccagcatgactaccctgacccagatatggatgacactggtactcaacaatgtcttgcctagtgaccacaactctgacctccctctgccaaagtgccagttggtgtatgccatcctgatacggatgagcgttcacgtggcccaagtgattgctgatgccatttatttttttgcaggaatggcgcctactaggcaccctttggacccggagaagtccaacagggccctggggttttcggctttgatcacaggcctctaccagttatacggagtgcatgtcacccttagcaaggtaatccgactgccgatcacccgagccttaatcgagaagtactgcacacctaggcaggcgtag

SEQ ID NO: 22135 - DNA, 201 bp, Glycine max
  Peptide Sequence Number=SeqID_113820
atggctgttagtggtggtggtagtcgtgcttcttcgaacaacacacctaaggtgtggcctatgttattctatgaccaagaagtgaattcaatgtcgataattctcaaagttggtcatgttgttctcaacacggtccatgctgacttagcacaactcatgcttacccctacaatgttgcctaattgtcatcagtataaatag

SEQ ID NO: 22136 - DNA, 601 bp, Glycine max
  Peptide Sequence Number=SeqID_113821
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttaaaacttcagaaagcttttggtacaaagaagaagaagaagttcaaagagattcaaggcttactcttcatgtctggtcaagaagaccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 22137 - DNA, 645 bp, Glycine max
  Peptide Sequence Number=SeqID_113822
atgaagcacttcactgacaccctcatcagtgccaacatagtaagccagtataccactcccgctagcgcccaatacgcaaaccgcctctccccgcgcgttggccgattcattaatgcagctggcacgacaggtttcccgactggaaagcgggcagtgagcgcaacgcaattaatcaagagcggctacgcaagaaaatttataaggctatggcttatgtacatggtcatttcttgcgtagccgctcttgctgctcagaaaatcccaaaaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 22138 - DNA, 1404 bp, Glycine max
  Peptide Sequence Number=SeqID_113823
atggggacaaatcaaaacggaaaaaggttttatcaagtcaaggttaaaggtctagacgtcactagcctcaaggaattgggacgattgatgggacccctccaaaggcaagccttccgcaaagtttatgggaagattctagatttgaccgtagtggaggtatttacggaagctgtcgtatccctcgcccaatactacgaccagccgttgaggtgtttcacgtttggggacttccaaatggtcccaactattgaagagtttgaggaaatattaggatgccctctaggggggaggaaaccgtatctcttctccggttttcttccttccttgagcaagattacggctgtggttggggattcagcaaaggagttggatcgcacgaagcaaactcggaacggcgtagtgggcctgcctcggaaatacttggaaggcaaagcaagggatatggcgagccaagagaagtggggcccgtttgcagatattttagctttgttgatttttggggttgtcctctttccgaacgttgacggcttggtagacttagccgccattgatgctttcctcgcatatcaccatagcaaggaaagtccattggtggctatcttggcagatttgttcgacacctttgaccggaggtgcgagaaaaacagtgcacggattgtttgttgtttacccgctctctgtgtatggttgacttcacacctattccgacaagacacgagacacccgtgtccgcttcaaacctgtcgctcatgcgctgaaaaaggaagagtcgtttgggaccaacatttggctgtgatagggagcagcacgatccattggtttccgcgttggaaggaaggcaaggaaggagttcttttctcgtgtggggactatcctaatgttccactggtagggactaggggttgtattaattataatcccgcactcgccataagacagctaggttatcccatgaggggagcgccaaccgaagaaagtctcacgcctttccttgtgagagatttaggcgcccaaagtctcaaggttatacaaagaatccacaaggcgtggaggagtccgttgaggaaagacaaggagcttagaggcatccgaaacggcgtcatcggaggttatcatggatggctaagaattcacacgcggggcttagattggctctccaaattgaaagttatcaatgaggagaacttcgaagctccggaggaagatgaagaagtccgagctctaaagttggagctagggaaagcgagactcgccaaggaaaaattcaagtcagctgctacacacatccggaaggagtgcaccgagttacaagaggaaacgcggccactgcaaaagcccttgaacaagaaaccaaaagggcctgcaaggaggatatggccggaagaattccgaggagcattgtgg

SEQ ID NO: 22139 - DNA, 390 bp, Glycine max
  Peptide Sequence Number=SeqID_113824
atgaccggccctctcaatgagtcaatctcttgctttctcataagggcggacccttgggtactagtaccctcacctttagaggactgcacatcgtcactttcagaggactatgcgtccttgccttcagaggactacacgtcctccctttcagagagctacacgccctcaccttcaaagggctgcacgccctcgcctttagaggttcctgggccaccccctgatattggagggcaaccaactgtgcaagcacaaccagagagggaggctatcacgcagctactatacataccggggcaagatttcacccgtgccgctgcaaagaagacgagtgtggatcatgcacgccaacttgaccactcttacacagatataaatgacgttgctacttag

SEQ ID NO: 22140 - DNA, 411 bp, Glycine max
  Peptide Sequence Number=SeqID_113825
caagagcctcgcttttgtcgaccacaccgccttttgttgccataactcaagagccggtagcccgcggagacaccttacggttatccgcacccttttgtcatccagaggcggcgggcccgatgacaagcagagaccaagttttggtcattctgcacacatgatacgcggagctaccttacgggttatctgcacccctttgccattcagacacagtcgtgtccaatggcacgcagagaccaaaacgcttgatagcatgcaggggctgacacagtcttctgcaccttttgttcctccgggaacaacaaagtcatttacatgcggaaatttcatggtcgcccgcgactctcgtcaaccgagaggagcgaaattagtgtcatacactgattttcggggacctttgcttgatgacat

SEQ ID NO: 22141 - DNA, 709 bp, Glycine max
  Peptide Sequence Number=SeqID_113826
tgatctccgtcacaggtatttattcggcgcaaagtgcgtcggctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcaagtttatgattggaatcactcagggacagaacaaagtgctaattactgatagaatgtgggctaggcttttatcttcaacaaatctgcccagctttataattgctaagactgtctctaaagaaaaaagggaagaagaagcaaacggtcatgtccctgaggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 22142 - DNA, 360 bp, Glycine max
  Peptide Sequence Number=SeqID_113827
atggcgtacactcacattccggattcaacaagcgattctcctcaaatttcagccagcccgtatcaattaggccttgcaccttacgcttcagagccctacaatgctcaatggaacgccccggggcttctccgtgacaagcacacgttgcgttcgagtcgtattctcggagaaacggaggttgatgaaccttggctagggttatggctactattgaattatcaaacagactttgtggttgatttagggatggcctttgtggataactgggtggtgggtaaggaggaggaatggcagtcacagcatgggtttctccctctttctcaccctctttatttgccccagttttctcagtcgtcctag

SEQ ID NO: 22143 - DNA, 537 bp, Glycine max
  Peptide Sequence Number=SeqID_113828
atgacacgttcgaccggggatgtgaaaagagtggcgcaagaattgtttgttgtgcactggctctctatgtgtggctggtttcacatctttttctccaagaaggtaggcccgtctatccgctacaaggaaggaagaatcaggattctatcttcatgcgaaggatgtccaaatgttcctttaatgggaacaaggggttgtataaattataatcctatcctcaccataagacagcttggctaccccatgagaggagcgccattagacgaaagcatctcgcctttcattacacggggtttcagtgaccccaatgcaaaggacagagagcttaggggaagcagtaatgggatcatcgacggctatcataagtggctgagagtctggacacaaggattggattggctcccaaatctaaagactgtgagagacgatgagattaaagcttcggaagaaagtgatgaggtacaagccctaaaggcagagcttgaaagagcccgggtagtcaaagagaagttcaaatccatagccatcaaagtctga

SEQ ID NO: 22144 - DNA, 387 bp, Glycine max
  Peptide Sequence Number=SeqID_113829
atggcttacactcacatttcggtggaagattcaacaagcgattctcctcaaatttcagccagcccgtatcaattagaccttgcaccttacgcttcagagccctacaatgctcaatggaatgccccggggcttctccgtgacaagcacacgttgcgttcgagtcgtattctcggagaaatggaggttgatgaaccttggctagggttatggataccattgaattatcaagtagatatgggatcaagtttagcatatgacaacggaatttggggtgaaccctacaggctttttgctgcaaaattcctttttgttggtgtttttttgctttgtgctaaaggtggtcttcgtcattggaagtgcggtagacagactttgtggttgatttag

SEQ ID NO: 22145 - DNA, 386 bp, Glycine max
  Peptide Sequence Number=SeqID_113830
gactctgccagtcgttcggcgtccccgtcacacctagcaaggtgattcggccgcccatcacccgagcttttatcgagaagtactgcacgcagagacaggtccagggtgacgcaccacaggccgcggacgcgccgccacctcatcaggatggtccagccggattgttcgacacagagcagtatttgcggcatttgatgagtctcagcctgcagagtcagggctttacttctttcccatgccctactccggaccagttcagggcagaggtcgcgtggcctggggattggcctgaggcccaggcaggagaggcaccagcaggggcaccagcagaggacgaagagatgaccgatttacttgatttcttaggagggagcggagccgcatga

SEQ ID NO: 22146 - DNA, 186 bp, Glycine max
  Peptide Sequence Number=SeqID_113831
gaagagaaaaaaccagaggaaaacaaagtgaaggagaaaaaagcaaatgaagaagaaaagaaagaagaagagaaaaaactagaggaatcaaaagatgacaaggaatccaaggaggaatctgcgctgccagaaatcgtgctaggcacaaccattgcaatgcatggacactttaagcacgatttctga

SEQ ID NO: 22147 - DNA, 288 bp, Glycine max
  Peptide Sequence Number=SeqID_113832
atgccttatgtggaagccgcagaagaatcgttagaaaccgctttccagtcttttgaggtggtcagcatttcctccgtggactccctctttgggcaaccttgtctgtccgatgcagcggtaatgatggcccgagttatgttggggaacggttatgaacccgggatgggtttaggcaaagacaacggcgctgggaaattggcgagtggaggaacgctccggcatttacgcgacgagcataatgtaaacctttacggttttaaaagctctatagttgggcctaggctttag

SEQ ID NO: 22148 - DNA, 315 bp, Glycine max
  Peptide Sequence Number=SeqID_113833
atgagtgaccctgaatcgaaaccagaacttggagggacaagggcggtggttggggcagagggtagggagtgccttccatggtgttcagacttatttgagggaccaacgagggttcagtcaaagaaggccatggtgaatcaagaaggacagggtccaaggagaactcaagtggtgactatgagaccacttgtcattgcagtggtagcacaacccctattcacggcagactgccatctcctccgctgtgagtctcttgacgggaagcttagacgaaggggtagaaaaaggggtcaagggtttaggcaacaagggtga

SEQ ID NO: 22149 - DNA, 337 bp, Glycine max
  Peptide Sequence Number=SeqID_113834
ttggccagggcttcccggtatcaacagggacaccaggatttatttattctgcgaagtgatcttccgtccacagtggcttctgtttctatcagctgtccctcctgttcagctactgacggggtggtgcgtaacggcaaaagcaccgccggacatcagcgctggcaagtgtagcggtcaccctgcgcgtaaccacccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 22150 - DNA, 267 bp, Glycine max
  Peptide Sequence Number=SeqID_113835
atggagattccttctgccaccgaaacccagacgccaaagggatgtatcctatcctctattctaagcgcgatagacgagtacccggaaactctcatcggagaacgagttcccccgcctttcataaatcgatcgctatcagtgaatttgatgtcagagaaaggggtgcgtcctcagccggcgaggaagactaactatctgatctttatttacgtgattgagcggggcacagcacatcagccagcctttcaagcatcctactccttgtaa

SEQ ID NO: 22151 - DNA, 570 bp, Glycine max
  Peptide Sequence Number=SeqID_113836
atgcgtccggtcgcctcgaagtcgaggtcgacgcaggtcaggccgtcgggatcgtccggcacgccgatgaagatcgtcggcgtgcggatcgcgcgggcgatctcggcgcgctcatcgtccggcgccacgtcgagcacgaggatggcgtcgacgagactgctcgcggtcacgcggttcatcccctccgcggtctgctcgtcggggctcggtgagggcgaagatgtgggtgcggcggcccgccagcatccgcgccccggcgtcgggctggtagcccagcgaccgcaccgcctcctcgatgcgtcgacgggtcttctcggagatcgggcgcttgccgctgagcgcgtacgcccccctgctgatcgacacgccggcccccttctgccacctcatggatcgtcgtcatccggactccgttgtcgtagggctcatcatcgaagcgtttcgctcgcctctgcagtgatgatacgcagacgatgctcgggatgcaagcggtttgtggtcagtcacaacatattcgccggatcttcggcggccggggcaggtgtttacggatctgtaccggtacagtag

SEQ ID NO: 22152 - DNA, 306 bp, Glycine max
  Peptide Sequence Number=SeqID_113837
atggttactagatcaatggcatcttcgtcatcatgcgcatcaagtatacaaacgaggtctggtccaattgagggtgacgttttgtggatgcaacccaagcatgtttcagaacatgtttggaatggagaagccgacagaaaactacacatcagacgagcagtgccgacgtatcaaggtgaagaacaaataccagaggaaattattcctctgcttcggcaatgtgggttttattggataattacgatgggatacctaaagataaatgcagccttaattagtgcgttcattgaacgatggaggccctga

SEQ ID NO: 22153 - DNA, 180 bp, Glycine max
  Peptide Sequence Number=SeqID_113838
atgccttcgcctgccacaagtggtatcccacatggcctaaggcgaggcccgtcactaccagataatcaatacggcggatttcgggaatgcgctcgcacagccgctgtactgttgatgtcgaccaaatggggtcgtgaaaagcaggtttccgagaactacggtaataaagaaagccgataa

SEQ ID NO: 22154 - DNA, 228 bp, Glycine max
  Peptide Sequence Number=SeqID_113839
atggggggtgcaaatagcacccaggcccatttgggccctccagaagattcctccagaaggcgaaaatctaagccgagcgctccgaaacgtttccgtaacgtttccgtgaggaatctcgcaaaggtttcaaccgtcttcgacgttcttcattcgttcttcatcgttcttcgatcttcaacgggtaagtacctcgaaccaagcttttcgattcattctatgtacccgtag

SEQ ID NO: 22155 - DNA, 873 bp, Glycine max
  Peptide Sequence Number=SeqID_113840
atggttcatggtccatgtggaattttgaggcctacatcttcatgcatgaaggaaggcaaatgcagtcgattttatccaaaagagtttcagcccacaactcttatagatggagatggttatcctgtgtatcatagaataaacactggtcggacaataaccaagaatgggattataattgataatagatgtattgtaccctacaatccaaaattgctgaaaaaataccaagcacatataaatattgaatggtgtaaccaaagcacttctatcaaatatttattcaaatacatcaataaaggatatgatagagttactgctgtcatggtacatgataacaatggaacagttccccatgcaaacactctgaatgatgaaatcaaggaatatctggattgcagaaaaccttctatagagaggctacatttccaccttctaggacaacatagcgttcactaccaagaccatgatgatattgatgatctcctctctaacccaagcatttctgaatcaaaatttatagcttggatgaatacacaccaagcttttgttgaaggtcaaagcttgacttgttctgaatttgttactaagtttgtgtataaccagaaacaaagatgttggcaacttaggaaaaagggttatgctattggcaggcttcaatgggttcccccaactacaggggaattattttatttgaggatgatgctgaccgtctctagaggaccaatctcatttaaagatatcagaacagttgctagtgttgaatatcctacatatagagaagcatgttttgctatgggttttttttacaggatgatagagaattcattgctgcaatcaaggaagcaaaagactggggctgagcaccttatctaa

SEQ ID NO: 22156 - DNA, 543 bp, Glycine max
  Peptide Sequence Number=SeqID_113841
acggagaccaacatgctagctatcatcgctaagtaccaagaagagttgggtctagccacggcccacgagcatagaatcgcggacgagtatgctcaagtgtacgcggaaaaagaggctagaggaagggtgatcgactctttacaccaagaggcaaccatgtggatggaccggtttgctcttaccttgaacgggagtcaagaacttccccgcttgttagccaaggccaaggcgatggcagacacctactccacccctaagagattcatgggcttctcggctattgaacagatgaaagccgacatgtcggctctgaaaacaaatggcctccatgatggaggccatgttaagtatgaagcagctcatagagaagaacgcggccacgctgccgctgtcagttcggctgctgaagcagacccgactctcttggcaactgcacaccatcctccctcaaacatagtaggatggggaagggacacactggggcacgatggcagccctcacctgggatacaaccgagcggctttcccttatggattgccgcct

SEQ ID NO: 22157 - DNA, 480 bp, Glycine max
  Peptide Sequence Number=SeqID_113842
atggtcacccctggtgttcgagagaaaggagtccattcttccttgtttcccacattgcgacacatgctgaatatgttcccagccgtagtatttatctcaaacaaacatagttcctgtacctcatcggagctgtgtttctttagctgctcaatttcacaggagttgagatgtaacctgctttacactggaatccatgcaaaaccaaagcccaaattcaagagcggagctatatccgaatcaacaactgctctgaatgttgatcagaccaacacctctgtgattagtggtgacatcaaaaccacaccggcgagtgctgcattgccagtgccagtgcttgcaaccaccacaacaagaggaaataatcaggaacaggcagcggctgttaatggttcttctgctgctacagtcatatctgctgcttctgcaccaccaaagaaggaaggtggacagcaaaagctcaggcggacaagaagaagatag

SEQ ID NO: 22158 - DNA, 740 bp, Glycine max
  Peptide Sequence Number=SeqID_113843
atgcctctgtcatggctgaagaacatcaacacaaggttacccttgaatattactccaggagtaccggataatgccatcagacttagcttattttcattttcgttgacaggagaagccaagaggtggcaccattcattcaaaggcaacaatctaaagactgaggcattggagagatttcgtggtttgttacgaaagactcctactcatggattctctaagccaattcagttgaacatgtttatagatgggctgagaccacaaaccaagcagttgttagatgcttcagttgtaccatttgtagtggtgctcattaatcagtccattgcatttccattgaagagcataatcatgaagttaattacatgggaaatcagcagaggcaagggtacaaccaaggaggattctcaggtttccagcaaggtccctacaatcagcaagaggactaccaagctggaggagaccctggctcaattcattcaagtgactatatccaatcataagagcactgagtcagccctgaaaaatcttgagatccaggatgaggatattgttgctttaaaggaacaagttgctttgaaggacactactgataaaaagaatgataaggaagtgccataccctttggtaccttccaagaaagataaggaatgccacttggcgagagtcctagacattttcaggaaactggagataacaatgccctttggagaagctctacaacagatgccactctactccaa

SEQ ID NO: 22159 - DNA, 435 bp, Glycine max
  Peptide Sequence Number=SeqID_113844
atgaaagataagagggatgaggaagaaaaactagaaaaacaaaagaaaaagaatgataataaggccttgtcttcaaaggccaagagggaggaaaaagaggaaaaggattcctccaagaagattgttaagaaggaaaatcattttgcaacaaaaggtgatatcaaaagagcactccttcttaaacaatccttcaaccttcttctatcaagggaaacctcccttagcactgccacaattcctacatttgagaccttagccgcaaaggtccaagaactcttacaggaatttggtgatatatttcccaaagagatacctgtgagtttgtatagtgctgatttttaccctctcgctaagccaacctgtcttcttagcgagtcattcgctgagtgcaacactcctcggttgagcgcaaagaagaatctggaagaaggatga

SEQ ID NO: 22160 - DNA, 144 bp, Glycine max
  Peptide Sequence Number=SeqID_113845
atggaggagatgttcccagaacacaagaagtccaagcttcaacctagaggagacggaccattccaagtgttggagaatatcaacgacaatgcccacaagtttgacttgcctagtgagtataatatggaggggccttggatttga

SEQ ID NO: 22161 - DNA, 132 bp, Glycine max
  Peptide Sequence Number=SeqID_113846
atggcgatcatcttatacaaaacttctaccccaagcacacgcaatggagccgtagacagtcaacatcgttgtggtaaaggccgtaatgccagaggaatcattaccgcagggcatagaggggggaggtcataa

SEQ ID NO: 22162 - DNA, 328 bp, Glycine max
  Peptide Sequence Number=SeqID_113847
atgactagaggaaatccatctgacttacaaccctttgatcctgagatagataggacatttcatagattagttagacatcatttagtaccttttgagcatcctgagcattctgttattggtgattttgagcattatagttcccagcattctgattttgaatattctgagaatatggcacaccctccacctcgtgagaggactctaagggaattggctgcacctgattttacctacgaaagcttgtgcatccaataccctgatgaggatgtcccatatgttcttaaaactggactgatccatttgcttccaaagtttcattgccttgcag

SEQ ID NO: 22163 - DNA, 438 bp, Glycine max
  Peptide Sequence Number=SeqID_113848
gatggtggacttggcgagaggaagatgttaggaatacagatacagatacgggttcggatcgcggatactgtacagtcaacgattgggcttcggaccgggttgaggtcaagtggcgattttgttttgtgcagtacagtacacccacacggcgatctacgggttcttctgattcaggaagggatcggagatggagatcaggcaacgttctactcgatcctgagcggagcggagcggctcggcggtttgattgtgtcagagcgtacttcggcatttacattcaacacaggatggtctgcgtctatcgtcacacctgagaacggacgcggcgaggattcgggggcgccagaaccacgggatagctggcaggtgatggcatcagtctcgccctccgtccgcggtggcacacacgcttcccacgccccggctggcaggcagtga

SEQ ID NO: 22164 - DNA, 407 bp, Glycine max
  Peptide Sequence Number=SeqID_113849
gatacgtagagcaagagcctcgcttttgtcgaccacaccgccttttgttaccatgactcaagagctggtagcctgcggagacaccttacggttatccgcacctcgtcattcagtgatcccaagtgtgattgacaagcagagaccaaagaccaagtttggtcattctgcacccttgtatcatccagaggcggcgggcccgatgatacgcggagataccttacggttattcgcacccttttgtcatccagaggcagcgggcccgatgacaagcagagaccaagtttggtcattctgcacccttgtatcatccagaggcggcgggcccgatgatacgcggagataccttacggttatccgcacccttttgtcatccagaggcggcaggcccgatgacaagcagagaccaa

SEQ ID NO: 22165 - DNA, 417 bp, Glycine max
  Peptide Sequence Number=SeqID_113850
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacgccaatccctgggtgagtttcaccagttttgatttaaacgtgggccaatatgggacacttcttcgccccgttttcaccatgggcaaatattatacgcaaggcgacaaaggtgctgatgcgctggcgattcaggttcatcatgccgtttgtgatggctttccatgtcggcagaatgcttaa

SEQ ID NO: 22166 - DNA, 354 bp, Glycine max
  Peptide Sequence Number=SeqID_113851
atgacttccttgactcacctcgacctctctgatagtggattctatgggaagattcctcctcagattgggaatctctcaaatttggtgtatcttgacctgagagaagttgccaacggaagagtaccctctcagatcgggaatctctctaagcttcgatatcttgacttgagcgacaattatttccttggagaaggtatggcaattccttctttccttgggacaatgagctccttgactcagctcgacctctcttatactggattcatggggaagattccatctcagattgggaatctctccaatttgctctatctcggccctgggagaatgggtatcaagtatgtggaagcttga

SEQ ID NO: 22167 - DNA, 573 bp, Glycine max
  Peptide Sequence Number=SeqID_113852
atgacaaggcaactagttgtgcatgctgaatgtagttgtatgactaggggcaatccatctgacttacaaccctttgatcctgagatagataggacatttcatagattagttagacatcattttataccttttgagcatcctgagcattttgttactggtgagtctgtgcattatgttattggtgattttgaacatcctgattttgagcattataatattgaacattctgattttgaacattctgagaacatggcacaacctctaccccgtgagaggactctaagggaaatggctgcacctgatttcacctacgaaagcttgtgcatccaataccctgatgaagatgtcccatatattcttaaaactggactgatccatttgcttccaaagtttcatggccttgcaggtgaagaccctcataaacatctaaaagaattccatattgtctgctccaccatgaaacctccagatgtccaagaagatcacatctttctgaaggcctttcctcattctttagagggagtggcaaaggactggctatattaccttgctccaaggtccatcacgagctag

SEQ ID NO: 22168 - DNA, 279 bp, Glycine max
  Peptide Sequence Number=SeqID_113853
atgtctgaagaagatgatatggatgatgaaaatgaacaagaatgtggtctgaatgaacaacatattgattgttcagatgcgttcaatacttatcaactttgtgggaaaccagtggttggtgggccaggttggatggtaaagtttatgtgtgggagttataatcatgaattggcgaagtcattagttggacatccatatgttggacaattgactaaggatgaaaagataattattgttgatatgacaaagtcaatggtcaatctaagaacattttgctaa

SEQ ID NO: 22169 - DNA, 418 bp, Glycine max
  Peptide Sequence Number=SeqID_113854
ggaacaaaagctggtaccgggccccccctcgaggtcgacggtatcgataagcttgatccctctgaaggagaggacatatatccctctgaaggcaaggacgtgtagccctctgaaggcaaggacgagtagccctctgaaggcgaggacctgtagccctcaaaaggcgaggacctgtagccctcaaaaggcgaggacgtgcagccctctgaaggcgaggacgtacaaccctctgaaggcaaggacgtacagccctctgaaggtgaggacgtgtagccctctaaaggcgaggacgtgcagccctctgaagattaactgtccttttgaaagaggtgataattcatgcaaccttatcctatcttttgcaaatctctttgggaactcccttagagtgtacattctgtttgatttagtcacttaa

SEQ ID NO: 22170 - DNA, 351 bp, Glycine max
  Peptide Sequence Number=SeqID_113855
atggtcgtcattgtcaatgcggaagcttgtggttacgtgagcatgaactactaccaatatatagatgttgtttatacaaacgagcacatcttaaaagcttactccgcacaatggtggcctcttgcgaatgaagcggctattcctccttctctcgacgacgcatggacacttatccctgacccaactacaattcgtgcaaaaggtcggccaaaatcaacaaggataagaaatgagatggattgggtcgaaccatctgagcaccgaacaaaatgcagtagatgtggagccgaagggcataacaggcgtcgctgtccaatgcaatctgagcgtgggagttgttcaaatccttga

SEQ ID NO: 22171 - DNA, 270 bp, Glycine max
  Peptide Sequence Number=SeqID_113856
atgatcaatcgatgtggctatcgtaataatttggatatcgacaatctaatgaactacccagatgaaaatgaagcatgttcagaggttcagagtttagaagatattgtggatactatcattgagaacaatgcagaggatgacggcgaagatgatacggtgtctttggagcctgttatgcgaaaggaagcacttatggcgtcaaacattcttcacaactttatgatacaatacaaaaatacaacaccggagctattggatgcaataaaaaaa

SEQ ID NO: 22172 - DNA, 279 bp, Glycine max
  Peptide Sequence Number=SeqID_113857
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgtttggccgcgtttgtctcaatccacgcctga

SEQ ID NO: 22173 - DNA, 204 bp, Glycine max
  Peptide Sequence Number=SeqID_113858
atggagacggagaataacattctaatgatcaccggtgcgacgccagacagtggtaaagatgagctcaacaaagtgatccagcattttggcaaaggaggctttgatgtgattactcgcggtcaggtgccacctaacccgtctgaactgctgatgcgcgatcggatgcgtcaattactggaatgggcgaacgaccattacgatctg

SEQ ID NO: 22174 - DNA, 207 bp, Glycine max
  Peptide Sequence Number=SeqID_113859
atgatgataacaaaagatgatgacaaaggtgatgacaaaaagctcaaagatcaatcaaagaacaactcaagtgaatcaagaagaattcaagactcaagaagaaaatctagaatcaagattcaaggttcaagatctcaagaatcaagatcaagattcaagactcaagattcaagaatgaagagaagactcaatcaagataagtattaa

SEQ ID NO: 22175 - DNA, 321 bp, Glycine max
  Peptide Sequence Number=SeqID_113860
atgaccaagagcaggcccgcggccgcccgttgtctcgatgcgcggcccgcgccatttcctggctggttcatctgctatcggcaacaacggcaggtggcaccggctcttcgagcatttatcgaggcggtccgggaaggagcggcaatggggcggacagagttggagatttggacgctgccggctgaacagacaactacacaatcagtgcggttcgagccatctcagatgccaccgaaagcgcccatgaactgcgccgctatccgatcaccaaatgccacgcggaaagccacatcagcgctgaaagctcgaatgaaacaatga

SEQ ID NO: 22176 - DNA, 90 bp, Glycine max
  Peptide Sequence Number=SeqID_113861
atggcttgttcctttttcccagtgtcataccctaatttcgtccggggacctttgctcgatgacgtgcgaccattctttggtcctcgtgag

SEQ ID NO: 22177 - DNA, 491 bp, Glycine max
  Peptide Sequence Number=SeqID_113862
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctttcgctccaagctggactgtatgcacgaaccccccgttcagtccgaccgctgcgccttatccggtaactatcgtcttgagtccaacccggaagacatgcaaaagcaccactggcagcagccactg

SEQ ID NO: 22178 - DNA, 118 bp, Glycine max
  Peptide Sequence Number=SeqID_113863
atgcctacatctccggaaagggcgcagatgaccatattggcctctgctttatcaatcaaactcgaggtgcagataaccataaggggtctcccgcgggctacccagctcttgggtcatg

SEQ ID NO: 22179 - DNA, 660 bp, Glycine max
  Peptide Sequence Number=SeqID_113864
atgagatatcggagttttgatttgcaccagcttttgtttcactttagtaagcatgggaacaaatcaaaccggcaagaggttctaccaagtcaaggtcaaaagcctagataccaccagcatcaaggaattggggcggttgatggaacccctccaaatgcaagccttccgcaagacttacggaaagatcttagagttgaccatagcagaggtgtccatagaagccattgcatcacttacccaatactacgaccagcccttgagatgcttcacattcgggacttccaattagtaccaaccattgaagaatttgaggaaattctaggatgtcctctcgggggaaggaaaccatatctttcctccgggtgtctcccctctttgagcagaattgcaactgtggtcaaggattcagccagaggtttagaccgcataaaacagactcggaacggcatagcgggcctgccacagaagtacctagaagacaaggcgaggggtatggccaatcaaggagactgggtcccgtttatggatatctatttgacacatttgatcgaaggtgcgaaaagagtagcgcacggatcatctgttgcttacccgccctctgtgtttggttggtttcacacttgttccaacaagacacaagacatccatgtctgctcctga

SEQ ID NO: 22180 - DNA, 108 bp, Glycine max
  Peptide Sequence Number=SeqID_113865
atggtgctggaggacaaggagaagactatgttcgtcaccctatggggagcatttttctccaaggtgatgtcctttgggctcaaaaatgctggagcaacctatcaacgg

SEQ ID NO: 22181 - DNA, 237 bp, Glycine max
  Peptide Sequence Number=SeqID_113866
atggctccactgccgtctgtagaagcaaagcttcatggtgaatcaaagaacaattcaagagttcaagataagaatcaagaagaattcaagactcaagaagaaagtttagagtcaagaatcaagattcaaggttcaagatctcaagaatcaagatcaagattcaagactcaagattcaagaatcaagagaaggcttaatcaagataagtatgaaaagtttttctcaaaaattgagtag

SEQ ID NO: 22182 - DNA, 528 bp, Glycine max
  Peptide Sequence Number=SeqID_113867
atgacggcatatttcaggcgcatatgtctgggaagtttgctgggggtgatggctctggcggcaggccaggtgcaggccgccgcgaccattctgttatggcctatcgatccgtggctggcggctgatgccaaagccacggagctgtggatccagaatcaaggaaacagcccaaccaccatgcaggtacgcattgtgcgctggaagcaggagggcgggttcgaacgttacagtgcccagcaggatgtggtggccagcccgccaattgtcaccatcgcagcgggcagcaagcagcttattcgtcttatcaaacaggggacggttccggtgggggtcgagcaggcctaccgcattattgtcgatgaaattcctcagccggacaacaaagccgaaccggctattggtctcaaactgcagatgcgttattccattcccctttttgtctatgggcaggggatcccgacaagcaaagagggggcgcaccatgcgtttgtggatacgcacaacctcagctgggcgggtaaaaaatga

SEQ ID NO: 22183 - DNA, 546 bp, Glycine max
  Peptide Sequence Number=SeqID_113868
atggagaaaaaaatcactggatataccaccgttgatatatcccaatggcatcgtaaagaacattttgaggcatttcagtcagttgctcaatgtacctataaccagaccgttcagctggatattacggcctttttaaagaccgtaaagaaaaataagcacaagttttatccggcctttattcacattcttgcccgcctgatgaatgctcatccggaatttcgtatggcaatgaaagacggtgagctggtgatatgggatagtgttcacccttgttacaccgttttccatgagcaaactgaaacgttttcatcgctctggagtgaataccacgacgattccggcagtttctacacatatattcgcaagatgtggcgtgttacggtgaaaacctggcctatttccctaaagggtgctgatgccgctgcgattcagttcatcatgccgtttgtgatggcttccatgtcgcagatgctaatgaattacaacagtactgcgatgagtggcagggcggggcgtaatttttttaaggcagttattggtgcctag

SEQ ID NO: 22184 - DNA, 297 bp, Glycine max
  Peptide Sequence Number=SeqID_113869
atgcgtcagatttgggatgaagactctcgagatagggcgagctattataggagtataggtccactgaagaacaaaaagaatggacctcaacatcgaggaaaactgtactcgacccctcctaagcaatatggtatccgccccaacaatcagaggactgttgctatggggtttttgggtggtagtggtagcatacccaatacattccccactcagatcacttgttacaaatgtgacaaagggggcatattcaaagagattgtccatatcccaagaaggagtagaatggtgggggcctga

SEQ ID NO: 22185 - DNA, 276 bp, Glycine max
  Peptide Sequence Number=SeqID_113870
cttggagggattgatggggacccggtgttgagaggaatgaggataagggctacgtgggagtacgtgagctcaattgaaggtgggcaactggggatggtggatttatgtgtgatttgtggatgtggagagtcgacttgcaccatcgcccgatcgccacctagtaccacatatgacggtgtacctggagatatgtcgcgggggtcaggagaccttgggacgtcagtgggtgctatgcccaaaaccaagcttgaacaatcccgactcaacccggcatag

SEQ ID NO: 22186 - DNA, 222 bp, Glycine max
  Peptide Sequence Number=SeqID_113871
gtcaataaagcggagatgcttctacttctgcctctgttggcatcatccaaagagaaagactcagtcttagtggttgccaatatagaaggtcatcaccgagatatacccattggcgatagggaagccttcccgcctacttcaacatcaactggtagggctggaaagcgagtaaagagtcaccctttgaattcgcgtaaggaagctattcgtcaccacgattga

SEQ ID NO: 22187 - DNA, 708 bp, Glycine max
  Peptide Sequence Number=SeqID_113872
atgaaacccccagatgtccaagaggatcacatatttctgaaggctttttctcattctttagagggagtggcaaaggactggctgtattaccttgctccaaggtccatcacgagctgggatgaccttaagagagtattcttagaaaacaaattccctgcttccaggaccacaaccatcaggaaggatatctcagtcattagaggagtgaatgaagtagctacgaactcagttgcttcaccgactgaaactaagaagcttgagggtaaactagatgcattggttaacttggtaacccagctggccttgaatcagaaatttgtacccgtcgcaagaatctatggtttacgtgctcctctaccgaccaccatacagacctttgcccttctgtgctgcaatctggagcaattgaatagcctgaagcttatgctgcaaacatctacaatagacctcctcaacctcaacagcaaaatcaaccacaacagaacaattatgacctctccaacaataggtacaatcccgggtggaggaatcatcccaaccttagatggtcaagtccttcacaatagcagtaacaactacaaccttattttcaaaatgctgctggcccaagcagaccataccttcctccaccaatccagcaacaacaacaatagcagcaacaaccctagaaacagcaaacagttgagactcctccgcaaccttccctag

SEQ ID NO: 22188 - DNA, 282 bp, Glycine max
  Peptide Sequence Number=SeqID_113873
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctcccctgttcctgcctttcggtttaccggtgtcattccgcttgttatggccgcggtttgtctcattccacgcctga

SEQ ID NO: 22189 - DNA, 576 bp, Glycine max
  Peptide Sequence Number=SeqID_113874
atgaagcgaccgcccaggatctggcggccaaagtgctcggggaaaaactcgccgcctgcgccaccatcctgccgggagcgacgtcgctctactactgggaaggaaagcttgagcaggatcccatcacccgtatcaaacccccgaactactggtcctgccggttactcacggagacaacgattacctctcatggctcaacgcatcattacgctgatcctgctactgtgcagcgcatccgccagcgccgggttgtttgacgcccccgggcgctcaaacttcgtgcctgccgatcgggctttcgcctttgactttcagcagaatcaacacgacctcaacctgagctggcacatcaaggatggctactacctctaccgtaagcagattacgctgacgacaaaggacgcggcgatcgtcgacccttctctaccgcctggcgaatggcatgaagacgagttttatggcaaaagcgaaatttatcgtcagcgcctgatgttgccgattactctcacgcaagccggcaaagcagccacgctgaccgtcacctatcaggctgtgccgacgcctgggttctgctaa

SEQ ID NO: 22190 - DNA, 183 bp, Glycine max
  Peptide Sequence Number=SeqID_113875
atgcgagtagagtttccacaagcagcagattggttggaccagattcccaagagtaaatggactcaggcctacgatgaaggaaacagtatgaccgcaggacataggaactctgaagacgtatatgtaatgatgcaagaaaatcaacacattgctacctcgcattatgttcgcatgcatgtttaa

SEQ ID NO: 22191 - DNA, 231 bp, Glycine max
  Peptide Sequence Number=SeqID_113876
atgaaagattgcaaaaatacaagtggtgaggatgtttccttcacctctaggatctcacaaccactcacaaacgcatctcaagctctcagaacaacttcctcttcaagctctggtggccttgttcgtgctcgtgcacttagcgcaattctgaaccgcttagcgcacattagtgaatttcggcttagcgtgtgcctttctcgcttagcggatggactgaagcggtgcgcttag

SEQ ID NO: 22192 - DNA, 582 bp, Glycine max
  Peptide Sequence Number=SeqID_113877
atgggtaagggttggggtcctggcactgctggtgcagtgtatactggtagaagctgtcgctcaactgcacctagcccctatgcttggccgcctactgataagccaaatgcagcatgtacgcgcgcatctggagctccatcctctgcatgtgagccgagatggattctagggacgatggatgatgtggaggcagtggtggtgcatctgttgccggctgctgctgctgatgagctttgtgggcgtaaccggtaccccatagaactggcagagacctgtgatcaatgcttgaaatcccagtgccctgttggacttttttgggtccattgggtgtctcggaggtgcgatacctacaaactggtagatggcatccaagataagctatgctacatgaacactgatctgagtcaagatggcatagaccaactggcatttaggcaacgagagattagaattatggtaactaggaaggatgttgctgagcagaagcatccagatctaggtcaaagtggtcatgctagtgtgcatgatccacacccacctccttgtcacgctccgtgcaaaatcctgtcccggggagcatag

SEQ ID NO: 22193 - DNA, 360 bp, Glycine max
  Peptide Sequence Number=SeqID_113878
atggccctctacaggataccgggctgccttgcagcaacattttccgcttgtccagcactgggaagggacgtcgatctgtcggtcgtgaccctatcctctatttgcatccgtccctatgtacctgaaagtaggaaacaacaatgcgtggcaaatcgtgactacgtcgtcgtcttaccttggttgatttctgccgttaactttgtctcgtcttctgaccatggcctaagacgattctgcccttgttattacaaaatatgcatgtgtatgtgcatgcatgaatgttttcaatgcaatgaccttcttagtgaaagcaggttaggttcagttttaattaagcgtttggggcaccccatgaactga

SEQ ID NO: 22194 - DNA, 216 bp, Glycine max
  Peptide Sequence Number=SeqID_113879
atggaccgtgcctgccccggtgagcttccggggcggttcgcaaggcttttccagggaaaaaacatcgatggcccgttcagccctttctcaatgtcattggttcaggccgccatcaaggcggtgcagaacctgcagggtctcgggtcaagggaccgagcgacttcgttttcgcaggcggatttgaaggccgagaagatcggtgcgcgaggagcttga

SEQ ID NO: 22195 - DNA, 126 bp, Glycine max
  Peptide Sequence Number=SeqID_113880
atgccttacaaagaaatggctccgaaaaagctttccgcgaagagatctaggagggacgccgcggctgaagggaccagtgccgcccccgagtttgatagtcaccatttccagagcaccgtgcactag

SEQ ID NO: 22196 - DNA, 408 bp, Glycine max
  Peptide Sequence Number=SeqID_113881
atgccatatgtggaagccgcggaggagtcattagaaatagccttccagtcttttgaggtagtaagcattgcctccgtagattccttctctgggcaaccttgcctgtccgatacggcaataatggtggcccgggtgatgttggggaatggttacaagcccggaatgggtttaggcaagaacaacggacataagaaagaggaaaccgtgggaagtttggggggcccgccctgccccatctgtaggagctttataagcgcgggtctaggacacgaaggccaagccattgcgatatgcgaggataactctccgagtgggttagatttggtacgaccatgccctcctggtttccgactaggaaattggcaagtggaggagcgcccggacatttacgtgacaagcataatgtaa

SEQ ID NO: 22197 - DNA, 225 bp, Glycine max
  Peptide Sequence Number=SeqID_113882
atgggcagttcagatagaatcgaactttcgattgattcgggtacttggaatcctatggatgaagacatggctgttcaaacaggtactggtcaactaaatggtattcctgtagctattggaattatggattttcagtttatggggggcagtatgggatccgcagtaggtgagaaaatcacccgtttggtagaatatgctactaatcaacttttacctcttattctg

SEQ ID NO: 22198 - DNA, 180 bp, Glycine max
  Peptide Sequence Number=SeqID_113883
atggggctaaaggcagaaaccaatcaaggtaaaacggtagcgcggccacggtttgctgcgcaatgtcgtttcctactttcaggtgtctttaaggtaagtatcggatgtctcatctacccttacgggggttcgagtaagcgaacgccgacccgtagagagccatacttatgtcttccctaa

SEQ ID NO: 22199 - DNA, 774 bp, Glycine max
  Peptide Sequence Number=SeqID_113884
atgccctctcagggggagaaaaccgtatcttttctccggctttcttccttccttgagcaaggatgcggctgtgattggagattcagcaaaagagttggatcgcatgaagcaaacccgaaacggcgtagtgggcttgcctcggaaatacttggaagaaaggcaagggatatggcgagccaagagaagtggggcccgtttgtagatattttagccttgctgatttttggggttgtcctcttcccgaacgtcgacggtttggtagacttagctgccattgatgctttcctcgcatatcaccatagcaaggaaagtccagtggtggctatcttggcagatttgtttgacacctttgaccggaggtgtgagaaaaacagcgcgcggattgtctgttgtttacccgctctctgtgtatggttgatttcacacctattccgacaagacacgagacacccgtgtccgcttcaaagctatcgctcatgcgccgaaaaaggaagagtcgattgggaccaacctttggctgggatagggggcagcgcgctcaattggtttcctcgttggaaggaaggcaaggaaggagttcttttctcgtgtggggactaccctaatgttccactgatagggactaggggttctagggtaccccatgaggggagcgccaatcgaagaaagtctctcgccttgccttgtgagggatctaggcgcgcaaggtctcaaggttatacaaagaatccacaaggcgtggaggaatccattgaagaaagacaaggagcttag

SEQ ID NO: 22200 - DNA, 597 bp, Glycine max
  Peptide Sequence Number=SeqID_113885
atgggcaaatatgacagtcaccaaattgcggcatttatgactgcttatggcggcgatggtaaaaataccttcaatatctcaacaatagcatcttttatcaccgctggggctggttaccatgtcgcaaaacacggtaatatcggggtatcttcgagctgtggttcatccaatgtcatggaatatttgggctatcaattcagcaatgacaagtctgaactgcaacgccagcttgatgaagccaatatttgttttctacatgcaccgttatttcatcctgcaatgaaaactgttgccccgatacgtcgcgcactgggtgttaaaaccttctttaacatgctcggaccattgaccaaccccgcgaatcctagatttcagtctgttggtgtattcagtttagaattagcaagactgtatggttatctataccaaaataccaacaaacaatattccattattcatgctttggacggttatgacgagatatccatgaccggcgattttaaggtaatcaacaatcgaggagagaattactacagtatggaggagcttggttttaccccagtctcagcacaggagttgacgggagtgatacaatag

SEQ ID NO: 22201 - DNA, 357 bp, Glycine max
  Peptide Sequence Number=SeqID_113886
atgcccttatcccttcctgtcgaacactcttacaaaagggagagatgcaacttgtttttgcgagtggctttggaagtgggtgggggagaagcggagcgcgggagctataaaaaaaagaagacctcggtggcttggctctggagcctgcctatacaaattgggatcgctggtgcggagctgcgaacggtgaaagcagggctagcaactagtgacagccggtcaaaatggagttcgtgtccccagagtcaacgtgacagaaaggagcgagcgcaacgcaagaaaatcaagggaaaactctgcttctccttccatcggacacagattcgatcaggttacggcatcatgaatcatgaataa

SEQ ID NO: 22202 - DNA, 1093 bp, Glycine max
  Peptide Sequence Number=SeqID_113887
attgctgaaaaccctagccttgcaacaagtcctagggaagtagacacagagatggataagaagatccgcagtattgtgagtaacattttgaaaaatgcttctgttcctgatgctgagaaagatgttccaacatcttccaccccagatgttgctgttcctgatgctgagaaagatgttccgacatcttccaccccaaatactgaagtcctctcttcacccagcaaagaggaatcaacagaggaagaggaagaggatcaagccacaaaggagacccctgcaccaagggcaccagaacctgctccaggtgacctcattgacctggaagaagtagaatctgatgaagaacccattgccaacaagttggcacctggcattgcagaaagactacaaagccgaaagggaaaaacccccattaagaggtctggacgaatcaagactatggcacagaagaagagcactccaatcactcctaccacatccagacggagcaaagttgccattccttccaagaagaggaaagaaatttcctcatctgattctgatgatgatggaaaaaggtgcctgggaaatgtccctgatgcaccattggacaacatctcattccactccattggcaatgctgaaaggtggaaattcgtgtatcaacgaagacttgccttggaaagagaactgggaagagctgccttggattgcaaggagatcatggacctcatcaaggctgctggactgctgaagactgtcaccaagttgggagattgctatgaaagtctagtcagggaattcattgtcaacattccctctgacataacaaacagaaaaagtgatgattatcaaagagtgtttgtcagaggaaagtgtgttagattctcccctgctgtgatcaacaaatacctgggcagaccaacagatggagtgatggatattgctgtctctgagcatcaaactgccaaggaaatcactgccaaacaagtccagcattggccaaagaaagggaagctgtctgcagggaagctgagtgtgaaatatgcaatcctgcacaggattggagctgcaaactgggtacccaccaaccatacttccactgttgccacag

SEQ ID NO: 22203 - DNA, 399 bp, Glycine max
  Peptide Sequence Number=SeqID_113888
acagggctctgccagtcgtttggagtccccgtcgcacctagtaaggtgattcgcccacccatcacccgggcttttattgagaagtattgcacacagagacaggcccagggtgatgcaccacaggccgcaggtgcgccaccaccacctcatcaggctgacccagctgggtcatttgacacagagcggtatttgtggcactcgatgcgccagcacgcggccaaccacaggggactggggcaggtccatgagtgtctctaccatctaagcctcaacatgcagagccaaggcttcgctccttttccgtgccctactccagaccatgcttatgtcgttattgtcgataatgtttatttgaagttccggaaccgtgtagagtttcatttaggaacctcgtcctaa

SEQ ID NO: 22204 - DNA, 366 bp, Glycine max
  Peptide Sequence Number=SeqID_113889
atggcaaatggcatgtggggcaatccaggtgatttacaaccctttgatcctaaaatagatagaacctttcatagattagctaggcatagtgtgcatcctggtcattctgtgcattttgagcatcttgatcattttgagcattttgttgctggtgattctaaatattctgattttgagcattcagctattaattttcatactgagaacatgactcaacctccacctcgtgagaagactcttagggagatggctgcacctgatttcacttatgaaagcttgtgcattcaatatcctgatgagggtgttccatatgtgaagatcctcataagcatgttaaggagttccatattgtttgttccaccatga

SEQ ID NO: 22205 - DNA, 216 bp, Glycine max
  Peptide Sequence Number=SeqID_113890
aagcgggagaagttggatcatctagaggaaaggctcaggaccattgaaggaggtgaagattgtgccttttctaacctagaagagttgttcctagtacccaatatcatcacccgtcccaagttcaaggtgtcggcctttgacaagtacaaggggactacttgcctcaagattattgtcgaaagatggaggcatatgcaaaagatgagaaactactga

SEQ ID NO: 22206 - DNA, 699 bp, Glycine max
  Peptide Sequence Number=SeqID_113891
atgggttggtggacctggaagcgatcgacgtttttctcgcctatcataaccacaaggaaagtccggttgtcgctatgctggccgacctatatgacaccttcgaccgaagatgtgaagaaagcaatgcaaggattgtttgctgtactccagctctctatgtggggctggtttcacacctttttctccgagaaggtaggcccgtctatccgctacaaggaaggaagaatcaagattctatcttcatgcgaaggatgtccaaatgttcccttgatgggaacaaggggttgtattaattataatcccatcctcgccataagacagcttggctaccccatgagaggagtgccatcagacgaaagcatcacgcctttcatcgcacggggtttcagtgaccccaatgcgagggacagagagcttaggggaagcagtaatgggatcattggcggctatcataagtggctgagagtccgaacacaaggattggattggctcccaaatctaaagactgtgagagacgatgaggttaaagcttcggaagaaagtgatgaggtacaagccctaaaggcagagcttgaaagagcccgggtagtcgaagagaagttcaaggcagcaatagtgagctcaagctccgaaggggtgaaaggaatcatcacgggtcaaaggcatgatcttgaaggacgagctaaaggcttgccttag

SEQ ID NO: 22207 - DNA, 186 bp, Glycine max
  Peptide Sequence Number=SeqID_113892
atgacgacgatgatgcaggtgatggtaggtgatgaaatggtggtgacgatgaaggtggatggtcttggatatgtcactggcagaggtggtggtggtcgattgatggtcatggtggtggtggaggtagacatggtggaggaaaatggtggttgtaacattccggacgttgatgagcttggagagtga

SEQ ID NO: 22208 - DNA, 103 bp, Glycine max
  Peptide Sequence Number=SeqID_113893
atgtgggatggacataggcttaaaggagcactcaaactgggtgtatttacccccaaggcctacactccgaagagtccatcagggtctctccctcctgattcag

SEQ ID NO: 22209 - DNA, 366 bp, Glycine max
  Peptide Sequence Number=SeqID_113894
atgaatcagaaatctacacctgttgcaagagtctgtggtctatgctcctctgttgaccaccacacagacctttgcccttttgtgctacaatctgaagcaattgaacaaccagaagcttatgctgcaaacatctacaatagatctcctcaacctcaacagcaaaatcagccacaacagaacaattatgacctctccagcagcaggtacaatcccgggtggaggaatcatcccaaccttagatggtcgagtccttcacaacaacagcaacaacaacagccttattttcagaatgttgttggcccaagcagaccatacgttcctccaccaatccagcagcaacaacaacaacaacaacaacaacaatag

SEQ ID NO: 22210 - DNA, 672 bp, Glycine max
  Peptide Sequence Number=SeqID_113895
atggtagaagtctccacagagaccattgcctccctcgcccagtattatgatcagccgttgaggtgcttcatctttggggacttccagctatcaccaatggtggaagaatttgaagagatcctaggatgtcctctagggggaaggaaaccatacctcttctcagggttctacccctcattggccagaatttctaaaaaagtccaaatctcggcgcaggaattagaccgccaaaggcaagtcgaaaatggggtggtcggaataccgagaaaatatttggaggtaaaagcaagaatcttggcagataaaggcgagtggatcccattcatagatattctcacactgttgatcttcgggggggggggggtcctctttccaaatgtggatgggttggtggacctggtagcgatcgacatttttctcgcctatcataaccacaaggaaagtccggttgtcgctatgctagccgacctatatgacaccttcgaccgaagatgtgaaaaagcaatgcaaggattgtttgctgtactccagctctctatgtggggctggtttcacacctttttctccaagaaggtaggcccgtctatccgctacaaggttaccgctcgtgcgtcgaaaaaggaaaggcgaattgggaccaactcttggctagcatgggggggcgtctgttaa

SEQ ID NO: 22211 - DNA, 642 bp, Glycine max
  Peptide Sequence Number=SeqID_113896
atgggtgaagtagaggagatacaagagaagatgaaggccgacatgaaggccatgatgagcatgaagaagataatggaagccaatgtggttatagttgccgctactagcgctgtcgctaaggtgaacccgatgctcccatctggcctcaagcaaatgaatcatccaacctctaatatggtaggcaaagatttgggaagtacggatgaccccgtgatgtgcaaattcaaaacaagcacgccttctcgccatatggcttgcctcccaaactatacaccacccaatgtggcgtacattcccaatgaggatgtcaataactccactcccatactcattaagagccaacaacctcaatctgatcatgcacatgtctctcgacccatggaggagacacatgaaattccccaccacaatctagctgacttcgagccttggctcagatatgccaccgaagggcaagcagttggtgaaatgggaaagttggatcatctagaggaaaggctcagggccattgaaggaggtgaagattatgccttggctaacctagaagagttgttcctagtacccaatatcatcacccctcctaagttcaaggtgctggactttgacaagtacaagggactacttgtcccaagaaccatctaa

SEQ ID NO: 22212 - DNA, 363 bp, Glycine max
  Peptide Sequence Number=SeqID_113897
cctaatctacttggagtcttctatccaatgcccttgcggggtaggattgcatcatttggtcaagtctttatcacagtagttgtgtctccagcaaaaccacctccaaagtctgatacagaggtcattgatccgctttatctgatgacattgaccatcccaaagcttttcttgaggccttatcagtttgagtctgaaagttacataaagacatggatgcagagttcaaaacgcgatgtctatcttggagcctacctaaatgggccatacaactaccttaaggggattattaatagtgctttaaaaggtcttgatgatgctccacagcctaaatcaaaggctcctgctaggtggattgtcgtcaag

SEQ ID NO: 22213 - DNA, 241 bp, Glycine max
  Peptide Sequence Number=SeqID_113898
gacagaaatctcatcttctactccaaaatgctttgaatgcaatcaacctagacatctgaggcttgattgtcctatcttcaagaaaaagatggagaaatctgaaaagaaaaattttagtgaaaagaaaattaaaaaagcgtacatcacatgggatgacaatgatatggaatcttctgaagattcaggaaatgaagaaataaacctctgtctaatggctaaaagttatgaaagcgatgaagag

SEQ ID NO: 22214 - DNA, 641 bp, Glycine max
  Peptide Sequence Number=SeqID_113899
ctacaatcccgttcttgctataagacaaattggctaccctatgagaggggcgccactagacgatgagctcgcacctgtaatttcacgaggcttcaataagaccaacatggagacacttcagaaggtccgcaaggcatgggaggtgttgcaaaagaaggacaaggaactcaggggcagtaacaatgggcccatcggtggctaccgtaagtggttgaaagcccacgtgcaaggtttggattggctcccgagtttgagaaccgctaaaagggaggaagttgaggcaccggaggaagatgaagaggtgcaggcccttaggacagaactcaagcaagctcaaacagtcaaagaaagggctcgtagggaagagcatggccggaacaagttccgaggggctctgtggggcagcaacagcgagcttaagctccgaagagaggaaagggaccaatcacgagtagacagtttgatcttgaaagatgagttgaagggtgatcgacttgctacatcagaggcaacgatgtggatggaccgatttgcccttaccttgaacgggagtcaagagcttccccgactactagccaaggccaaggcaatggcggacacctactccgccccggaggagatccatggacttctcagctatt

SEQ ID NO: 22215 - DNA, 306 bp, Glycine max
  Peptide Sequence Number=SeqID_113900
atgagtagttcggtccaggactccaccccctcgagagcaggatgccggccgagatggagctgggagccaacctatactttcctggggcttgccttgccccaacatctaaatcaaatgcgggcgccgaaaaggaaccagcccagcctcttccagaaagctttgcttggtaggcgctgcctattcacttcactcggacaatgctctaaacacgaaagtgtgacgcccccttctcccatgctgagtcacaggcagcgcctcggaaagcgcggacgagccacatgcagggaaacttgcacgtccccgtaa

SEQ ID NO: 22216 - DNA, 449 bp, Glycine max
  Peptide Sequence Number=SeqID_113901
atgaccacattggcctctgcttgtcaatcgaacttgggatcttcgaatgacaaggtgcggataaccggaaggtgtttccgcatgctaccaaactcttgggtcatgatagcaaaaggtgcggataaccgtaaggtgtcttcgcatgctactggactctcaggtcgctggatagcaaagggtgtttacggcttaccgtcgggtgtctccgcatgccaccggactcttggtcactaccagaagatgctgacatcttcggaaagggtgcagatgaacacattggtctctgcttgtcaatcatacttggggtctccaaatgacgaggtgcagataaccataaggtgtcttcgcatgctaccggactctcgggtcactagattgcaaagggtgtttgcggcttaccgtcgagtgtcttcgcatgccactggactcttgggtcacggtaacaaaag

SEQ ID NO: 22217 - DNA, 558 bp, Glycine max
  Peptide Sequence Number=SeqID_113902
atgcaagagaagactagctccacgaagtgctttaaatgtcttggaagaggacacattacttctcaatgctccaccaagaaaaccatgattatgaggggccaagaaatttatagtagccaagatgaggctactacttcaccttcctctagtaaaagtgaagaagcaaaaggggaagaatctagtgaagagatctacccccaagaagaaggacaacctttaatggttaaggaggagtgtaaggagacacttgttagcattgccacatctcttaggcttgagtttaatcctcaagtaaaggagttgttggatgagggtttggttcgcaagagattaaatccttgtgctttgttggtgcccaaaataggggttcccatgaaccctaagagaataaaggtcattcctgagtggccggctccaccaagtgtaagaaaaatttggggcttccaagacttaacaaacttttacaaaaggtttgccccatatttttctatacttgtagcaccactcattgagttggtgaggaaccatgtccttcatgggaagatgcccaggaaatga

SEQ ID NO: 22218 - DNA, 600 bp, Glycine max
  Peptide Sequence Number=SeqID_113903
atggtgttggcagagggtgagacattgcccatatactccaaatactgcaggctgcctttagatcttagggagattgaggctgccctatgcataccaggccgagggttcatcttgaatgctgagggccatcctgggaggatcctgaggaaggacttgacaactttagcccaagtgtggagtgttctctcatactccaaactggcccccacatctcacacatctgacctgacagtggacagagctaggctgatctttggcttagtctctcgcatggacatgaacgtaggagcgctcatttctggccagatgacttctatagcccattctaactcttctagacttgggtttcctactttgatcaccaccctatgtcgagccagaggggttgtctctgacagcctcacttttgagtgcctgagcccgctcctactccagtatccatatcagcagctccttcagtcccagctcagattgattctcagcattttgaagccatgcttcagagcattcatcagggacagatcattttactttagagtttacaagtggtggcacctccaggatccattccttccgttcaacagtttctggaaagggtag

SEQ ID NO: 22219 - DNA, 430 bp, Glycine max
  Peptide Sequence Number=SeqID_113904
atgccaatctccccttgcaaaagtatcagttggtctgtgtcgtcccgacatggggatcgcacccacaagacacccagtggacccggaaaagtccaacagggccctggggttttcagctctggttacgggcctctatcagtcctacagggtgcccgtacccccccggcaagacacccagtggacccgaagaagtccacagggtcttggagttgtcaagctctaaatacgggtctctatcagttcaaagggagtgcctgttgcccccagcagggcgcagggcgaaacaccacagcagcattgggatggccggtagcgggcaatagacacaccgccaccacctctagagttcacctcagctcatccgcaaaaaggttagagcgttgcctacgacacatggccgaccagcaggctaccaagtccaaagccaaag

SEQ ID NO: 22220 - DNA, 507 bp, Glycine max
  Peptide Sequence Number=SeqID_113905
gaagctaagggagcctctggtaatcgattaccagcctgtgtaatcgattacacagagggatgggtcactggtaatcgattaccaggctgtgtaatcgattaccagagatggaaagccttaaaatacccattttacttgcatgtagtgatcgtgatggcggcgcagctaatccgtgatcgagtagagatggagtgcctagagggagcttgggagaccctcgaaggcaacacgagcgcactgtggagtgatactacccacgcctacaccatatcgtctagtgagcccgtccaagtgatcgaggtaacgtcatccgaggaagaccctgaggaggatctggaggagctacctcctgagcctgctgtggatgcccttgactttctagagggtgatgaggatccacttcttgaggtggattctcccgaggaagtcatgtcggcatctgaggcagactctacggaggatagtggcccaggggagatggcgatcagcggaggctcttcatcatag

SEQ ID NO: 22221 - DNA, 210 bp, Glycine max
  Peptide Sequence Number=SeqID_113906
actcagagtctggtagcatgcagaaactaacatcgtcatctgcaccctttgtcaacctggggcaagcgagcttgttaacacgcagagacaaacgtagtcttctgcaccattgtcatccagggacgaagtcaggaagcaggcgaagatacccaagtggttatccgtacaaaatggtttctgttaatcctgacccgagaagtcaggtggcag

SEQ ID NO: 22222 - DNA, 456 bp, Glycine max
  Peptide Sequence Number=SeqID_113907
atgacccaagagctggtagcccgcggagacaccttacggttatccgcacctcgtcattcagtgaccccaagtgtgattgatgagcaaaggccagtgtggtcatttgcaccctttccggggatgtcaacatcttccggtggagactttttcaagtctcacaagttatccagaactacacacagccgtgtccgatggcgcgcagagacaaaattggtcattctgcaccctttgtcatccagaggcggcgacgggcccgatgacatgcggagacaaaatttggtcattccgcacccctttgccattcagacacagtcgtgtctgatggcagtgcagagacaaaatttggtcattttgcaccctttgtcatccagaggcggcggacccgatgacatgcggagatttacatcatcttccgcacttacaagatctgtcatactgacttttgagtcatgctga

SEQ ID NO: 22223 - DNA, 660 bp, Glycine max
  Peptide Sequence Number=SeqID_113908
atggtagatacagaattcaaaacaaaagtgcgcgaagcgatgctaaaagatcgtgagaattacggcgggtctgatacagcttatgcgtccacgcttagcatcaacaaaaccagctttaacaaaatcaaaaacggccagaccgaaaaagtaatttccgattcgtcatggcttcacattgcgcgactgctccacgtttcccgtgacgagaaggcttggaaggttgcaaggacatcggtctacattgagatggaagatcaattcaacttttgccagaccaattccaaaggcatgatgctggttgacgacacagggatcggtaagacagtctgcggttcccacatcgtacaattcatgaaaaacgctttctacgttgattgttcgcaagcgactacaaagtttaaattgattcgttcgctggcccgaaccatcggagctgacgtgaccggaaagatggatgcggttttacagggtgtgaaggacatgttgaattttatggaacaaccgttcatggttctcgatgaattcggtgacctggactacaatgctcttttgctcatcaaggagctgcaaaacgcgaccgtcggccgctgcggatggtttgctatgggcgcggaaggtctacgcaaaaaaatggagcgcgaatggcttcgcagaaaatag

SEQ ID NO: 22224 - DNA, 159 bp, Glycine max
  Peptide Sequence Number=SeqID_113909
atgcaagattccaactcagaaaaatggattgaagcaatgaatgaggagtataagctcatgcaagacaacaaggtttgggaacttgtcccattaccagaaggtaatgtggagaggtataaggctcgtcttgtggcgaaggactatacccaaaatgaatga

SEQ ID NO: 22225 - DNA, 387 bp, Glycine max
  Peptide Sequence Number=SeqID_113910
atgatggaagcaatgatgaacatgaggaagatgatggaagcaatgacaactgctacagttgttgctacgaatattgctactgagatggacccaattcacccggccggttcaatcaacaagcattccttcccaccatatgggttgcctcctaattacacactacccactgttgtatacgcttctggatataccactgaacgacatgcatttgctagcatccctatgctgaatgctctcgattatctcaatgttgccctacttgagaaggaaaggattgagcatatggaggagaggctacacgccattgaaggaggaggaacttacgtcttggctaatatgacagagttgtgctttgtacctgaagtggttattcctccaaagttcaag

SEQ ID NO: 22226 - DNA, 352 bp, Glycine max
  Peptide Sequence Number=SeqID_113911
ggccttcttcagcagctctaacccaatcctcttagagcctcttgctcatggctcaagtgactggtcccttcctagggaggattgcatcaccaaatgtcacgtgaaggagagcttaaacaagaagcttgaatctgaagagttgttcaacaatcttcatgctcatcttgaacctcaagtcaatgctattgaacctccactgattgaagttacttcccaacctccacaaattgttgaaaatgccttagcaactatcatcactttcactactcctcatgagataactcttttgaccacctttgctctaactggtgtgtctgaagagagcattcaagatctattgtgccttcaatag

SEQ ID NO: 22227 - DNA, 300 bp, Glycine max
  Peptide Sequence Number=SeqID_113912
atggcctcatcaaacttcctatttcccgaaggaaactccattaatagaccttctatattaaatggtatgggttatcattactggaaaacccgcatgcaaatcttcatagaggctatagatttaaacatctgggaagccattgaaatcggtccttacatccctacaatggtagtaggaaatgcaactatagaaaaacctagggaacaatgggatgaagaggaaagaagaaaggattggatgaatactttagagtctcaaattgtaagaatacaaaagaaatgtgagatacattgcaagtaa

SEQ ID NO: 22228 - DNA, 345 bp, Glycine max
  Peptide Sequence Number=SeqID_113913
atgggcataagaaccgacttaaaatccaaattttctagtagtgtggacaaccggaatggtgatacagtttttgggctttggctgacaagtatagcaggttattcacaaattcttgtaatccgaatgccctggtggctgaaatgggatattaggtaccctcccaaaaaaacaatgttatttttagaggggccaatgggaattgggaagctgtgttgtgtggccgcatgggatctggcaaaacatagagcttgggcatggattaatgcgaaagggaaaggaagaaaattctcttattgtgaatgggagatgaatcccagggcttgtttgaattgtttaacgttatga

SEQ ID NO: 22229 - DNA, 323 bp, Glycine max
  Peptide Sequence Number=SeqID_113914
gtgggtgtggaggaggttaaagatccagatgttcccgttcctgtacccactgatgaggtttccttagtggggcaggcaattcacaccttccttgcttggccgacacatctggaaactgtgtatccggcaaaaccacctcaaaatccggatccagaggtcgatgattcgctttatctgatgacattgaccatcccagagcttttcttgaggccttaccagtccattcagaggtctgggcaatcgcagtttgagactaaaagttacataaagagttggatgcagagttcaaaacgtgatgtctaccctagagcctacctaaatgg

SEQ ID NO: 22230 - DNA, 207 bp, Glycine max
  Peptide Sequence Number=SeqID_113915
atggaggctcgaaacccacatgtttcacctgagatgcggagaggctaccattactctccaagatgtgtcagttttattagggcaacacgtatgcgtggggacctgccatgcttgcgtatttatatagagagatgtgcagcgccaccgattacaaagttaaaccaatcgaaggtggctgcgacgtggaaatcagcatattggcaatga

SEQ ID NO: 22231 - DNA, 384 bp, Glycine max
  Peptide Sequence Number=SeqID_113916
atgtttggcagtggaggaccttttgcaaaggatgatagatcaaggtcgactggaagtcgacaccacgcagtcccatggaggtacacacctccgaacaaaaaggaagaagaagccaccgacatcagttcgttgttggccaaggtaaccaatatcacggggctgagcggtgtgacccgcagcggtcgcgtgtttgtgccccccgacctaccaattcaacccgtgaacgttaaggggaaggcaaaggtagtggaagaaaaagatgataaaatgcccctcactcctaatgaggatattccagtgaagggtcttccggagaaaagggatggttatggcaagaaggaggtgtcgctagaggaagccagcgagtttctccgcataatttaa

SEQ ID NO: 22232 - DNA, 252 bp, Glycine max
  Peptide Sequence Number=SeqID_113917
atggtgggttacacaccttctagctttgcggatatggtcttcgccggcaaaaggatcgaagtgggcatgaaaagaggaaaatttggtcatcctgctttgataaaagctggggcaaatgaagaggatgagaatgagggagaaactcatgctgtggctaccattcatatatggccaagtttcccaccaacccaacaatgtcattactcaaccaataacaacccatctccttacccaccacccagttatccataa

SEQ ID NO: 22233 - DNA, 596 bp, Glycine max
  Peptide Sequence Number=SeqID_113918
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgcctctcctgttccctgcctttcggtttaccgggtgtcattccgctgttatggcccgcgtttgtctcatttccaccgccttgacacttcagttcccgggtaaggcagtttcgcttccaagctggactgtatgcacgaacccccccgtttcagtccgaccgctgcgcccttatccggaactatcgtcttgggtccaaccccggaaagacatgcaaaagcaccactggcagcagccactg

SEQ ID NO: 22234 - DNA, 501 bp, Glycine max
  Peptide Sequence Number=SeqID_113919
atggaagggttagtggacctagcagcgattgacgctttcctcgcctttcatcatggcaaggaaagcccggtcgtcgccattttggccatgtatgacacgttcgaccgaggatgtgaaaagagcagcgcaagaattgtttgttgtgcactggctctctatgtgtggctggaaggaagaatcaggattctatcctcatgcgaaggatgtccaaatgttcccttgatgggaacaaggggttgtattaattataatcccgtcctcgccataagaccgcttggctaccccatgagaggagtgccatcaggcgaaagcatcacgcctttcatcgcacggggtttcagtgaccacaacgcgagggacagagagcttaggggaagcagtaatgggatcatcggcggctatcataagtggctaagagtccggacacaaggattggattggctcccaaatctaaagactgtgagagacaatgaggttaaagcttcggaagaaagtgatgag

SEQ ID NO: 22235 - DNA, 485 bp, Glycine max
  Peptide Sequence Number=SeqID_113920
atgttggataaacaggtagctatgtctccagcaaaacctacagatgggccagatcctcagctttttttgaagtcgttgcaagttatgtgggatgctatcgtgttcgtggtgtttaagcaagacttccccttgtacataaagcacgaagatctgtctgaaataccagacagtggtcaatgtctcagcatctctgttatacagttgtggattctgcatccgactaagacaagtatgcgagcaggaaattctgatgtatatggattcctcgagccacagtccattcatagatctgggcaatcacaatttgaatcagaaagttacatgaagagttggatgcagaattcaaaatgtgatgtctaccttcgagcctacctgaatggcgatcactggcaaatggtcatcattttgcctaaggaaaatcttgttgtctggttttgttccttgcataacaggccatacaactaccttaaaagaataattaacag

SEQ ID NO: 22236 - DNA, 1023 bp, Glycine max
  Peptide Sequence Number=SeqID_113921
atggggacaaatcaaaatggaaaaaggttttatcaagtcaaggttaagggtctagatgtcaccagcctcaaggaattgggacgattgatgggacctctccaaaggcaagccttccgcaaagtgtacgaaaagattctagatttaaccacagcggaggtatttacggaagctgtcgtatccctcgcccaatactatgatcagccgttgaggtgcttcacgtttagggatttcctaatggtaccaactgttgaagagtttgaggaaatattaggatgccctctcgggggaagaaaaccgtatcttttctccgggtttcttccttccttgagtaagattgcagctgtggtcggagattcgtcaaaagagttggaccgcatgaagcaaactcgaaacggcgtagtgggcctgccgcgaaaatacttggaaggcaaggcaagggatatggcgagccaagagaagtggggcccgtttacggatatactagctctgttgatctttggggttgtcctctttccaaatgtggacggtttggtggacttggccgcaattgatgctttccttgcatatcaccatagcaaggagagtttagtggtggctatcttggcggacttatttgatacctttgaccaaaggtgcgagaaaaacagtgcgcggattgtatgttgcttacccgctctctgtgtgtggttggtttcgcacctattccaaccagacataagacatccgtgtctgctccaaagttatcgctcgtgtgtcgaaaaaagaatagtcgattgggaccgacacttggctgggatagggggcagcgcaatcaattggttttctcgatggaaggaaggcaaggagggagttcttttctcgtgtggggactaccctaatgttccgttgataaggacgaggggttgtattaactataatcccgcacttgccataagacagctagggtaccccatgaggggagcgccaacagaagaaagtcgctcgcctttccttctgagggatctaggcgcgcaaagtctcaag

SEQ ID NO: 22237 - DNA, 362 bp, Glycine max
  Peptide Sequence Number=SeqID_113922
atgacgggtgaaacctcggacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgggcaatgtggttaaaaagggggtgaaaacccctgagtatcttctgggattcacgatgaacgcgctaagcatgcctgctacgcttagccg

SEQ ID NO: 22238 - DNA, 378 bp, Glycine max
  Peptide Sequence Number=SeqID_113923
atgaagcacttcactgacacccctcatcagtgccaacatagtaagccagtatacactccgctagcgcccaatacgcaaaccgcctctccccgcgcgttggccgattcattaatgcagctggcacgacaggaaacagctatgaccatgattacgccaagctcgaaattaaccctcactaaagggaacaaaagctggtaccgggccccccctcgagggcaaggattgacattctcaccctcggtcaaggtttatgataagttcggcctttggctcaaggcttgtagaacagctggtcatgatatatgtcagggtttggctagcggttcggggataaaggggatgtcccacattatttccatgatacacatgcaacaatga

SEQ ID NO: 22239 - DNA, 297 bp, Glycine max
  Peptide Sequence Number=SeqID_113924
gggacacatgtcccagacattgtctcgacatcagggaaagctgctgcttcaggtgctgtgtccaaggatgatttgattgctgaactcaaggacacatgcaaggtgctggaggcaaccatcaaagccaacacagagaagaaaatggagctggaacgcctgatcaaaagactctcagacaatggcgttgatgatggagaagcagctgaggaagaagaagatgcagcagaggatacagaatcagatgatgatgattctgatgccacccccatgactagctattggggcatgtccctttga

SEQ ID NO: 22240 - DNA, 216 bp, Glycine max
  Peptide Sequence Number=SeqID_113925
atggagaattcgtccctaacagtcaaccacttaatccaaccctatttcaatttactaagcgaaaatcaacttaggggagaactgccaggaaaccacattacaagcgaaacctcaaagagagttgggcttcgtcctcaaaaggaaacaacaccagaaaatctagccttccatggattcaaacagaaaacgcaattgaaacatgaagcagaaacgtaa

SEQ ID NO: 22241 - DNA, 558 bp, Glycine max
  Peptide Sequence Number=SeqID_113926
atgtcttgcctagcgatcataactctgatctccctctaccgaagtgtcagttggtgtatgccacccaccaggcaccctctagactcagataagtctaacagggccttggggtttctagcattaatcacgggcctctgccagccatttggggttcccgtcacccctagtaaggtgatccgaccgccgatcactcgggccttcatcgagaagtattgcatgcctaggcaggcgcaaggtgatgcacctcaggccgcagacgcaccgccaccacctcatcagggcgatcccgctggatcactaggcatggagctttatcgacaacacttgatacatgagtgtctctaccagttcaacctcagtcagcaggggcagggtttcactccttttgcatgccctactccagagcagtttggggctgaggtcgcatggcctggagactggcccgaggcccaggcaggggaggcgcctgcaggatcccccggcgatgtagaggaggctcgtatggatgaggagatgacggatttgctcggtttcttgggaggaagcggagccacgtga

SEQ ID NO: 22242 - DNA, 246 bp, Glycine max
  Peptide Sequence Number=SeqID_113927
atggtgaatcaaaggtgttttgatgataacaatgatgatgacaaaggtgatgacaaaaagctcaaagatcaatcaaagaacaactcaaagttcaagataagaatcaagaacaattcaagactcaagaagaaagtttcgagtcaagaatcaagattcaaggttcaagatctcaagaatcaagattcaagaatcaagagaaggctcaatcaagaggagtataaaaagtttttctcaagaagtgaatag

SEQ ID NO: 22243 - DNA, 294 bp, Glycine max
  Peptide Sequence Number=SeqID_113928
atgacaccggacattatcctgcagcgtaccgggatcgatgtgagagctgtcgaacagggggaagatgcgtggcacaaattacggcatcaagcttatcgataccgtcgacctcgagggggggcccggatatattccgcttcctcgctcactgactcgctacgctcggtcgttcgactgcggcgagcggaaatggcttacgaacggggcggagatttcctggaagatgccaggaagatacttaacagggaagtgagaggccgcgcaaagccgtttttcataggctccgccccctga

SEQ ID NO: 22244 - DNA, 183 bp, Glycine max
  Peptide Sequence Number=SeqID_113929
atgacttgggctaagtgcgcatctatcgctaagcgcagcttcagcgcaacagaagaatatggcagagcatcaatattaaggttgtgtgctaagggcgagattagtgcgctaagcgcagcggttgtcttcagccaggctcaacgcacgactggcgctaagctcacatccacttattcgcgctaa

SEQ ID NO: 22245 - DNA, 1950 bp, Glycine max
  Peptide Sequence Number=SeqID_113930
atgtctcatgagataagatctccactgtctggagttgtcagcatggctgagattctttccaccacgaaactcgatcgggagcaaaggcagctcttgaatgtcatgatatcttctggagatttggttcttcaacttataaatgacattcttgatctttccaaggttgagtcaggtgctgatcatttaaatttcttcccaccccacaaaacccccttgttctctataggagttatgaaattggaagctaccaaattccggccaagagaggtagtaaagcatgtactccagacagctgcagcatcattgcagaaaatattaaccttagaaggaaatgtggcagatgatatacctgttgaggtcattggagatgttttaaggattcggcagattctcacaaatttagtcagcaatgcagtaaagtttacacatgaaggcaaagttggcataaacctgtacgttgttacagaaccaccttttgccaaagcagaaggccatcaaaagatgatcacagaacagtctacaaattcagcaaatggggtgaaggaagagaaacgtgcatcaacgccgcgaagcaacgatgatcaaaattgtcttgatggtcagaaaaacaatgaccatcctagccaaaatcatgcagtcaatgatgaatgcagatcttcagttaaaagtgaatgctcaataaatggagatactgaggagcaaacgcattcaactgaaactgtgtggatacgttgtgatgtatatgacacaggaattggaataccagaaaaggctatacctactttatttagaaggtacatgcaagtaagtgctgatcatgctcgaaagtatggtggcacagggctgggactagcaatatgcaaacagctggttgagttaatggggggtcgtttaacagtgactagcaaagaacattgtggttctaccttcacattcatacttccatacaaggtttcaacagtttgtgatgattctgatgacccagatgagctctcagatgtggatgataatgatgacgatacaacagaaggcttcttccaattccaacctcgcactttgggctctctcttctcttctaatggacctaccaggccacaaaatgtactaccgggattcagaagctcacacaacttcaatggtttttcagagaattctttctcattcctcactaccaacataatatcaaaagggactaattcaaccgaggatgcttcttcagtcattgttgatgctccagagatgtctgaatcaacaggttcatcaagtcacagccctcaaacaaagcatgaaaatgtagttaacacaaacaaccagaatcaagataaggcacatgctcggttacagaatggtagtgtagactcttctcaacataaggaggcaatgactctaggaacaatgtcaagtgaaccacaacaaacatgtcaaggtcaagtgaagacagacataacctcccaaagtgttattaagagtaataaatatacatcatcagaagtaaccaaatccacattagggcctaagattcttcttgttgaagataacaagatcaatgtcatggtgacacagtcaatgatgaagaggttaggatacggcatggatgttgtgaataatggagtggaagccgtacgtgcagtgcagcgccatacttatgatgtcattttgatggatgtttacatgccagttatgaatggtcttcaaacaacaaaactgattcggtcttatgaggaaacaggcaattgggaagctgcaagagaagctggaattgaacaatgttcaccagcttcaaatgaatgttctgtaccacttaaaaaccggatccacatcattgcgatgacagcaaacacaatgtcagagagtgctgacgaatgttatgcaaatggtatggactcatttgtgtcaaaacctgtgacattccaaaaactgaaagattgtctagaacagtacctgaggtga

SEQ ID NO: 22246 - DNA, 1572 bp, Glycine max
  Peptide Sequence Number=SeqID_113931
atggcgaaggcgttagggtttagggtggttggattagggttaatcagtcagggggttataggcagagccctgggtagacaggatcatcatgatggagatgatgttccccagcgacgaaggcctaccgcatccgcatgtaggcaacaagaagctacccttgttgctgaggatgctcctgagatgagtgaggacatacttgcacctggtgcagaagctgctgatggtggtgagggatctgctgttgatggtgctcagggattcccaggtgggccacgtgacccatcagtgctgacttcgtttgctgaccatgttgcacttagcatatggaatggagaggaacaccctgaattgaagttagcctcccacggaaggaaagttgagaaatttgagaggccagctctagaaattgaagggctagtcgctgccacaagattaactcatttgatcacttgttcagtagacattggcaatcggagagttatattcgcttttgtcgagaggtggcataaggagactaacagtttccatctttcagtaggaaaactagcaatcacgctggacgatgtggcgtcactgcttcgtcttccgatcatagacgccttccacaacttcgagcctctgcatctggacgaggcggtgattatgttggtggagttgctagaggtctcggatgaggaagctagagctgagactaggagatgtgaggcccgacattggaatgttgcagctcgtgcgtatcttctacatttggttggttgcactcttttcactaataagagcgcaacacatgttcatgtagtttatttagacgcatttcgagacttggctcagagtgggagctatgcatggggagctactgccctagtgcatatgtatgatcagttaaatgatgtttctcagagcactagccgacagcttgttggttacattactttattacagtgttggatatatgagcactttcccagtgttcatgagagcatgactaatgaagggtatgatgagacgtcaccatgtgtctgtcagtggcttactacgaaggcttattcgaagggatttgcagcatcgacgtaccagacacgtatagatacactaacgatccctgacggtgagcttagatggggtcttgttgtggtcacacatcacctggagagggtagtgcgccaatttggctacattcagaccattcctccatcgccaattggtgccaccttgtcatttgaggatatggacgacaggtggatgcattactcagaccatctagtagctgcagttgatctgcccagacatccacctgtcccacaacatgagacatacgtggagtcagatatcctggaggtcccagtggcaccaaaagctggaccttcacaggcagttgatcagcccagacatgcaatggatgcttgcgaagcgatcgcagaaaggttggagcacgtgctcaacctaaggatagtcactacaggcacaaagttacatgacatcatggaagactgcctgaggatcgctaggggtgtcacctcagatggaaatgtgtatgttaggacgcaacgaagacggtgcatggatcagtga

SEQ ID NO: 22247 - DNA, 3363 bp, Glycine max
  Peptide Sequence Number=SeqID_113932
atgaggtatagaagaacccatagaatagcagtggaagggtgtttgtgtttgtgtcgctcatggcattcatcatcgaaatggcggaggaggaatacagtgaacagcgagacattgtcgagatgtccatctgatttgattgccttctcccttttcctttggtcagcccaacgtcgccgccacgactcattcgccttcgatcgcatagtgactgtgctccgtcggctcactcaccgctacgacaccgttccagccattctctctcacttggagaccatcggctgtgcctctctcacaaaccctgtatctcagttggtgctgttgaggatttactcgcgtgcaggtatgtatgcgatgctcttggaggcttatcaccacttgcaagcctcttacgcttttgtccccgatacctttgctcgtaatttggtcatggacgctctctttagggtcggccactcccatctcgctctcaccctcactctctctctcttcaaccacactcatccccctaatttcttcaccttccacattttgctcctccatctttccaaactaaacaacaacaatctcaatctcaacctccctcacatcgctcgtatgctcagacttatgctctgggccggttattctccctctcctctcacttttcagatgcttctcaattctctttgcaagattaatgcattcccacaggcttatcagctcctcgctctcatgacggttctcgggatcaatttctctgtcaatatttggaccattctcatccataactattgtaaattcggccgccttcgtcttgctaacaacctcttccacaatatgcttcaaactggttgttctcctaatgttgtgacatataccatcttatttaaggcttttatgcaatccaacatgccaagccctgcttttcgattgtttaatgtcatgttatcttctggccaatctccggatttaattctttgtaatgtattaattgattgtctttcaaaggctggaaggtgccaggatgcaattcaagtttttctcagtttgtcagagcgaaacttaaagcctgattcttatacctttgcttcattgttatctacaatctgtcgttccaaaatgttttatctcttacctaaactagttctagtctctagacatgtagatgctgatttagtgttctgtaatgctcttttaagctctcttactaaggccgaccttccttctcttgctgttggattctatgaccatatgattgatgaaggttttgtgccagataaatatacttttgctggattactaagtgcactctgttgtgcgggaagagttgataaagcagttaatgtgtaccatggtgttgtaatgagttatcatgacattgatgctcacatccatactgtaataatagttggtcttctaaagaccggaaagtttcacaaggctgtcagtgttttaagatttgcagtaatgaataaatatccactggacactgtagcatacacagttggcatctgtgcacttcttagaggtagaagaactcaagaggcttgcacattgtatgaccagatgaagaacgatggtctgaaacctagtgttcatacctataatatgatgctgttcactttttgtaaagaaagggatctccagatgataaaacagatactgcaagagatgattgattcaaggatatatttgagtggcagaaatttctccaacttgtgtaaatatatgtgtagatcagatactcatctttctcttttaaaattgttggctgagataagagatttgaggttattatctgccaaggcattgcatttcttaaactttgacaggcatgctgatggtgtacaagcaaaacataaacatcaggcagaagataatacagagtggaacctaattttggatacatccagttctgaagatctgtcagatgtagctgcttcagttgttggttttgatatagtggagacacctttgccttctgaattcacaccttggtatggacgtgccattggaagaccaaaggaggagagtacaaagttggtgatccaatatgttaaacatcgtgctgttcttggtgccaaatatcatcgcatagattggacatccatttctgatcttccagcttctccaatcgcttgtatgagaagaatgaattcattgaatagtaacatgagatttaggaaagcctcctgtgaaggtatcctcaataattctagtcctgatgctgaaattcaaattacaagtctaaacaaagaagcttgggatgactttgagaacaaaaatatcaagatggcccttgatgagattcttcgctgtaagatgatggctaagctgggtgcctcctcccaaaaaggtcaattgcaatatgatgggtggtcagatgcaaatgcgaatgctaatggacttgttgggggcactggcaatgaacgttttgaactatcacaacatttcttgcagagtgtttccaagtcaccatttccatttaatactggaaagcaagctgttaaattttctgcatggctggaggaaagaggcaaagacctcacagaagtgggcgctaatcttgctgaagatctacaatgtggggacatttttcatttgcttgctttagtctcatcgggtgaactttcaatttctccattcctaccagataatggtgttggagaggctgaggacttgagaagtgcaaagcgtaaatatgatactaccgagtcttcatatagtgataaagccaaaaagtcaaaatccttctttggagtagaaggtgaaattatttctcgtcgggaaaaaggttttcctgttgtttatgctgccatccaaaaggctggtgaccaaggattaagcatgggagaaatttcccaggttattaacttgccaggagcagagatagatgtcttgattgttgatgctcttcaagcatttgggcaagccttaaaggttaatgcttatgatactgtccgtgttgttgatgtcttataccgtcacaagtactttttgacacctatgtctgattttcatcttcgtgttgtacaaccttcctcatcaaaaaccatcgagaaaagtgatcatacatgtgagctttatgaatcggaggaaagggatactacttctgttgatacttcgaggaatgaaggctgtaagcaaaacagacttggcttatccagagtcaatcataagaaagaaactctcgaattttcttctagtaaatcatgtgtgccaatattgccatgggtcaatggagatgggatcatcaacaacattgtttacagggtactcagacgtcgtgttcttggaatagtgatgcaaaaccctgggatattggaggctaggaacttaggattttggatatttgacaagtttggttgctacaatcctacttga

SEQ ID NO: 22248 - DNA, 1920 bp, Glycine max
  Peptide Sequence Number=SeqID_113933
atggaagaacattccctacgttgtgggagcaactcgagacagaggagaaatggagatacgcacagaaggagcttcaatggtacttcaaacagaagtttgaacaggggccaaagggaacacaaacgagacgacaaggaatgctttaacaagaacgcgaaggacgctagctttggtaaaatcgaagagtggacaaaggtgattagtaggaggaaagcaaagaaaaggaagaagattacctcagaggatagaacaccccataagtatgacataaggggtaatccttcaaactatcatctcaactggagaaataaggaggatatcacgtccttctatttcacccacgtcacagatgaggtcaacgaagtgcggctttgggagaagtttaaggtatggggtgacgtgcgtgaagtctttatcgctaaacgtcgtaacaaggaaggtagaagatacgggttcgtgcgatttaagggagtttcagatgtaaagcttctggaggtgcaactggataatatcttcatcgatgatcaaaagttgttcgtcaaccttcctaggtttgcaagatcagcttggaaccttgagatgcagacaagggttggtaaaggaggggagccaaaaaaaggaactatcatatgtccagaagctaccaacagacctcgggtgagatcctacgcggaggtgacggctcagagaggagtctcaggtggaaggacgagctgcgaaggagatacaccaatcatttcggattgcatatcgtgggagttagggtacaatattagtaccaaattcctcggtgacgatatggtcattctcactggcctgccaaacaatcgggtcgtttggctacaactatggggattttcgattgaagtgtgggatgttgaccacatgaagcaggttgtctccattattggagatgttattgaaactgacgaagataccgacgaccgtcaccggttggatcgtgctcgactactggttcggacacctctcccgccggcgatcatgaaggaggtcattgttcgtactggggacgccgactatagggtgtggttggtggaggaggtcggagacgacggagctgtgaggagaacgagaactcctttgtccgaagagtggacggaagagataacgtcggtggaggaggacgacgacgatgatgacacaaccttctcctactcggcggagctgtcatcgaccaagaaccagcttcgttcgagccatcagtctcacgctatacccagtggttactgctgccaaacacccaaccactctagtccgctggataataccccttctgctgatgaatacatagacaagtcaggagacagaggggagcatactcagggttctatttcggcaaaggttgaccctgtggtatgtttcacagagaaggctcagggaaatgctttaacagatatgataaccttggaccctgcaaaagctgggtctcgacagcctgttgaagaccagattggaaattttttgaattgtgaagatttagcagaaaaggagcaaaacatttacggggtaaacacgagacttgtaacggataggggatcacaaccaggcatgccttctttacagttccaaaaggctattgggccaagctctatttcgggcccaataatgaagatggaggggtgtaaaaaggaaaaccacccaacttcggctcagacatcaaaagggagctctgatttgttctctaaagtctatgttagacaaagacatggcccatctaaagctgcccctcttgagcctgtagtagaagaagatatctcgctaagggaggacaagggtctgggtggtttaaatgattcctcttgtaaaggcccaaacaacaggactctagaggcttttgaggggttcaagaatacagaagaaaactctcttgaagacttggaagaggctatgcagcaatga

SEQ ID NO: 22249 - DNA, 189 bp, Glycine max
  Peptide Sequence Number=SeqID_113934
atgcacggaggagagaaaacaccgaaagaatgtgaaaatgaagcattgtgccgtttaaaaaagcttggtgcctggtgcaaagcactgttcatagcggcactgttcatcgtcaagacggaatgtaggagcagcagaggaacggcaagttgtgattgtgctacaatgggcacaaacagaatccttcactga

SEQ ID NO: 22250 - DNA, 1014 bp, Glycine max
  Peptide Sequence Number=SeqID_113935
atggcaccctactcctccaagcatcatcatacctcacctggtcattgtgactggaacagtgcttttcacggccaaaatggtggcatgggtgagcaaatcgtgttgcaatgccgttctgcagcttctattgattgtttgctctcacgctgcactgttaggggcgaagagattacgaaagaagaatatgctgctttctacaacagtcttaccaatgattgggaagagcatttggctgttaagcacttttctgttgagggtcagctggagtttaaggctgtcctctttatccccaagagggcatgttttgatctctttgacaccaggaagaagcctaacaacatcaaactgtatgtttgccatgtcttcatcatggacaactgtgaggagttgatgcctgaatatcatagctttgttaagggtattgtggattctgaggatcttcctctcaacatttctagagaaatgctgcagcagaacaagatcctgaaagtcatcagcaagaacttggtgaagaagtgcattgacatgttctttgaaattgctgagaacaaggaagactataacaagctttacgaagccttctctaacaacctcaaacttggtattgatgaggattctcagaacaagacaaagctagctgaattgctcaggtatcactccactaagagtggtgatgacatgaccagcctgaaggactatgttaccaggatgaaggaaggacagaatgacatctactacattactggtgaaagcaagaaagctgtcgagaattcccccttccttgaaaagcttaagaagaagggatacgaggttctctacatggttgatgctattgatgactatgctgttggtcagcttaaggaatttgcgggaaagaagttggtctctgctagcaaggaaggcctaaaacttgatgagagcgaagacaagaagaaaaagaaggaagattggctgcttaagttctaccataccctcacggaaggaacagagttggaggtttatcttgttatctaa

SEQ ID NO: 22251 - DNA, 744 bp, Glycine max
  Peptide Sequence Number=SeqID_113936
atggctaaagtaccccttcctctgctgctcctgcatttcgtcttgtcgatgaacagtgtcgccatgaacagtgttttgcaccaggcaccaagcttttttaaatggcacaatgcttcatttgcgcattctttcgttgttttctctcctcaatgcacagtgcttcttccccgtagttcttttgtttcgttgcgatcagtttggttcggtgaacggttaggttccgtgaaggtgaaggtgaaggcgttgcgatggtcgacggtggcatacgagatggacgaggatcagtggatgtatgaaggtataatgcctgaagaagtggatatggattatgaaaatgaagaagaatgtggtgtgaatgaaccacatgttgattgttcagatgcgttcaatacttctcaggaagctgaaattatgtggattggtttgtggtgtttgacaaccgagaggatgtctgacacaaacacaagtagtagaggaaggacttcatttgtgttaattgggtgtgaaaggagtgacgagtattggtgtaggaagaaagaattcgttagaagagacactaggactaggaaatgtgggtatcccttcaagcttcgttgcaagccaatggttggaggacaaggctggacgatgaagttgatttgtgggattcataatcatgaattgaccaactcattagttggacatccacatgatggtcaaaccaaaaaacattctgctgactctaaaggagcacaatgtcaatag

SEQ ID NO: 22252 - DNA, 438 bp, Glycine max
  Peptide Sequence Number=SeqID_113937
atggttgttgcccacaagctatttgatacaactgctattccaaatcttgtttcttggaacaccatgatatctggttttgaccataatcaaatgtttgagaagtcattggagatgtttaataggatgcatttgcttggtgttgaacctatgagtttagttatgggagtgttcttttggcctgttgggctaggcggcggggatgttaactcattggcaagtgcaccaattcgtccaaagcttaactacaaatggaaaaagcaaggaatggatgaagtgttgtatcaaatgagggagagatgggctactttaaagactctcgggcttctcgattcacgaatacgcgctcagcgtgctagtctcgctgagcgcgacgggatgctctctgacggcaggttctctagggttcttcttcgcgctaggcgggtgtctttgcactga

SEQ ID NO: 22253 - DNA, 858 bp, Glycine max
  Peptide Sequence Number=SeqID_113938
atggcacttgcaaataccagtgttgcgagtacaacggttctgagttccatgtcaggtctctttacccttttctttggagccattcttggacaggactcagtaaatataaccaaaatagcagctgttttaatcagcatggctggtgttgccatgacaactgttgggaagacttcggcagcagatgagaatattagtatgactcaaaagcattctatcatgggggacatttttgctctactctcagcaatatgttatggtttattcacagtgcttctcaagaattctgttggatcaggagaaaaggtagacatgcaaaagctttttggctgttttggtctctacagttttcttggcttttggtggctagcatggccattaaatgttgtgggaattgaaccacatttcaaatttccaagttcaatgtccacttgggagattgttattgcaaatagcatttgctcaagcgtgatttcagattacttatgggcactttctatagtttggacagctcctttggtttctacgttgggaatgtccttgacaattcccgttgccatgatagctgacatggttatacatggtcgcaagtactctgcaatgtacatccttggatgcattcagtctgaactgaacacgatccagagagaacccctgctccttaacgacgccgtttcgcaagcatcaatggagaagggaaagggagtgatgggatcgggaggaagaagatggggcgttgacttctccgacaattccacttctcgcgacattcccgatcctcccggtttctctcgcgcttctctcgatcaggcacaagctctctataaccctttcttctctttcaatttcgtcacattttaa

SEQ ID NO: 22254 - DNA, 348 bp, Glycine max
  Peptide Sequence Number=SeqID_113939
atgtccatgattgtgtttgacagccgagaggatgttttgcggtgggctcgatccgttgctcatgaaaatggatttgtgacgctgattataaggtctgacacaaacacaggtagtagaagaaagacttcgtttgtgttaattgactgtgaaaggagtgacgagtataggtgtaggaagaaagaatttgttagaagagacactgagactaggaaatttgggtgtcccttcaagcttcgtggcaagccagtggttggaggacaaggctggatggtgaagttgatttgtgggattcataatcatgaattggccgtcattagttggacatccatatgtcgagcgattgactaa

SEQ ID NO: 22255 - DNA, 309 bp, Glycine max
  Peptide Sequence Number=SeqID_113940
atgagctctttttggttggatgatgttcccgtattttgctccgctcattttgcctgtaattttaaagggcttcctcagtataggttggccttacagcagcatgtgaatattggaaaaagttgggacctaaggctgttgccttcctggccttacagcatacacgaccctagatgtaatgatggtgatgataacgataataatgacgacaatgatattaatagtgttggtgataataataatgtcaagagtgatgatgttatctgtgatgacgatgatcacagtgatattggtggtggcatcaagtggtag

SEQ ID NO: 22256 - DNA, 72 bp, Glycine max
  Peptide Sequence Number=SeqID_113941
atggaaggcagtgctcatactgaatgcattgttacagaagatagtgaagttgctgagactttcttaaattaa

SEQ ID NO: 22257 - DNA, 633 bp, Glycine max
  Peptide Sequence Number=SeqID_113942
atgatcactgttatgaccatcgttgtcgccaccaacatgattatcattgttgtcattactgtcgtgatcatcgccatgaccaccatcatcaccactaacatgacgattgctgccaccattgacgctatcaacatgaccactattgctgccaccgttgtgattgccgttgccaccaccgtcgtgatcgtcgtcatgaccactgtggttgccaccaacatgactgtcactgtcgccggcaacggtaatcatgatgacgatcatgagtgtgatgattgcgacaatgatggtagttgtagtgatgatcttgacctggaagagagtgtgcaagctgaaggaggaaggaagccttggactattaaggaagacttgaagacttggatattaaggaggaagggagacttagcttggactattaacgaaggaatctttgtggatcatggattgttaaagtatcttgatgttgcggttgcctactgctatttgagtgttataaattctgtaaaaccaaaaagggatgtggacaatgcagatttctttaaaacttttttggttcattttggtaccatcaaagttagcagctctagcttggagaatatcgctgaacaagtctccaacgaaggacaattcagctaa

SEQ ID NO: 22258 - DNA, 348 bp, Glycine max
  Peptide Sequence Number=SeqID_113943
atgaaaacgcagggttttagatctgacgaagaggaacacggaaagagagagagagagagaaaggaagcgtacagagagagcgaggtagaagacgagcttgaaggagaacttgcggagctccttgaagaggaggtagcacactacaatgaagctggaaccggccaacgacaggctcgacgctccgacgttcaccgctgtcagaatccggcgatcatgcgccgtcaaagcgccggcgactgcgacggaggtcgccattacacggaagtagttcgctgtcgccgaccagtagtcactctctggattatcagttctaactcaccgcgaaatgaagaaatacagaggtggtag

SEQ ID NO: 22259 - DNA, 436 bp, Glycine max
  Peptide Sequence Number=SeqID_113944
atggatggcaatataaatttaatattgcaccatggaggaagattcactccacatgccagtgatggaaaggttgaatatataggcggagaatttgacgtttgggaggatatatctgcagattacattaacatatttatcctatatgatctggtgaaagcatgtaagaagtatagcagtataggagattgtttttggttgattgataatgacttagattttaatcatgggttaaggagttgtacaacagatggagatatattatacttagtgagggatgctttggaaaatgagaatgagataaacatttattttcatcatgaagtagatccaattccagaagaagtcccacaaatgttgtacttgaaatgtcatccaattctaaaagctagtaatgaggatgatttagatgatgtacctattgatggccatgaggaag

SEQ ID NO: 22260 - DNA, 399 bp, Glycine max
  Peptide Sequence Number=SeqID_113945
atgatttcactgtcgaaaaaaaacttcgagataaaaacataccgtgagagcgagagtgactatgatacctacactgtgagcaagaatgagactgacagtgacaacaccgtgagcgacacaacaatgtgtcgcaagagtgagagtgagactaacaaagggtttgtgagggagatgagtcgtgagggagacgagtcttcttggttgaacactgaatacaagggaccaaccttccttgggttcattgcaagaagtgggatttgcttcttggttgatcactggacaacgtcttttgtgtccattgcaagaagtgggtacaacttcttggttgttatcattggacacaaggattttataaggatactgaaaatctcaagcgggttgcttggagactggacgtag

SEQ ID NO: 22261 - DNA, 1794 bp, Glycine max
  Peptide Sequence Number=SeqID_113946
atgtcgtcggtttacgttctagagcctccgacgaaggggaaggtggtggtgaacactacgcgcggtcctttggacattgagctgtggccgaaagaggctccgaaggccgcgaggaacttcgttcagctctgcctcgaaaactattacgacaacaccatcttccaccgcatcatcaaggacttcctcgtccaaagcggcgaccccaccggcaccggcaccggtggtgaaagcatttatggtggtgtttttgctgatgagtttcattcacgtctgaaattcaagcacagaggaatagttgcaatggccaatgccggaactctgaattccaatggaagtcagtttttcatcactctcgaccgctgtgattggcttgatcgcaagcataccatttttggaaaagtgacgggagatacaatgtataatcttttgaggctgggtgaacttgaaactgataagaatgaccggcctttagatccgccgaagatattatcagttgaggtgttatggaatccatttgaagatattgttccaagaacacttcaaaaacttcagattgaagctaaagctgatacaaaaaataaagagtcagggaaaaaaggcgtaaaaaaattgaacttgctttcatttggggaagaagctgaagaagaggaaaaggaattggcatcggtgaagcaaaagattaagagcagtcacgatgtcttgaacgatcctcgtcttctaaaggaagatactcttaataatgaactgagttcatcaagaagagatatgcaattatctgtaagggatgcacttaactcaaagaaagacgagcctcagaaagattcagatgctggtagcatggcatgtcttaatttcagtgatgacgatgaagcagattttgatgcaagaatgcgcatgcaaatactcaaaaagaggaaggagttgggtgatctccctcccaagccaaagttgcgaaatgtttgttacatctcaacctctgatctagggaatgtttctggttctacctatgcaagtttcaatgatcttataaccatgacattgtgctatcagagtcactgtcaggctgccttgtttattccctcttcatccccaacagaagataaatcttttagaaattattgtggccacttgatactaatcccatctgtcaatttgaaaactaaacataaaaatgatgaaggtccagtccagagaaccatgatacgtcgtctgcagccaggctcgttatgggtagcctttggccaatacttactccatgtttctgcactagcatatttgggaacaaagctatttgaacttgtggccaaggacccaaggtccaatgctgtaagtgttgatgaggatcaaccaaaggtggaaaaattgtccttgaagaaaaagggagttggatctgaagcaagagctgaacgaatgtctaatgcagatgcagatttgcaactattgaatcaagctgagagaggaagacaattgcagaagcagaagaaacgcagacttcaagggcgtgaagatgaagttctggctaaacttgaaaaatttaagaattctttatcagcaaaggcgacacccccaactgatgaatctgaagacgttagtaatgaggaattgtcagactggaaaggtgttagtttaaagtttgccccacagactggcaaggaccgcatgtctcgcaatgaagacccaaacgactatgttgtgcatgaccctcttctggagaaggggaaagagaagttcaataggatgatagccaaacaaaagagacgagaacgagagtgggctgggagttcccttacttga

SEQ ID NO: 22262 - DNA, 1200 bp, Glycine max
  Peptide Sequence Number=SeqID_113947
atggttagaaccagaggtttggatcggactttaggcaaaattataggaagagccctagggagagaacctaaagaaacaggtgttgatgatgtagttactaatgctgagagtttttcaggcgaaccccacgacacatcagttctaattggttatgttcatcatgttgtagtgactttttggagtgaagaggaacatcctgagttgaagttatcttaccatagagggaaggttgagaaatttggcagtcctctgatcacatgttcgttggacactaacgatcggggacttatatcgacttttgtggagaggtggcataaggaaactagtagtttccatcttcctgtaggagaggtgactatcaccctcgataatgtggcatcgttgcttcatctgcccattacaagcaccttccatagctttaaggctcttcatatggacgaagtcatgttgctattagttgaattgcttgaagttagttcagaaaaagcaaaagctgagacaatacaatgccatgggacatatgtttggctatcgtggctgagagacatttatcgttacaaatgtgatgcagcacaatggactgtagcagctcaagcatatctcttgcatttggtaggttgcacactgttgattcaagctctctttgttgctctcaaccagttttcccttcatttccgccaacttcagtgttttaaaggctcttggactcctcagcttccgaaggctcgctcagcgagcatgtctcgtagagcgagagtaagtgaaattccgctaagcgagcatgggcgcgctaagcgtgagaagagacaacgtcctctctgggcggatgcctttcgtgacctcacccagagtggaagctacgcatggggaactgtcgccctagtccacattccggcacagcctggggatcctcctaaacatccacccgtgctgcacaatgacatatttattgcaccagatattcctcagcacttggtggtggcagtggttatggacgaagcacctacagatgcacctgttcatgaggtttgccaaacaatagatgaaaggttggaaaggttgctcaacctaaggatagtaactgaaggtacaaaagcatacactatcacaaaagattgtttaaggatcaccagaggtgtgactgcggaacgcaatgtagatgtgcgatcgggacgaaggcggcatataaaagacacatga

SEQ ID NO: 22263 - DNA, 150 bp, Glycine max
  Peptide Sequence Number=SeqID_113948
atggaagggatagtgggaataggcagtaaggcaaggatagtgaccaaacgtgtattgcaagctaaggatagagcacttgccactgtcagaatagatgaattgttcaagaaattttatagaggcaacaagaatggactgaatatttcataa

SEQ ID NO: 22264 - DNA, 267 bp, Glycine max
  Peptide Sequence Number=SeqID_113949
atgaaggttttagagaaaggagatgaaggtataactatggaggaagaggatctattaatgcgaagtacgaagaaaataaaaaatgaccaaaaggagaaaggaagtgaaaatgatgtgtcttatgctaataaactcctaaaacctataggaggaaacatggatgatgtagttcttatggacggagtgaaggataatggtgttctagaggaagccccaaaggagagtctaagcattatggatcagaaacttggagggagcgaattctag

SEQ ID NO: 22265 - DNA, 159 bp, Glycine max
  Peptide Sequence Number=SeqID_113950
atgacttctactcatgatgccctgctatattacaacgagaggtggaacatgtcatgccaacacgactttgtgggttactcgttcacaggaaaaaattcaaaaagatttgacattccttcgggatgtagcatcaatggactgaaggatgtgatcaactaa

SEQ ID NO: 22266 - DNA, 369 bp, Glycine max
  Peptide Sequence Number=SeqID_113951
atggcatttttgggagaaacgagcagtcagatcattgtcaactctagattagcttttatttttctgaatggatcgattattcacaaccaatctggtgtttatttccaaaattccacttcgatacccattcgagtacctaatgattgtggttttgaaacgcgaaaaaacaaaatgcacaatacccttcaactaaccgacgatcaatatttggatgaaatttactaccggcaacacctttcgcagatacagaggtggaacatgtcatgccaacacgactttgtgggttactcgttcacaggaaaaaattcaaaaagatttgacattccttcgggatgtagcatcaatggactgaaggatgtgatcaagtaa

SEQ ID NO: 22267 - DNA, 162 bp, Glycine max
  Peptide Sequence Number=SeqID_113952
atggcattttgcggaatttttttttccaacttaactcatgtgactcggtccagactcgcgagtttacacgagtctaccccgagtccactgagtctgctccaagtctgcccaaaaatgagtttgcttctgagtcgactcgcagggcccaagttcaatccctaa

SEQ ID NO: 22268 - DNA, 159 bp, Glycine max
  Peptide Sequence Number=SeqID_113953
atggttagcaagaatgatagatcaccaggaataatcaccaacttcagtcctcataaggctagtgtttctctcaatcccacaagtttaccgaaaatcacccaaaaacattcccccaaatttgggacaaatttttctggattcatgagtgccctcctataa

SEQ ID NO: 22269 - DNA, 543 bp, Glycine max
  Peptide Sequence Number=SeqID_113954
atgacccttcggtcactttcccagggacccgcaaggccagggccagggaatctaagggaccatcttcatcagcgcctcctgcttctactgcaccagctcccctacctccgtcagcaccagctcacattgacacctccgctcagagcccagacatcattatgtcgatgctgcagagccttcaccatggcttcatcggcccatcatgagcatggaggagtttgcttcttaggtggcctggctaggagcctgaccttcttcttttggggaggtgaggcctctgcaacccagaagtctcagccggagccagaagctactcaggaggatgatccagatgttgtagaggaggacactgtggaggattcgctagagatgactccacaagcattaccagtgaccacacctgtgctggagttgtcttctttgcaagcatcgacggtggctacgcctgtgctagagctatctgaggatgaggatgatgccacagccatggattatgccccttctgcaccacatgatgacccttctgcaccacaggacccatga

SEQ ID NO: 22270 - DNA, 426 bp, Glycine max
  Peptide Sequence Number=SeqID_113955
atgtataaggcattacgggccaatgcacctctaccttacccacagttgataactttgtttctgcgtcattttcaaattccgcttgatgatgagccatttgttcaagtcaagcgttcctttgcaattggtgttggtgccgtgacttcctttggttaccgtaaggatcggaatggtcaatggctgaagaaagatgcattccctcctcaagatgagcgtactccttcacctcctcttcagcgagaagattcagcactcatgaatgaagtccttaccgaattacgaggtcttcgttcttatgttggtgaacgtttcgactcaatgaatacacgttttgccagcatggatattcgcctcacacagcttgaagaggatgtaggttacatttgtcagagtttcgatcttccaccgccacctccaccttcttag

SEQ ID NO: 22271 - DNA, 261 bp, Glycine max
  Peptide Sequence Number=SeqID_113956
atgagagagcaaatgtcagtgaaagggcgtgacagaggcagtgagagggcgctgtcatggtggactttgtctgagagtgaagcatcaccgcacgagaatgagggcgcggtcgcagtgagctctaagagagagggcatgagaagacaacttagtgtgtggaacaatgtggctagtgcgacagcgaggtgtgagcttgcaatgatgctggttttgcaatcagtttcgtgcgacgatgggggattgatggtggttaggcattag

SEQ ID NO: 22272 - DNA, 504 bp, Glycine max
  Peptide Sequence Number=SeqID_113957
atgtcgttaaacacttacaacatcggttttcaaataaccgatgatgtactgactgctgccattgggcgaccagagcaccttggttgtgtgcgtgttgttgaagccagtgtcacgatcaaacaatactttggaccggctctaaggaccttctgcacgtcttcacccatgactcccaaagacctggagtacataaaggagagttatgttgatccctcagggagcgacccagacacgggtgacttagacaaatgcgggttgtacgtcgaagaaaatcctccccgcttggttgccttaggaagactttatcaggggttgacaaccgttcacaacatccctttgcgcaatgatcaagtcaaggttggtgttgaagaagttagagatgcagatgctcccattcttgtacccattcaagagattgagttagggggtcagacacttaacactttcgttgcttggccaacacatcttgtcaaacatttctcagttagtgagttagacagttaa

SEQ ID NO: 22273 - DNA, 834 bp, Glycine max
  Peptide Sequence Number=SeqID_113958
atggggatggttggtggttcaacaaaactgatggatggagggtggttcaagttcgacaatgctttgggggttgctgaccttgactatgttctccatagggatgagccagctgagcttacgaattctagcacttcaaaagaaattgcattatacgaacgatgggaaagatctaactgtctttccattatgttcatcaagacacatatctctactagtatccgtggttcaatttcagaatgccaaaaagtcaaggatttcaagaaggccttggctagcaccctaatgtctaagttgtcatctatgaggctcattggagagaaaaggagacttgctcaagaaattggtgaaggtgcttttaccgtgactcaagataaagggaagaaggaaaggaaggaaaagaaccatatacctcctattgtcaaaattaagaaggagtctagaaatgcaaagtttctagaaaatgatgtggctagtcggagtgatttaactcaaggtattggtcttgaggaaaatcaatgtgaaggagcaattcctacatcaagttataagctagtggtttttggcgatactcaccaaaattgtgtaacacaagctccacatcaagttgatcatatcctagaagttgaacaacatcaaacacaaaatgttgagcaacctattgaaaaacatcaaacacaagaggttgaacaacctattgaacaacaaccagaaggtgtgaatgtaacattgagaagatcaactagaataaagaaacctacaattcctagtgattatgaagtgtatttacaagagtctcaatatgactttggagttaaaaatgatgttatggtatga

SEQ ID NO: 22274 - DNA, 702 bp, Glycine max
  Peptide Sequence Number=SeqID_113959
atgaccctttcatcatggcagaacaagctaaatagacaaatgtctacatcacccagctcccctcctcctccttctactgattcaacatcacattcaccttctaccatgaagaggacaagaaaagcaactcggttgagatcattggctactagaccaattggggcagagagacccttggtccatgtggatcctgcaactgggaaaaccgacggtctccacaaaaagaagttaagaacatatttggggattgtcgctcttgatgaggtggatgtgacatacgagaatttgaaactagtctctgctgctgagaaggatttgttgtgggaggatattcaatttgatttggcgtcaaaatgggcacttgtagtcgacaaggatgatgtcgataacactatttgcgaaaagtacaacatccgcaaggagaagtggacccaattttgtcagagccacaaagacccttcatgggaggaacaaaacatttccgctcacgtgttgtctcgtgggggttatgaatttcaagaaaacaagttgatggaggagaagaaaaagaaacaactagaggaagctgctaaatccaaaagcactaacattatcattgatcctccatctcctatcagacaacatgtgaagtggaagatgacctgcaccaagaaaattgaccaaatgacgtctgaggcagcaaaagacactactagaaaataa

SEQ ID NO: 22275 - DNA, 465 bp, Glycine max
  Peptide Sequence Number=SeqID_113960
atgattagtcatactggggatgttgctgttctggctcatccatgggcattgaaaaatccagttcccattgttagaaggttaaaagaagctggtcttcatggaatggaggtctacaaaagtgacggaaggctggcagcatatagtgaattggctgatgcctatgggcttttaaagattggagggtcagactatcatgggacaggagggcacaatgaatctgagctgggaagtgtgaaccttccagtgatagtgttgcatgacttccttaaggtagctcggcctatttggtgcaatgccatcagggagatattagagtgttatgctgaggagccttctgattctaacctagcaacaattactaggtttgggagaacctgtagttttaagggaggttcacccttgagttgtggacaggacttgattgatcatttgtctagccaagagatggaaaaatgcagagtttga

SEQ ID NO: 22276 - DNA, 555 bp, Glycine max
  Peptide Sequence Number=SeqID_113961
atgggagatgggtgcgtgattgagggcaccacggggaattccaattccaataacaataataacaataagaagaagaacaagaagaagaagaacaggggtgggagcaagaagaagatgacccacaaacaggtgttggccttcaagttaaagcttctagggagaggcggggaaaagctcctctttgaattgcattcgcactccaaattcagtgatggcttcttctccccttctaaagttgttgaaagagctcacatcaacgccatgaaagttcttgctttgacaaatcatgaaactatgtcaggcattcctgaagctgtagaatcagcttgtaaatatggcatcaagataatcccaggtgttgaaattagtaccatattttctccaagaggagactctgaagtagaggaaccagttcacattttagcatactacagctgtattggaccatcaaggtttgaggagctggacaagtttctatcaaatataagggatggatgttttcttcatgcgcagaacatttgtcttaaaactgaacaagctcaagttgcctcttaa

SEQ ID NO: 22277 - DNA, 540 bp, Glycine max
  Peptide Sequence Number=SeqID_113962
atggtggcaaggcatgtgatgagcgactcttttatgatgaaagttgcttgggagtcaagtacaaggatggatagtctgtgggttagagtggtgaaagccaaatatggttgcgggaatgacttgaagccaatgatcaataaagatagacatgggtcaaatctttggaggggcataaaagcagtgtgggacagctttgatgagaattgtgattggaccattgtaaaccagaaatatgccaaatgtctgaaacaacaaggtttttggtggcaatatatttggagcaacgagaccttgttggctcaactatctcacatgaacatgccgtggaatgcaaacaaaaagctgcaagatctgcttcctgatgtttcagttcgtagtcaaggtgttttcacttggataattactgagggagggaatataatcgtcaattgtgatggagttgtgtcccactctacacgcaaagttgtttgcggaggtgtgctaaggaattcaactgctacattccttggagcattttctgaatgcggagctgctagatag

SEQ ID NO: 22278 - DNA, 396 bp, Glycine max
  Peptide Sequence Number=SeqID_113963
atggggtttctcttactttcgcttcgcaacacccttgaacacattatgggaattactcctaatgtgcaacgccttcttcatcatgccatggatcctaatcgtcgacctcctaaccaacaagttacctacctccaagatcgctggcatagtcatcctcaatgcgtgctcactctccgagacttccacggaagccttcatcgttcggattttccggttgctcaaccatggcgcgtatgtctgcgagttatccgacaagctgcacatgatggtgtcgggattcacataggcggagcggacgatgaagtgcttgcaagtgcggacgtgtctccccctcacgtcgcacgcgtcctttgtcgtcgccaaccttgccgtggaggtccatggccttacagttga

SEQ ID NO: 22279 - DNA, 678 bp, Glycine max
  Peptide Sequence Number=SeqID_113964
atgctagacccaacccctatcgttactacgcattctaagcacaattcaaattccagaactagtaagtggacagaagaggaacctgtagtggcacacgagttcgagggaggcctcgacgatgccgtcgaggagggcaccgcagcgggagtcgacggcggccttgggcggttggtcctcctcgaggcggacaacatagactttgaggacggtgacaacgaggttggggagggagccgacgtggtggcgagggcgggagggccactcggcgtcgatgtcgtcgggctggagaaggacgaagttagagcgggagtgggtgaggaacccggcggcgcaattgtcgatgtcggtggggcactgcatcatcttgtacgccgcaaaactcatggtggaagaaacagtctcagcggtgaaagagaagagagaatatatggcatcaaaaccatagtgaaaagctacttgccaatcaaagatgctcatgtttgtcctggtatagatggtcttttgaatatcctgataaacatgttatcttatggtgaaatatcaaaggactttcaatcaagaaaattgtcagtttctctcttttcatttcaaattggttatgaggttcaaatactatgtactcgtttatgccctcttgaagctcagttgataagagcaacagagcttccctcaagctaa

SEQ ID NO: 22280 - DNA, 186 bp, Glycine max
  Peptide Sequence Number=SeqID_113965
atgaacttggatgaagatgatgttgtaatgggtgatgctactgctagaagtgacgctacaatgtttgctttatatgggaccttgaaggctattgctggagaagctggtgttccatttttctatcaggcaggattagaatttgaggagatgatattaggatctatttttctagaatgtaataactaa

SEQ ID NO: 22281 - DNA, 339 bp, Glycine max
  Peptide Sequence Number=SeqID_113966
atgaatgaaactagagccaagggtataaggttcgtccagagtaacgacaccttcgatgaaacctatgaagcatacataaacaacaccaagaattcaagttcaaagggtgatgccattttggtagcagcggaaattaaaagagtagggaagaagaagacaaacacacaagagttttatactggttcggcaaaaacctgtgcctacatccagtccccaagcgacctgcagtccttgagatttcttttcaaccttataaaattcctttacaagcaaagatccacaggggatgtaccctcccttgttctctttgaacaacctagtggatgtaccctccactag

SEQ ID NO: 22282 - DNA, 207 bp, Glycine max
  Peptide Sequence Number=SeqID_113967
atggaatggatgcaaggaaagcaacgaacgtcgttcaaagacaatagcagtgacaacatgaatttttttgaagcaagaaaacttaccaagacatggcgcctgagggtggctttgcgagactcagtgtggggggtcagggacaatggcaatgacgagggtgggtttgcgagattgagcgtgagcagagaaaagggttttgagttttag

SEQ ID NO: 22283 - DNA, 543 bp, Glycine max
  misc_feature (9)..(9): n is a, c, g, or t
  Peptide Sequence Number=SeqID_113968
atggagagnctggctgaagagtattctgggaacacctaccaccttatccagaaaaattgcaaccacttctgcgaagatgtttgtgtcagattaacgggaaagtctattcctcgatgggtgaatcggcttgctagactcggtaaaggatataggaaattgtttatgagatttgcaagaagctatgacaattgtggtaatggatacttcatcatgaattttttcctatctgaaaaagatgatgttttgaaggatccatgtgatacctcacctctagattctagagtgacacaaaccctcttcatcctcgttcaaaatttaagttttctctgcaactgtgttcttccacctagcctaaatgaaacaaaggttcgccaagttacaatagacagggttcaagaaggaggagaaaagaagaaaatgagaagccagtcgagcaggtacgaggcttcacccaatcctacattgtccagtagccaaagacattgccttcctccatcttctgtaattaatgcttctccgtcctcaaccttaaccgtaaagtaa

SEQ ID NO: 22284 - DNA, 240 bp, Glycine max
  Peptide Sequence Number=SeqID_113969
atggaattagtgcttcacatacagtttgagacccaggacccagcaggtcggattttgcaacccggatttaagaaaaggcattatgtgttctattccttctactttaaactagaaacactccaaaggtattgcaattctgaagtgatcaagaatgctctgggaagtagaattgatgtgccagggaatcatggtgttttaattgatggtaatcctagcaaaatcaagtgcaagtactattaa

SEQ ID NO: 22285 - DNA, 246 bp, Glycine max
  Peptide Sequence Number=SeqID_113970
atggattctgctgcctcaaaacacatttgtagagatcgagagatgtttgatatttttaaaactaatggagaattcaaccatttcaagttagggaatggtgaaaaaatgaaggttgaaggcatagggagcgtgaggatgaagctccatgatgttgttattcgaactttctcaaatatggggtttgtaccttctgctattgtcaatgtgatttttgatgcaatcctaccccccaagggcattggatag

SEQ ID NO: 22286 - DNA, 126 bp, Glycine max
  Peptide Sequence Number=SeqID_113971
atggattcaaaggtggccatgacgaagtcatggtggcttgatgtggcggtcgtggttgtggatatttcaagggagagcgatagagcagataatggagatggggttctaagtttgtggtggtggtga

SEQ ID NO: 22287 - DNA, 861 bp, Glycine max
  Peptide Sequence Number=SeqID_113972
atggggtcatccttgttgatggggttgatacccttgaagtctctatccgtgaaagtgatagaagggaaacttcgttgtgatggtgttatcgctcacatttgtgctgctggtatctctgactaccttgatcttctactctatctcttcttctatccgcatcatgactcctatgttacttctcttggtgtcctccagggtcaaacaatcttctgtgttatgaccaatactgcgatggtgtcagagatgtgtaatgctcgtacctgggcccttttaggagaggatggcacttgtccagcttatgcctcttgtctgacttgtgtgagtcggtcttggtgcttcattctcgcttgtcgtattgtccgcaaacttgtcaggccgtacaacgaggagcatgaaagagattcatcatctgcttgtcgtaggctggccagtgtggccaatgtcatgcgatgtgactggctggttgcatattatacattgaagcgctcaacaaaagtgtcgaagttgtcgatggatcatggaggaagtccatcgtgtcagttgaggttgagtggtttccaacctaagggtatgctagcttccatgatgcggtcaacaaagaggagccaacgagtagtctatcctactggacgatgcatgtgggagagacttagaacatctttagtcttgactgtgcgtcgagggtgtgatttcccttggccttcagctttctcagctccttcttatggcgtcctccatgtccgcaatgcgattttggagttgctggagagtattggtatctatcatggttgctggtggagggttggagccttcgaaaggggtctcatgtctaaggccagattgagtgctaatcatgggtga

SEQ ID NO: 22288 - DNA, 1005 bp, Glycine max
  Peptide Sequence Number=SeqID_113973
atggagctttttcccctgatggttataaggagtgtgtttgacttgcccatggttacaggtcttgtcaaccagtctggtgatgggtcgtcttggcctatggagcctgaaccttggactttggtcgtcatagttgccgtgagtgagcggaccaaggggggtacatcctttgtggtacaagtagagggtacatctacttgggttgtaatactgagaacaagagagggtacatctcttgtggatcagtttaagtggagggtacatccacttggttgttcaaagagaacaagggatggattaccaagtatagaccttggattttgtgaacctgtgaaacttactaagggtaggtcttgggttgggcgagcctttggagaatcgaccataaacgcgtccttccttgattttggtaagacttaccaagggcgaaccatgggtttaacgagcttggtgagtgtatcacacatgtcgtgctcttgcatacatgtcacttgtggagcggcatgtactggagtcgtagtgtcgtgctcttgcatacgtgtcacttgtggagtggcatgtactagagtcacaatgtcatgttattgcatacgtgtcacttatggagtggcacgtattagagatgtggtgtctttctcttgtatacgtgacacttatggagtaacacatactggagacgtggtgtcgtgctcttgcaaacatgtccctcgtggagtggcacatactagagacgtaatgttgcgctcttgcatacgtgtcactcatggagtggtacgtattagagatgtaatgtcgtgctcttgcatatgtgtcacttgtggagtggcatgtgctagagatgcaatgccatatttttgcatgcgtgtcactcatggagtggcatgtattggagacatagtgttgtgctcttgcacacgtgtcactcgtggagtggcacatactggagtcgtagtgtgtgagcctataggacttttcaagggcaaactttgggttttgacgagcctttga

SEQ ID NO: 22289 - DNA, 480 bp, Glycine max
  Peptide Sequence Number=SeqID_113974
atggtgaatatctcaagggcacctcaaactctctacctgactatcttacctatgaattcttatagaaaaattctcatgccgcctaaggtgtccggaacctccctacggggaggaaaaagcataggtaaaggttttaagttggccctacctgagccaaccatcaaaaggagttcttctacatcccctgggtcaccaacccaagctggggcatcttccctgaaacccaaaaaagaagggtcatcgacccaaatagtcaccatcaaacctgagccatccactcaggaacccccaaaacctgcaaccgtaaaacaaacaaaggccgactatgccttctcagtacaaactctccaggccctacaagaaataggtctaatcaaactaccaaaaatagttaaaaagacttgggcagacattgccttagaatctgatgatgattctgaaagagacctacaaaccatgattcaaaattcctcacaataa

SEQ ID NO: 22290 - DNA, 822 bp, Glycine max
  Peptide Sequence Number=SeqID_113975
atgggggagcaggagggtgagggcgaggtggaggggcaaggagaggtggaaatcgagagcgacgaagatgccgagcctgaccatgagaacgagggcaagaaggagcagagcttgcaagaggtggaggttgtggagagggaagaggagagcgagggaagagactcaaataatgatgccaaggacgacgggtacaaccatgtgacatcacgagtaagcagaggacgatgtcatggagagcggatcaaagagaatctggcatggagatttgggacacgcggttgtggtggtggaagcccacagtggttgcaaagtgactgcacagaagaggaggtggtcgcgacgacgtttaggcttttggagccactcaatgcggagtttcctattttgagctacgccgatttctaccaattgcctggcattgttgcggttgaggtaactggtagacctgaagttcccttccatcctgaaagagaggtagatcctagtaagagaccattgatggattatgttcagaagattcagagggatgttaatgctaacatgcgcgatgttcttgtggattggttggtggaagcagaggttgcaattgttggggttgcttcaatgctcattgcttcgaaatacgaagagattaagccgcccgaggtggaggatttttgttacattacggataacacatactctaaggaagaggttgtgaacatggaggctgaaatattgaaggctttgaaatttgaattgggtggtcctatagagattcttgagaagattcttgagagttggtcaagtgatcagaagaagctttataaatacacactttag

SEQ ID NO: 22291 - DNA, 237 bp, Glycine max
  Peptide Sequence Number=SeqID_113976
atggtgaagattaacaataaaacagaggaaatgttcagcattgttcatgttatggatcaatcttatgatgaagtcagtagatcatttgttataagatggaaagatgaacaagaccctacttggaatctgctacactcaagtagcaacatgtactctgttatatataaccaagatctggttagcccggctctactagttggatggacagaactcagagagttttatgggttcacttga

SEQ ID NO: 22292 - DNA, 888 bp, Glycine max
  Peptide Sequence Number=SeqID_113977
atggctgttgcagttaatgtatctcggtttgaaggcatacctatggctcctcctgatccaattctcggagtttccgaggcgtttaaggcagacaatagtgatgtcaagctcaatcttggagttggggcatacagaacagaagaactacagccatatgtgcttaatgttgttaagaaggcagagaatcttatgctggagagaggggataacaaagagtatctcccaattgagggtttggcagcatttaataaggcaactgcagagttgttactcggagcagacaacccagcaatcaaacagcaaagagttgccactgtccaaggtctttctggaactggttctctgcgactaggtgcagctctgatagagcgatattttcctggggcaaaagttttgatatcagctcctacctggggtaatcacaagaatattttcaatgatgctagtgtcccatggtctgagtaccgatattatgatcccaagacagttgggttggattttgagggcatgattgaagatataaagtcagctccggaaggatcttttatcttacttcatggatgtgctcataatcctactggtattgatccaacacctgaacagtgggaaaaaatagctgatttaattgaagaaaagaaccacattcccttttttgatgttgcttaccaggggtttgctagtggaagccttgatgaagatgcagcttctgtgagactgtttgtggcacgtggcatcgaggttcttgtagctcaatcttacagtaaaaatctcggtctctatgctgaaaggattggagcaatcaatgtgatttcatcgtcaccagaatctgcagcaaggtatggtaaattagatcttccattctttctgatatctgatgggcatgtctaa

SEQ ID NO: 22293 - DNA, 420 bp, Glycine max
  Peptide Sequence Number=SeqID_113978
atggggatcttaccgaaatttggagatgaccgatgtcaaagtcgacgtagtcaagatggactccacatagtcaagataagcttcacgatctcacacgtcgaactacatctcgactggggcctaatagcccgactgttaaggaataggcatggcaacggggtgggtcggggtcgggttttgtttaccccacccccaaaatcgacgggggtcggggcgggttcggggacgggttcgggacaggtattgagaatctcatccccgactccgaatccgaatttggttatcgggaaaaacttgacccttaccccggtcaactcaaattttcctcggggcgggttcgggacgggtcccacagattcgagccccgttaccatgtctactaaagaagatgtgcatgtgctatggaacacatgggactga

SEQ ID NO: 22294 - DNA, 90 bp, Glycine max
  Peptide Sequence Number=SeqID_113979
atgaagggtcaggattttctcatagctatcggtggggatgtaaggccattgaaaagggaaattgatgtttggttcagaaaggaagcataa

SEQ ID NO: 22295 - DNA, 111 bp, Glycine max
  Peptide Sequence Number=SeqID_113980
atgggagaaagtgtttaccatcgagcaaatgacacaatgcgtgacgatctatcattggtccgacagatcgatagcgaatgctccacgaaaccaaaaagcctcgccctttaa

SEQ ID NO: 22296 - DNA, 456 bp, Glycine max
  Peptide Sequence Number=SeqID_113981
atggtactagagaaaggctatacaccaggacctgaagttcttcctctagtagtatcacattcacctcccaaagtctcattccttcaccttgtttatcttaacaagcctgaaatcccagagttcgtcctagggactctagcagctatagtaactagggcaatactaccccttttggggtttctaatctccaacatgataaatactttccctgagcctacagatgaactccgtaaagactcaaagttttgggcattaatgtttattgcccttggtgtagctggcaccatatttcatccaataaggtcatacttttttgttgtagcaggctctaagttgataataaggattgggctgttgtgttacaagaaaattattcacatggaagtgggctggtttgacaaagctgggataagaagtgagatatacaagttgcgggtgagatatgtgcaaaattaa

SEQ ID NO: 22297 - DNA, 312 bp, Glycine max
  Peptide Sequence Number=SeqID_113982
atgggtgatcaagaggagacacaggaacagatgaaagccgacatgtcggctttgaaagagcaaatgacttccatgatggaggccatgttaggaatgagacaactcgtggagaataacgtggccaccgctgccgctgttagttcggctgctaaagcagaccctactctcccagctactgcgcaccatcctctcccaaacgcggtaggacgagaaaggagcacactggggcaacatcagcaaccccatttgggatacaaccgggtggcttacccttatggataccacctattacacgccaccagtcatgcgtga

SEQ ID NO: 22298 - DNA, 1247 bp, Glycine max
  Peptide Sequence Number=SeqID_113983
gttctaccaagtcaaggtcaaaagcctagataccaccagcatcaaggaattagggcggctgatggaacccctccaaatgcaagccttccgcaagacttacggaaagatcttagagttaaccatagcagaggtgtccatagaagccattgtatcacttacccaatactacgaccagcctttgaggtgcttcacattcggagacttccaattagtaccaaccattgaagaatttgaggaaattctaggatgtcctctcgggggaagaaaaccatatctttcctccgggtgtctcccctctttgagcagaattgcaactgtggtcaaggattcagcaagaggtttggaccgcataaaacagactcggaacggcatagcgggcctaccacagaagtacctagaagacaaggcgaggggtatggccaatcaaggagactggatcccgtttatggatgtgttagctttgctaattttcggggttgtcctctttccaaacgtggatggtttggtagacctagcagcaatcgatgctttccttgcctaccaccatagcaaggaaagtccggtggtagctgtcttggcagatctattggacacatttgaccgaaggtgcgaaaagagtggcgcacggatcatctgttgcttacccgccctctgtgagatagattgggaccagctcttggccgggataggaggtagaacatcagttggttcccccgatggaaggaaggaaaagaaggagggttgtattaactacaatcccacgctcgctataagacaactagggtaccccatgaggggagcaccgacagaagaaagcatgtctcctttccttgtgagggatctcggtgcacaaggttccgagactatacaaagaatccataaggcatgggaaaccccgttaaggaaagataaagagcttagaggcgttcgtaatggcatcatccctgggtaccacgaatggctgaaccctcgcatacgaggtttagattggctcgccaagttaaaagtcgtcagcgaagagaattttgaagcaccggaagaggacgaggaagtccaagctctcaaaagcgagttaggaaaggcaaaactcgccaagaagaagttcaagttggctgctacacacgttcggaaggagtgtgccgggttacgggaagagaatgcaattaccgcaagagcccttgaacgagagaccaagagggctcgcaaggaagagtatggccggaacaaatttcgcggagctctatggg

SEQ ID NO: 22299 - DNA, 234 bp, Glycine max
  Peptide Sequence Number=SeqID_113984
atggtcctcctggttggacattcagaagcaatatgtcctttgcctacgcatttgaagcattttatgtttctggttccagtattggatgaggaagtggaggtgttatgtttgcttccacctccactggacgctgctgactttctatgtggcccggatgttgctggaattggaaaggaggattggtgccatcccttgaagaatttgagtaaagaagcaaggggccaaccaccttaa

SEQ ID NO: 22300 - DNA, 477 bp, Glycine max
  Peptide Sequence Number=SeqID_113985
atgggaggatattcagcttttgatagtaggacaaagaagaaaattcttcagattgtcggcgagcgctggaggcagtttaaatctgacctgactaggaaatgggcacttgcagccgacaaggatggtgtggacgacattttctgtgaaaaatatggcattagcaaggagaaatgggcccagtgtcagacccgcagagacccctcatgggaggatgtgcggaaaaagccctcccgcctcccagaagcaaaacacccgctcccctacatattgtctcatgggggttatgaatatttaaaagaaaagctcatggctgagaagacaaagaaaagactggaagaagctgcccagtctggaagcactgaaggcatcattgaccctcaatctcctatcagacgccacgtgaaatggaagatggcccgcacgaagaaaactggacagatgacgtttgaggcagcaaaggaaatagctgacaggatt

SEQ ID NO: 22301 - DNA, 543 bp, Glycine max
  Peptide Sequence Number=SeqID_113986
atgacaagcagagaccaagtttggtcattctgcacccttgtatcatccagaggcggcgggcccgatgatacgcggagataccttacggttatccgcacccttttgtcatccagaggcggcgggcccgatgacaagcagagaccaaaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccatgatacgcggagataccttacggttatccgcacccttttgtcatccagaggcggcgggcccgatgacaagcagagaccaagtttggtcattctgcacccttgtatcatccagaggcggcgggcccgatga

SEQ ID NO: 22302 - DNA, 222 bp, Glycine max
  Peptide Sequence Number=SeqID_113987
atgggggagatgcttgccacccagctcgcccagacgagctgggttgcttcctccagaagcaactgccttctggaggaattttctggaaggcccaagtgggccagcttccggcatgtcacggaacttcacgaattgcctaacgatgggtgccaagtacctcgaagtggtcaaacgagggtcgcatcccacaacggatggtccccggacgaaattagggtatga

SEQ ID NO: 22303 - DNA, 609 bp, Glycine max
  Peptide Sequence Number=SeqID_113988
atgtgggcctttcataaaggtttacaaattgattgggcacaccttgttagatatcgcatgcataaggaattgcgattgaatgccccattaccttatcctcatcttgttacccttttccttcaacacttcaacatccctcttgattctgaaccttatgttccaatcaagaaatcattccttataggcgcttcagtcatagcatcctttggttatattaaggagcatgatggctcttgggtaaagaagggtgctggaaatgttggtgaagaaggacatgagggagaagattcatctcttctttcgaagattttggaaaggtttgatggtcttcaaacctttgttgaagttgtcatcatcaaaaagggggagactctagaagcaaagcttcatggtgaatcaaaggtgattcaaagatgttttgatgataacaatgatgatgacaaaggtaatgacaaaaagctcaaagatcaatcaaagaaaaactcaagtgaatcaagaacaattcaagagttcaagataagaattcaagactcaagcagaaagtctagagacaagaatcaagattcaaggttcaagatctcaagaatcaagatcaagattcaagaataa

SEQ ID NO: 22304 - DNA, 307 bp, Glycine max
  Peptide Sequence Number=SeqID_113989
atggaaaaatctgaaaagaaaaatcatagtgagaagaaactaaagaaagcatacatcacgtcggatgaaaatgatttggaatcctctgaagattctgaaaatgaagagataaatctttgccttatggcaaaaagttacgaaagtgatgaagaggtttctttgagaaagaagtggtacatagatagcggatgctcaaaacatatgactggagatgcatcaaattttacacatatatctccaaagaaaagcgggcatgtaacatatggtgacaacaacaaaggtagaattcttggagtgggtaaaatag

SEQ ID NO: 22305 - DNA, 421 bp, Glycine max
  Peptide Sequence Number=SeqID_113990
gcgcccccaggtaggcgcaaggcgagacaccacagcagcctggggatggccggcagcgggcaatagacacaccgctgccacctccagagcccctcagttcatccacaaaaaggttagagcgttgcctacaacacatggccgaccaataggcgaccaagtccaaagccaaagtaggacacacctagttgctcatgatcccaggaatttaaataaaacgagcacaagctcggaaggtggtgaagataccttagatatgcatggtgagaatgtcaatccttaccctcggaagaaaacacaaaaagaaggaaaattctcaatcaaagagtgggagaaagcaaaaaagaaaagaaggaaaattcccaatcaaagagtgggagaaagcaaaacaaggaaggaaagaaaattctcaatcaaggattga

SEQ ID NO: 22306 - DNA, 333 bp, Glycine max
  misc_feature (298)..(298): n is a, c, g, or t
  Peptide Sequence Number=SeqID_113991
atggacgaagatcaatgggcgtatgagtatgcgatgtcacaagaagttcatatggattatgattatgataatgaagaagaatgtggtgtgactgaaccacatgtcgattgttcaaatgcttttaatacgtctcaggtatttggtactcgagatgatgttttgcagtgggctcgaacagttgcccatgaaaatggatttgttgcagtgattatgaggtctgacacagataccggaataaagaattcgttagaaaagacactgggagtaggaaatgtggttgtcccttcaggcttcgtgngaaaccagtgcatggaggggaaagttggatggtga

SEQ ID NO: 22307 - DNA, 624 bp, Glycine max
  Peptide Sequence Number=SeqID_113992
atgggatggtcctggagtgaccagggagaagttaccgtcaacctttattctatcgctgcatgttacaccaccctcggcgataccgatttcaaaaactgtcatagtaatgaaggcttttacggtttcggttgggatcaacaagctatcggcactctgctgaaatccgggcacacctggaattttgctaaagaagatctgttccgtagggcgtctttctttggtgaaataatgacgagctggccacagctttacccggcactgtcgaaagcttaccgtgaagttaaccagaatgacccaaccctggttaatagcagccagaaaaaaatcgactggtttacgcttaatgccagtaaaatcgccggcgttaatctgaaccagtatttccagcagtggaatattcccctttccgcagaggcgattgcagcaattaatgcgctgaatttacctcagcctaagaaagttgcgaaaacctttactggtagcctgaacggctcttccccgataacgattgaagttccagctgaagataacaccgtaaatattgcttttgtgaccaacacacctaaggcgggccctacctctctggtctgggttgaggatggtgaaacgccactgtatgcgcag

SEQ ID NO: 22308 - DNA, 63 bp, Glycine max
  Peptide Sequence Number=SeqID_113993
atggaagagaagcggaaggcaaaggagaataggagaggggaggcaccatccactagggaataa

SEQ ID NO: 22309 - DNA, 648 bp, Glycine max
  Peptide Sequence Number=SeqID_113994
gggcaattaattatagtctcgggagaagaagacattcttgtgagttgtccttcttctacgctttacgtggaggccgcggtggagttcttggaaatgtcctttcaagccttgaaagtggtaagtaatgcttacgttgagtctcccccgatacaacctcgctcatttggggctgcattgatggtagctcgggtaatgttgggacatggatatgagcccggaatgggtttggagcctacgtgcgctgacgtgaggcggattgccctagaaaggatgggaagaagcatgggccagctacaagggctgcaagtgaaaaaggttcccttatgtcacatcaacaagagctttgtcagcatgggttggatgtgcgagggacgaatcaccatgatacacaaagaaacccctcaagagcaatcaaattgggtgcagtcgtgccctctggagttcaaattggggaactggcgaattgtcaaacaacccagaattttcgtggcgagctcaatatccgacaatgagtcttgtgaaggtaatgatgctgaggacacagatgtcaattttgagcaactgataaatcaagcggaggaaggggaagatgaggattgggggcttcccccagagctaaaaagaacggtcgaacaggaagatagggaa

SEQ ID NO: 22310 - DNA, 261 bp, Glycine max
  Peptide Sequence Number=SeqID_113995
atgtcaggatttacacacgattctcctcaaatttcagccagcccgcatcaattagaccttgcaccttacacttcaggcccctacaatgctcaatggaatgccccggggcttctccatgacaagcacacgttgcgttcgagtcgtattctcggagaaatggaggttgatgaaccttggctttctcgctgcaaaattcatttcttggttggtgttttggtttacgctaaaggtggtgtttgtcattggaagtgcggtaggtag

SEQ ID NO: 22311 - DNA, 422 bp, Glycine max
  Peptide Sequence Number=SeqID_113996
gtggacatcacctacgagaactgaaggaggttcctactgctcagaaggacctgatttgggaggatattcgggaagaatttgatgtcccagagaggcttctgacatttaaatcagacctcatgaagaaatgggcccttgcagccgatcaggacggtgtcgaggacactgtctgtgacaaatacgacatcagcaaggaaaagtgggcccagttttgccagactcgcagagacccttcttgggaggatgtgcgcatcaaggcacaggccatccagaagcagaatactgtcccccaagttttgtctcgtgggggttatgattatttgaagcagaagctcgtggctgagaagacaaagaagaagctgcacagtcaggaagcgttgatggcgtcatcgaccctccatccccggtcagatgccacgtga

SEQ ID NO: 22312 - DNA, 342 bp, Glycine max
  Peptide Sequence Number=SeqID_113997
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggtaactatcgtcttgagtcccaacccgggaaagacatgcaaaagcacccactggcagcagccactgggaaattga

SEQ ID NO: 22313 - DNA, 597 bp, Glycine max
  Peptide Sequence Number=SeqID_113998
atgcagcaacctggagcaattgagcagcctgaagcttatgctgcaaatatttacaatagacctcctcaacctcagcagcaaaatcaaccacagcagaacaattatgacctttccaacaacagatacaaccctgaatggaggaatcaccctaacctcagatggtccagccctcagcaacaacaacaacagcctactccttccttccaaaatgctgctggcccaagcagaccatacattcctccaccaatccaacaacaacaacaaccccagaaacagccaacagttgaggcccctccacaaccttccctcgaagaacttgtgaggcaaatgactatgcagaacatgcagtttcagcaagagactagagcctccattcagagcttaaccaatcagatgggacaattagctacccaattgaatcaacaacagtcccagaattctgacaagctgccttctcaagctgtccaaaatcccaaaaatgtcagtgccatttcattgagaagcagcacatcccacttccattccctccaagagcagttcccaacaaaaaaatggaagaggcagagaaagagatcttggaaacatttagaaaagtag

SEQ ID NO: 22314 - DNA, 516 bp, Glycine max
  Peptide Sequence Number=SeqID_113999
atgggtgacgtagaagaggtgcaagaacaaatgaaggtcgatatggtggccttgaaagatcaaatggcttccatgatggaagccatgttaagcatgaaaagactaatagaaagtaacacggccacggctgccgccgccagcgccgccgccgaggtggatcctacccatccatcagccacgaatcaagcacatcaacccaccccggatagggcgggacgaggaggagaggtgttgcggagcaccggtggcctgcacatggggtataatagaaatacttacccctacagcttaccccccaattatacgccgcccaccatgcatgagaacgttgatcatgccattcttgttacctttgagggccagcaaccccagcctatagggggcgcccatgaagagcctcgggagcatgcccaaggcgacttcgactcatatcccctgttcaccactgaggggtcgacgctcaatgctatgcctcaacccaacatcatgggaccatctcaaccccgccctctgtga

SEQ ID NO: 22315 - DNA, 523 bp, Glycine max
  Peptide Sequence Number=SeqID_114000
atggaccctcggagggctgcacgccctcaccttaagaagactgtgtgtcctcaccttcagaggactgcatgtccttaccttcagagggctacacgccctcgccatcagaggactgcgtgtcctcaccttcagagggctacacgccctcgccatcagaggactgcatggctacacgccctcacctttagaggactacacgtcctcgccaacagagggctgcatgccctcaccttgagaggactacacgtcctcgccaacgtagggctacacgccctcacctttagaggactacacgtcctcgccaacagagggctgcacgccctcacctttagaggactacacatcctcgccttcagaggactccacgtcctcaccttgagaggactacacgtcctcgccttgagaggactacacgtcctcgccttgagaggactacatgtcctcaccatcagagggctggacgccctcacctccagaggactacacgtcctcgccttgagagggctacccgccctcgccttgg

SEQ ID NO: 22316 - DNA, 935 bp, Glycine max
  Peptide Sequence Number=SeqID_114001
ataatgtattggggagaaacatcttgacagagaggaaggtggagatctaccacactgagtttgatgattttaaggctgagttggagaggcatagtctccataaacacctcaccaatttggttgatgggagcatagatgtgtcttcggtgaaagagttctacgcaaacctatacaactctgaaggtccttcaccaaagcaagccagggtcagaggccatctagtgaagatcgacgctgacaacctcaacacattcctagagacacctatggtgttggcagaggggccatcctgggaggatcctgaggaaggacttgacaactttagcctagcccagtataactcttttagacttgggtttcctgctttgatcaccgccctatgtcgagccagaggggttgtctctgacagcctcacttttgagtgcctaagctcggtcattaacttagcctacatcaggaagaaatgttggaatcatgatgatctaatagttgctatccgaggggctaggagggcgagggcgaggtcagctgatcttccttccacatctgcagctcctactccagcagccacttcagcagctccttcagtcccagctcagatggattctcagcgctttgaagccatgcttcagagcattcatcaaggacaaatcattttacttcagagtcccacagcccaggtaccacagcatgtagaggatgcatcatctgaggccaccattccaaagccattcattgtagaggaggaggcaggtgagacacaggttagacaggaagctactgctactcctgagaggtcacgagagataccagaggacccgaccacaccagtcctgactctgaacacttctcctccagctaatccagtacttcatctgatagatgaggagggtgttcagacacacgatactcaagaccagtcacatgaattctaa

SEQ ID NO: 22317 - DNA, 531 bp, Glycine max
  Peptide Sequence Number=SeqID_114002
atgaccatagtagccacagcctaccaaacattccatgagtgttcagaagaaaccattattgacatcctaatagcaggattttccggacaattgaaaggatggtgggatagttatctcactaatgatgaaaagtcaaaaatttacaacatagtcaaaacggatctcaatggaaaagtcattactcatgatgataataaagagattcctgatgctgtaaataccctcatttttacaatagcccaacattttattggagacccgtcactctggaaagataggtctgtagaattattatccaattttaagtgtagaactttaacagattttaggtggtatagagataccttcctaactagagtttacactaaagaagatagtcagcaacctttttggaaagaaaaatttataactggtcttccaagatcattaggagataagaaagtgaccctaaaaatctgtcaagatgacaattcaaaggcaattagccaaagaaaaagcccaaacaaagagagatctaagatctttctgtga

SEQ ID NO: 22318 - DNA, 474 bp, Glycine max
  Peptide Sequence Number=SeqID_114003
atgctctacctgattgtgcgcatcctacttcctagatcatccaaccttgcacaagtttctgaggaagatttgataattatgtgggttttcttaaccggttgtcaaatcgattgggcccatcttgcagcagaagaccactctccatcaccacctcctcagagagatgattcttcatctcttatgcacaacattcttgacagactggatggactccacactttcgtcagtgagcgttttgactcattggacagccgcattgacgccattgatgcacggtttgcaggaatggatacacgcatcactcagcttgaggaagatatgagttttgtttgtcatcatcaaaaaaggggagattgtggaagcaatgctttctacgtttattttgatgatgccaaagactcaagtcaagaatcaagagtcaagcaagtatcaagaatcaaagagttcttcaatcaagaatcaagattcaagtaa

SEQ ID NO: 22319 - DNA, 285 bp, Glycine max
  Peptide Sequence Number=SeqID_114004
atgacaccggtaaaccgaaaggcaggaacaggagagcgcacgagggagcgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatcttccgccccgttcgtaagccatttccgctcgccgcagtcgaacgaccgagcgtagcgagtcagtga

SEQ ID NO: 22320 - DNA, 311 bp, Glycine max
  Peptide Sequence Number=SeqID_114005
atgagaatcatgaaactggccaaatacagactaaaggcccttgtggagaaggacgaaggcccaagtggagaaggacaaagcccccgagtggagaaggatgaaggcccagaggcaaagacactatcaagactattaattacttatcaaggtaatccttgtggcgtctaccctgacttatcttccttcaccggaagtggcgtctaccctgacttatcttccttcattggaagtggcgtctaccctgacttatcttccttcaccggaagtggcgtcatccaaaccttcgtagcctgtatcaagcgatccgcctc

SEQ ID NO: 22321 - DNA, 438 bp, Glycine max
  Peptide Sequence Number=SeqID_114006
atggcttctcgacctagctggttgtgtcgggtttggttgatctgcgatgacctggcgatgggttactaccctgatcgtatgctccgccactttggctacgtccagaccattcccctgcctgttcctcagggttctgcgctaggaataccgaccgagcataatgtgatagatagagagaacttctttaaccaagtttgggagcgaagattcgactacaccattcagaacctcatgcagggtatttgggcagtggagttgcacatgatcggcccacctctatacttgcaaccacctgattggacggataggagcactatccgactgaatgagcgcagagcgaatgaggccctcgcggaggtgaacacgaggaatgctgcggcttttgattacaagaagactcttagggcaaggcttatgaggcgcagctcttggagttga

SEQ ID NO: 22322 - DNA, 1101 bp, Glycine max
  Peptide Sequence Number=SeqID_114007
atggccccgaggaagcttgcctcaaagaggtccaggaaggacaaggcggccgaaggaactagttccgccccggagtacgacagtcatcgctttaggagcgttatacaccagcagcgcttcgaagccattaagggatggtcgtttctccgggagcgacgcgtccagctcaaggacgacgagtatactgatttccaggaagaaatagggcgccggcggtgggcaccactggtcactcccatggccaagtttgatccagaaatagttcttgagttttatgccaatgcttggccaacagaggagggcgtgcgtgacatgagatcctgggttaggggtcagtggatcccgttcgatgccgacgctatcagccagctcctgggatatccgatggtattggaagagggccaggaatgcgagtatggccagaggaggaaccggtctgatgggttcgatgaggaggccatcgcccagctgctatgtataccggggcaagattttgcccggactgctgcaggaaggcgggtgcgaatcatgcgcaccaacatgaccaccctgacccagatatggatgacgttgctcctcagcaacatcctgcccactgatcataattccgacctcccatgccgaagtgccagctggtgtatggcgcccactaggcaccctttggacccagataagtccaacagggccctgggattccccgcactgatcacaggactctgccagtcgttcggagtccccgttgcgcctaccaaggccgcaggcgcgcccccaccacctcatcaggctggccaggctggggcatttgacatggagcagtatttacggcatttggttcgccagcaggcggccaaccaccgagcacatgtacggacccatgattgtctgtaccagatgagccttagcatgcagagccagggcttcgcttctttttcatgccctactccagaccagttcagggcagaggttgcatggcccggagattggcccgaggcccaagcaggagaggcacccccagaagctcccggcgatggagaagaagcccacgaggatgaggagatggccgatttgcttgacttcttgggagggagtggagatacgtga

SEQ ID NO: 22323 - DNA, 129 bp, Glycine max
  Peptide Sequence Number=SeqID_114008
atgatgcaatcctccctaggaaagggaccagtcactagagccattagcaagagactccaagaggattggactagagctgctaaagaaggccctagggttctcatgaacctcaagggctccataatgtag

SEQ ID NO: 22324 - DNA, 261 bp, Glycine max
  Peptide Sequence Number=SeqID_114009
atgacgtgcgaccattctttggtcctcgtgaggtgcttggcacccatcattaggcaatttgtgaaatttcaggacatgtcgaaaaaccaaaaaatattgatgcacaatccgcccatttgggccctccagaagattcctccagaaggcggttgcttctggaggaagcaaccctgctcgcctgggcgagctgggcggcaacctcctcccctatttgctataaataggggaggaaagcaagaaggaatgggtccagccccttag

SEQ ID NO: 22325 - DNA, 246 bp, Glycine max
  Peptide Sequence Number=SeqID_114010
atggctccttctttagttcgattatatgaacaaatgcccgaacctaaatatgttattgctatgggagcatgtacaattacaggggggatgtttagtaccgattcttatagtactgttcggggcgtggataaactaatcccagtggatgtctatttgccgggctgtccacctaaaccggaggctattatagatgctataacaaaacggttcggccgtatagccaaatattcctcgagaaatatatga

SEQ ID NO: 22326 - DNA, 369 bp, Glycine max
  Peptide Sequence Number=SeqID_114011
atgacgttgctacttagcaacattccgtccagcgaccataaatgccgatctccccctgcgaaagtatcagttggtctgtgccatcatgagatagggatcgcgcccacaaggcacccagtggacccggaggagcccaacagggccctagggtttccagctctggttacgagcctctgtcagtcctacagggtgcccgtccctccggcaaggtcatggcatcatgagatagggattgcgcccgaaagacacccagtggacccagagaagtccaatagggtcttggggttttcagctctgattacaagcctctgtcagttctacggagtgcttgtcacccccagcaaggtcatcaggccccctactaactga

SEQ ID NO: 22327 - DNA, 296 bp, Glycine max
  Peptide Sequence Number=SeqID_114012
aagatagagttcaagttggaaagagaggttgcactagcgccggagccgattgcttgactggcacgttcggttcttcgggatgtggtgtttggaccgacccgatctcggaatcccataacgtattagtaggagcgcaagccgatgtcgttgatagtgcaatggacacgtcggtaaggcgtacctctctggttgtttctataggaggaggcctagtactagttgttgatataggggagcctggcccatcatgtactaaacctactacttgggaggttcgtatgggtactagcttatag

SEQ ID NO: 22328 - DNA, 507 bp, Glycine max
  Peptide Sequence Number=SeqID_114013
atttatcatactgaattcgatgagtttaaggcagagttggagaggcataacttagacaaacgcctcaccaatctccaagatggaagcatagatgtagctgtggtgaaggagttttatgccaagttatacagcccaaaagaccagagccctaagcaagtgaggggtgagacactgcctacctattctagatttacgaggatgaggattgatcctcaagagtttgctgcccgtctctgcatccctgagggccatccttggaagcttttgaggaaagatctcaccactcttgcacagacatggaatgtcctctcctacaacaacctgactcccacttcccacacctctgatcttaatattgacagagccaggttggtttacggcttagtcacaggtatggacatgaatatcggagccctaatcttaggtcagatttctaccattgcccagagtaactcctccagactcggattcccagccttgatcactactctctgtagagctggagga

SEQ ID NO: 22329 - DNA, 222 bp, Glycine max
  Peptide Sequence Number=SeqID_114014
atgaagggaattgctcttaaagcctcatcttcaatccaaaaagaaagtgataaggaaattgatctagatgaagatgatgatcttagcctctttgtaaaaaggttcaacaagttccgaaagtcagaggaagtcaaaggcgaccaaattttaaatctaaaagaaggacagaaatctcatcttctactccaaaatgctttgaatgcaatcaacctagacatctga

SEQ ID NO: 22330 - DNA, 462 bp, Glycine max
  Peptide Sequence Number=SeqID_114015
atggcagaagtctccacggaggccattgcatccctcgcccagtattatgaccagccgttgagatgtcagaagagcagtataaggattgtgtgctgtactccggccctctatgtatggttggtttcgcacctttttcgccaagaggtgaggcatgcttgcccgctagaaagccaccgttcaagcacagagaaaagaggggaaaattgggaccgactcttagcaagcaaagaaggagcgtttgtcaactggttccctcgatggaaagaaggaagaaccgggattcttatttcgtgcggaggatttccaaatgttcccttgatggggacaaggggttgcatcagttacaatcccattcttgttataagacaacttggctaccttatgagaggggcaccactagaggaagaactcacacctactattgcaccaggtttcaataagaccaacatggaggcactttaa

SEQ ID NO: 22331 - DNA, 340 bp, Glycine max
  Peptide Sequence Number=SeqID_114016
tcgggaaacctgtcgtgccagctgcattaatgaatcggccaacgcgcggggagaggcggtttgcgtattgggcgctagcggagtgtatactggcttactatgttggcactgatgagggatatattccgcttcctcgctcactgactcgctacgctcggtcgttcgactgcggcgagcggaaatggcttacgaacggggcggagatttcctggaaggatgccaggaagatacttaacagggagactaataaagataccaggcgtttccccctggcggctcctcgtgcgctctctgttcctgcctttcggtttaccggtgtcattccgcttgttatggccgc

SEQ ID NO: 22332 - DNA, 452 bp, Glycine max
  Peptide Sequence Number=SeqID_114017
gttcaagatccttggatatcgaaattgagatggcttcctcaaatggaaattttccagcatctatgcctgttctcaaaggcaagaactatgatgattggaacccaactgatgcacagaaggtggctcaccgtgatttgatgaaaagagatgcaaaggcattgttcattattcaacaatgtgtagatgcagataattttcagaaaattagatctgctgatactgcaaagaaggcatgggatactctagagaaatcctgtgcaggggatagcaaactcaagaagcaatcagacttggggatcattgacaaggtattaagaaccttgacaccaagattcgatcatatagtggtggcaattgagcaaggccagaatcttgaagaaatgaagattgaagaactgcaaggaatacttgaagctcaagagatgaggctcaatgaaagaaattcacaatga

SEQ ID NO: 22333 - DNA, 159 bp, Glycine max
  Peptide Sequence Number=SeqID_114018
gttgaagattatcaacctatgattccttactactctcagaacatagaaccacgacctcacacaagaactcagaataccgaggaagacgggaaactcactcgtggaactcacacgagaaagaatagtcccaagggactgagtgttattaattttttatga

SEQ ID NO: 22334 - DNA, 686 bp, Glycine max
  Peptide Sequence Number=SeqID_114019
atggccaagttcgatccaaacatagtcctcgaattttatgccaatgcttggcctacagaggagggcgtgcgtgatatgagatgctatcggccagctcctggatatcctttagtgctggaagagggtcaagagtgtgagtatggccagaggaggaaccggtccgatgggttcgatgaggaggccatcgcccatttgctatgtataccggggcaggattttgcccggactgctgccgggagacgggtgcggatcatgcgcaccaacatgaccaccctaactcagatctggatgactttgctgctcagcagcatccagcccagcgaccataattccgacctccccctaccgaagtgtcagctggtgtacgccatcctgacgcggatgagcattcacgtggctcagttaatcgttgatgccatctatatatttgcaggtatggcacctaccaagcaccctctggacccggataagtccaacagggccctgggatttcccgccttgatcacaggactctgccagtcgttcggcgtccccgtcgcacctagcaaggtgattcggccgcccatcacccgagcttttattaagaagtactgcacgcagagacaggttcagggtgatgcaccacaggccgcggatgcgccgccacctcatcaggctggtccagccggatcgtttgatacggagca

SEQ ID NO: 22335 - DNA, 636 bp, Glycine max
  Peptide Sequence Number=SeqID_114020
atggccccgaggaaacttgcctcaaagagatccaggaaggataaaacggccgaaggaactagttccgctcccgagtatgatagtcaccgctttaggagcgctgaacaccagcagcgcttcgaggccatcaagggatggtcatttcttcaggagcgacgcgtccaactcagggacgacgagtacaccgatttccaggaggagatagttcgccggcggtgggcatcgctggtcacccccatggccaagttcgatccatacatagtcctcgaattttatgccaatgcttggccaacagaggagggcgtgcgtgatatgaggtcctgggtaaagggtcagtggatcccgtttgatgcagatgctattggtcagctcctaggatatcctttagtgctggaggagggccaggagtgcgagtatggccagaggaggaaccggtccgatgggttcgatgaggaggccatcgcccagttgctatgtataccggggcaagattttgcccggactgctgccgggagacgggtgcggatcatgtgcaccaacatgaccaccctgactcagatctggatgactttgctgctcagtagcatccagcccagtgatcataattccgacctccccctgccgaagtatcagctg

SEQ ID NO: 22336 - DNA, 422 bp, Glycine max
  Peptide Sequence Number=SeqID_114021
atggcctctggtaatcgattaccaagggtgggcttgaaaacgaggtcaggaagctatgagggcttctggcagcaggttgtggaggcctctggtaatcgattaccagtctgtgtaatcgattacacagaggaatgggtcactgagggagcttgggagacccttgaaggcaacacgaggtgccgatttcggggcacgattcgatttacggccacttcattggtgcatccagatgaacctgcgcgtacgcttcagcacactatggaatggatactacccacgcctacaccatatcgtctagtggagccaatccaagtgatcgagtacgtctccgagaagaccttgagagatcttgaggagccacctcctgagcctgctgtggatgctcttgactttctagagggtgatgaagaccccttcctgag

SEQ ID NO: 22337 - DNA, 531 bp, Glycine max
  Peptide Sequence Number=SeqID_114022
atggctccacagcgaagaagactgatatttgattggaaaaactattttctcccttatggagtgtatgatttcgatcaaacctacgctatacaagacatttcaccattaaaaaaactggatatcccacttgcggaattagtagtagatactcagcgttattttgactaccaccactcttccgaagatacttttgataaagcccagggagattcaatacaattcagtaaaatttcgacggaaattctaaataatggaaaaggatatgaagaactcagagatctaacacaaaatataggaaatcgtttaagtggttcggaagcctacgaaaagtcggtacaatgggcagcgaaagaacttcgcaatgctggggcagataaagtatggctgcaggaagttatgattccagtctggaaaaggggaaaagagtctttatatataaaagccggttcaggaaagccccaagcctcaaatgctttctttgggaactctgaaggaactgaaggaaaagatgtttccggagaaatcgttatg

SEQ ID NO: 22338 - DNA, 228 bp, Glycine max
  Peptide Sequence Number=SeqID_114023
atggggggaaaagagggaggtggttgccacccagctcacccaggcgagctgggttgcttccaccagagggcaccgccttttgttggaaccccctggaaggcccaagtgggcctgcgacacttattttctttccggaatgtcgcgaaactttacggattacgcaacaatgccctttttgacttctggaatgttgtggaactttacggattgcctaacgatgggtgttaa

SEQ ID NO: 22339 - DNA, 158 bp, Glycine max
  Peptide Sequence Number=SeqID_114024
acagtggcattgatgatggagaagcagctgaggaagaagaagaagcagctgaggaagaagaagaagcagctgaggaagaagaagaagcagctgaggaagaagaagatgcagcagaggatacagagtcagatgatgatgattctgatgccaccccatga

SEQ ID NO: 22340 - DNA, 366 bp, Glycine max
  Peptide Sequence Number=SeqID_114025
atgagcaatcttaccggcaagcgaatggtttgtccaaacaataaaactccaccaacggacacaatgcaaaatgcattcctttatgtgaatgattcacattcgtcaaccaattccaatgtttgcattctttttcaggctatctaccaatatgccgaatcgccacactttttagctgattcccatttgaaggatgggcactatttttcacagtgggttatgagccaccatagaccagcatggatttctcctaaattgcgcatctttttgctgccaaccagatcctaccagttgatagtgatgggagcgggcatttctgtgacgattttaacaattattactttgattatttgtcaatgcattaattaa

SEQ ID NO: 22341 - DNA, 636 bp, Glycine max
  Peptide Sequence Number=SeqID_114026
atgggtaaagcagaggaggtacaagagcagatgaaggccgacatgaaggccatgaaagagcagatggccacaatgatgaaggccatgatgagcatgaagaagataatggaagccaatgcggttgcagttgccgctactagcgctgttgctaaggtgaacccgatgcccccatctgacctcaaccaaatgaatcatccaacctcagatatggtagacaaagatttgggaagtatggacggccccctattatgtgcaaattcaaaacaagcacgcctttccgccatatgcttgcctcccaactatacgccacccaatgtggcgtacactcccaatgagaatgtcaataactccactcctatacccattgagagccgacaacctcatcgtgtacatgtctctcaacccatgggggagacacatgaaattcccaaccacaatctagccgacttcgagccttgcctcggatatgccactgaagggcaagtagttggtggtatacccctgcaaaacactttggaaggccctcagtatcacccacaaccacaccccttgcattccacagcgggtaaaaaccctcatgctatggcagaaatgggagaagttggatcatctagaggaaaggctcatggtcgttga

SEQ ID NO: 22342 - DNA, 220 bp, Glycine max
  Peptide Sequence Number=SeqID_114027
atgaagaacggtggaaaaccttcacgaaatcgcccacggaaacgtctcggaagcgttacggaagcgcctcggcttggattttcttcatggaaacaatttttctcactaatttcaagtgaatctcagataccaggagggttgaacgggaaaaaagggaggtggttgccgcccagctcgcctgggcaagctaggttgcttccaccagaaggcaccgccttct

SEQ ID NO: 22343 - DNA, 370 bp, Glycine max
  Peptide Sequence Number=SeqID_114028
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccaagccagttacctcggttcaagagttggtagctcagaagaaccttcgaaaaaccgccctgcaagcg

SEQ ID NO: 22344 - DNA, 486 bp, Glycine max
  Peptide Sequence Number=SeqID_114029
atgtcacctttatatatctgcaaagcggtaaggggtattcatattccaaatcttattagaactgctcggtttttatcagaagcttgtgatttagtttttgatgcagcaaaaacacgacttcaaaagttcagggacttgagaatgcaacaaaagacggggagactcaatagttttccaaaaagagatgccgctatattgaagagacatttagctcatttggaaacatatcttggcggcattaaatatatgacggggttacctgatattgtaataatcgtcgatcaacaagaagaatatacggctcttcgagaatgtataactttggaaattccaacaatttgtttaatcgatacaaattgtgacccggacctcgccgatatttcaattccagctaatgatgatgctatagcctcaattcgattaattcttaacaaattagtatttgcaatttgtgagggccgttctagctatatacgaaattcttga

SEQ ID NO: 22345 - DNA, 207 bp, Glycine max
  Peptide Sequence Number=SeqID_114030
atgccggtgagtacaaaagtaagcagcgagaacaaattcgttcaagcggacgatgctgatagtgttgctgctacagcagggcaaatagcaggagctttatatggttattctgagatccctcatgaatggcttgataagttagcacaacgaaaaaagttagagttgatggcagagaaattgtttctcatgggatgtgaaaatgcttga

SEQ ID NO: 22346 - DNA, 207 bp, Glycine max
  Peptide Sequence Number=SeqID_114031
atgtcctgcagtacccttcaagatgcttctagtagtggcattcagggaggaggatcaaatgagtgtgatgcaagcgcatcagacatggatgtaaatgggcagaccatacatcaggtaccgatgaagattacctctcgattgccttcttccttcgtatctggattgcggaatgaccttgctcaaggatcagcatcctacgggtactga

SEQ ID NO: 22347 - DNA, 228 bp, Glycine max
  Peptide Sequence Number=SeqID_114032
atgactactcaaaatgccctgaaatacaaggtgaaaatgaggtgggctaagtgtgcatccatcgctaagcacaacttcagtgcacttagcgcgacagaagaatctggcagggcatcatcatcaaggttgtgtgctaagcgcgagatcagtgcgctgagcacagcagttgtcttcagcctggctcagtgcacgactggcgctaagctcaaatccacttactcgcactaa

SEQ ID NO: 22348 - DNA, 522 bp, Glycine max
  Peptide Sequence Number=SeqID_114033
atgaagggaagaaggcataaatatgggtttaacaacaataaacgtgagaaggcagagaagatcatgggttctccacctgcctcccctcctcctcctcctcttccttctccttcggacgcatcggcttcgccgtctgccgtgaagcagacacgcaaagcctcacgtctacgatcgttgtccactagaccacctagtgctgagagactagaggtctatgttgatcttgctaccgggaagaccgacggtccctacaggaagaaattaagaacatatttggggattgtggcgcatgataaggtggacatcacctacgagaactggaaggaggtccctactgctcaaaaggatctgatttgggaggatattcaggaggaatttgatatcccagaggcttctgacaccgatcaggacggtgttgaggacactgtgtgtgagaaatacggcattagcaaggaaaagtgggcccagttttgccagactcgcagagacccttcttgggaggatgtgcgcaagaaggcatag

SEQ ID NO: 22349 - DNA, 651 bp, Glycine max
  Peptide Sequence Number=SeqID_114034
atggctaagtttgaccctaagatagtcctggagttttatgctaatgcttggcccacagaagagggagtgcgagacatgtggtcatgggtgaggggtcagtggattccctttgacatagatgccctcagccagttcctgggtgacccgctagtattggaggaaggccaggattgcgagttcagtcagaggaggaatagggccgatgggttcgatgaggaggccattgcccagctgttatgcacaccagggcaggatttcgcccggaccactgcagggaggcgggccttcattgagaagtattgcacacctaggcaggcgcagggtgatacacctcaggctgcatacgcaccgctaccacctcatcaggctgatcccgctaggtcactaggcatggagcgttatctacaacacttggtgcagatacatgagtgtctctaccagctcagcctcagccagcaggcacagggttttgctccttttacgtgccctactccagagcagtttagggctgaggttggatggcccggagattggcccgaggcccatacaggggaaacgcctgcaagatcccccgccgatgcagaggtggcccatatggatgaggagataacggacttgctcggtttcttgggagcaagcggagccacgtga

SEQ ID NO: 22350 - DNA, 267 bp, Glycine max
  Peptide Sequence Number=SeqID_114035
atgaagggtagggttaacctagggttagaaagtgagaataggtgttatgagtggaaaaagagtgaagctttgagagttggaaggccaaatctgaatttagtggtatttggaggacttatgagaaagtttgggctgtgcaagagagaaaaacaaatgaccaaagtgaaggcaagagccatttctagggattcaatttgggcaaaattggatgagggaaagtgtgatttcgaaaatctgcactttatgcagaattttgctgtcaaatag

SEQ ID NO: 22351 - DNA, 134 bp, Glycine max
  Peptide Sequence Number=SeqID_114036
atgaagtcaagtgatatgcaaggttaccatatggttacccgcacctttggtcaaccaggggcaaacgagcccgttggcgcacggagactagcgtcatcttctacaccatttggcgtcctgacccgtgaagtcag

SEQ ID NO: 22352 - DNA, 363 bp, Glycine max
  Peptide Sequence Number=SeqID_114037
atgcgtagtgattgcttagtgcaacttctccattctcaatattttcggagccccaagaattgcgttttcattcatgtgtcctccaccttcgagtttggagctatgcgtagtgattgcttagtgcaattctccattctcaaatcttttcagagccccatgaattgcgttttcgttcatgtgtcctccaccttcgtgtttggagctatgcgtagcgattgcttagagccattctccattctcaccctttttcggagccccatgaattgcattttcgttcatgtgtcctccaccttcgagtttggagccatgcgtagcgattgcttagtgcacctctccattctcaatattttcggagccccatga

SEQ ID NO: 22353 - DNA, 411 bp, Glycine max
  Peptide Sequence Number=SeqID_114038
ggttgtcatcatcaaaaaaggggagattgtagaagcaagcttcatgatgatgaatcaagtagttttgatgatgacaaaaagcccaaaagaatgatttcaagattgagtcaacaaattcaaaggactaaccgcctgagaatcctttgtcttaacacattggagggtacatcctttgtggtacaagtagagggtacatctacttgggttgttgtaactgagaacaagagagggtacatctcttgtggatcagttcaagtggagggtacatctactaggttgttcaaagagaaaaagggagggtacatcccttgtggatctttgcttgtaaagtattttacaaggttgaaagaaatctcaagaactggtggtttcttggggactggatgtaggcacgggttgttgccgaactag

SEQ ID NO: 22354 - DNA, 174 bp, Glycine max
  Peptide Sequence Number=SeqID_114039
atgccatggaaggagaagcttcaccaccaagagagtgccttggataagaaacttagagaggaacacatgggaaacttccttgagaagttagagggtagcttccttgggaagctagaggaagaaagcttccttgagaagctagaggggggctactcacacccctccaatagctaa

SEQ ID NO: 22355 - DNA, 582 bp, Glycine max
  Peptide Sequence Number=SeqID_114040
atgattgatgctgccagtggtggagcccttggagacatgacccctgctgaagccaggaatttaattgagaagatgacctccaactcccaacaatttagtgccagaaatgatgctattgtcattagaggagtgcatgaagtagccacgaattcatcttcatcagttgaaactaagaagcttgaaggtaaactagatgccttggttaacttggtaaaccagctggcacttgaatcagaaatttgtacctatcgcaagagtctgtgcaatctggagcaattgagcagcctgaagcttatgctgcaaacatttacaatagacctcctcatcctcagcagcaaaatcaaccatagcagaacaattatgacctctctagcaacaaatgcaatctcggatggaggaatcaccctaatctcatatggtctagccctcaacaacagcaacaacaacctgctccttccttccaaaatgttgctggtccaagcaggccatacattcctcctccaatgcaacaacaacaatagcaacaacagcaacaacaacagagacaacaatcaactgaggccccttctcaaccttccttag

SEQ ID NO: 22356 - DNA, 540 bp, Glycine max
  Peptide Sequence Number=SeqID_114041
atggtcctagatgaagggaagaatttctccaagaacaccctcttaaggtcatcccagctgaaaatagacctgggagcgaggtggcaggcagagatacccgagtggttatctgtacaaagacaacttatgttaatcctgacccatgaagtcaggtggcaggcggaaataccccaacttgttatccatacaaacacacttctgttaatcctgacccatgaagtcaggtggcaggcggaaataccccaagtggttatccgcacacacacagttctgctacctcgacctgtgagaagtcaggtagcatgcagagatgccctatacggtaatccgcacacatttcaaagaaaaaaatgtcttcagtcattgcatgccttcaaaggtgacaatgtcctcacacattttgaagacaaaaatgtctttagtcattgcatgccttcaaaaggcgacaatgaccctcatttacattttgaagacaaaaatgtcttcagtcattgcatgccttcaaaggcaataatgtcctcatctacatttcgaagatga

SEQ ID NO: 22357 - DNA, 169 bp, Glycine max
  Peptide Sequence Number=SeqID_114042
ttgcatcctatccgaagacattatactgacactgcctaacgaaggcacccaccacgtgtccttccaagaagtactcggtgaaggtcttgaagtctactcaggagcactccaggctttcgttgagaaacagaccaatgcttgcacccacattccggtgaaagttgaataa

SEQ ID NO: 22358 - DNA, 149 bp, Glycine max
  Peptide Sequence Number=SeqID_114043
ctgaggaagatggtgaagcagctgaagtagaagaagaagctgccgaagaagaggaagaagcagccgaggaagaagaagaagctgctgaggaagaggaagatgcagcagaagagacagaatctgatgatgattctgaagccaccccatga

SEQ ID NO: 22359 - DNA, 153 bp, Glycine max
  Peptide Sequence Number=SeqID_114044
atgaagaagattcatggcctaaaagttccacatggagctacatcctgtgggaattggaaaggaggattggtgccatcccttgaagaatttgagtcaagaagcgaggggccaaccaccttaagagctattggactaataagcactccaagttga

SEQ ID NO: 22360 - DNA, 298 bp, Glycine max
  Peptide Sequence Number=SeqID_114045
gttagctcgcctgggcaagctgagctcgcctgggcgagcaacccctgtacgaaaatatgaaaggggtggagggggaacgttttcttcacccaaaacccttccccctcacttcaaaaactcccaagctcacgggaattacaagaacagcagcccccaagcttccgttgttgagttttgcttatcttttcacgctttaattcactccccacaagggatccgaaatgggtgcccaagtgcaattccaagcttagagatcccagctcttagcttcaatgcaaggcaacatacttatgactaa

SEQ ID NO: 22361 - DNA, 108 bp, Glycine max
  Peptide Sequence Number=SeqID_114046
atgttccttcatgggaagatgcccaggaaatgggttttcagaccttaccttacttcaacttcccaaacaccactaatatggctccataatgtaggtagggtaccctag

SEQ ID NO: 22362 - DNA, 135 bp, Glycine max
  Peptide Sequence Number=SeqID_114047
atgactgaagcacgtcaaaaggggggtacggaaagggaggagcttgccacccagctcgcccaggcgagcaaggttgcttcctccagaagcaaccgccttctggaggaagaaactggaaggcctaagtgggcctga

SEQ ID NO: 22363 - DNA, 201 bp, Glycine max
  Peptide Sequence Number=SeqID_114048
atgggtggttgtgtcatactattgcagtcatgggcttggtaccacatgccttttattgcaccaagagtcccacgaccggaaacaacttttccactggctaaaagatggagtggtggtagattagaatatagggccacaccgcatggtgacttagtcggatataggtctcgtatagatcatatggagagccatgaggtatga

SEQ ID NO: 22364 - DNA, 1287 bp, Glycine max
  Peptide Sequence Number=SeqID_114049
gggccgaccatcgccagcgccacccttcaggtgacctcagtgccgctgcggcagccgacggcgcaggtgcggcacctgctgacggcgctgccggccaaagccttcgaactgccggccgaacagctgacggcggcggcggggcaggtatttgtgaccaggagcccagggcgatcgctgagctatgcgcagctggcgagcgggcaaaatctgcacgtgatgctggataaaaacgtgcagttgaacagcgaacggcagaaccactacgtgggccgcgccgtgccccgggtcgatattccggccaaggtcagcggtgggctgacctacgtccacgacttgcgcttgcctggcatgctgcatggccgcgtggtgcgcccgccatacgtaggcgccgacagcagcgcgccgttgggcggcggcctgctgtcggtggatgaaagctcgatcgcgcacctgccgggcatcgtgaaactggtggtgatcaacgatttcatcggcatcgtggccgagcgcgaggagcaggcgatcgccgccatgcgccaactgaaaaccgaatggaaaccctgggccgggttgccggatctgtcgccggaagcgctgcccgccgcgctggaggccaatccgaaaaccgaccgcgtgctgcgcgacgacgcgggcactgacgccgcgctggcggcgctgcataccgcagtgcaggccgactatgtctggccttaccatcagcacgcctcgatcggcccttcctgcgcggtggcggaagtcaaagacgggcgggcgcaggtgtggtccggcacgcaaaacccgcacgatctgcgcaaagacatcgccaggctgctcgagctgccgcctgggcaggtgcacatcacccgcatggaggcctccggctgctatggccgcaactgcgccgacgacgtctcggcggacgcggcgctgctggcgcgggctaccggccgaccggtgcgcgtgcagctgatgcgcgaacaggaatccggctgggagccgaagggcaccggccagctgattcgggtgcgcggtggcctcgacgcgcaaaaccgggtggcggcctacgaattgaaaaccagctacccctccaacaatgccgtgaccttgccgctggtgctgaccggcaaagtggcccaccgggccgacgtgcagcagatgcccccatcgcaccgccattccgcaatacgagtatccgcacatgcgggtgatctgccaggacgccgcgccgatcgtgcgggcttcgtggatgcgcggcgtttcggcgctgcccaacgtgttcgcccatga

SEQ ID NO: 22365 - DNA, 363 bp, Glycine max
  Peptide Sequence Number=SeqID_114050
atgaccaaacttggtctctgcttgtcatcgggcccgccgcctctggatgacaaaagggtgcgaataaccgtaaggtatctccgcgtatcatcgggcccgccgcctctggatgatacaagggtgcgaataaccgtaagaatgaccaaacttggtctctgcttgtcatcgggcccgccgcctctggatgacaaaagggtgcgaataaccgtaagaatgaccaaacttggtctctgcttgtcatcgggcccgccgcctctggatgacaaaagggtgcgaataaccataaggtatctccgcgtatcatggatgcagaatgaccaaacttggtctctgcttgtcatcgggcccgccgcctctggatga

SEQ ID NO: 22366 - DNA, 169 bp, Glycine max
  Peptide Sequence Number=SeqID_114051
atggctttcactcttatccaaggaaggaccaagcccaaggaattttgggggatgcaccttcaaaaccccaggaagataagggagattacttattgcctttcctctagtgaaagtgaagatgaagtaaggggtgaagagtctagcgaggaagtctacccccatgaagaag

SEQ ID NO: 22367 - DNA, 630 bp, Glycine max
  Peptide Sequence Number=SeqID_114052
atgaactggaaggatgaggctcggcagtttttttcccaccgcgccaaggtcgtgggtgagcggccggccctgcacgatctttgctacgtgagcgggcgggatccccgcgtgtgggccgatcagtcgcgctacgacgacatgatggacagtattgtgcgcactatcggcgccaacgcgtcctcgcgggtgctggaggtcggttgtgccgcgggtttcatcgcctgcggcgtcgcgcccaagatcggccaatatgttggtgtcgatgtagcggaaggtgcaatcgaatgcgctagcagcttgaatctgcccaacgcgaccttccgggtgggcgatggcggtgcattgcctttcgatagtggggcgttcgacagtgtgtactgttatgacgtcctgaccaactttccgacgttcgacagcgtgaaaggcgtggtccaagatatggtcagagtggtgcgccccggcggcaaggttctgttgggctccattcccgatgccagcaatgtcgatgcgtttctggacgccgttgcacgatttcaagctgagcttgcccaacaagctccggcgaccgagccagctgtgacgcctgtttcctccgctgcgaagcctgccgctccgacattatggacgaag

SEQ ID NO: 22368 - DNA, 58 bp, Glycine max
  Peptide Sequence Number=SeqID_114053
atgaaaaaggctccattgtcgaattcagacctaaccatgggtaatcgagaagtgatgg

SEQ ID NO: 22369 - DNA, 420 bp, Glycine max
  Peptide Sequence Number=SeqID_114054
atgccgatctccccctgtggaagtatcagttggtctgtgtcgttccgacatagggatcacatccacaagacacccagtggacctgaagaagtccgacagggccctggggtttccagctctggttacgggcctctgtcggccctacagggcgcccgtttccccccagcaagttcatgtcgtcgtggcataggtaaggattgtgcccgcaagacacctagtggacccgaagaaggccaacagggtcttggagttgccagctctaaatacaggtctctgtcagttctagggagtgcctgtcgcccccaacaaggtcatcaggcccccctaccaatcgagctttcatcaagaaatactgcgcccccaggcaggcgcagggcgaaacaccacgtcagcattgggatggccggtagcgggcaatag

SEQ ID NO: 22370 - DNA, 705 bp, Glycine max
  Peptide Sequence Number=SeqID_114055
atgtcactgacccattggcaacaccgttacgaaagctggctgcagctgaactggctgcacgatgataaagcccatgatatcgcgcacctgcgccgcgtctggatgagcgcggcccgcattatgcaaaacaccaatgccgatccgctggtggtgctgaccgcctgctattttcacgatgtggtgaacctgccgaaaaaccatccggaacgccatctggcttcgacttacgcggcggaagagacgcgccgcattctgcaacaggattttccggacttcccctcagcgctgctggacagcgtggcgcatgcggtgcaggcccacagtttcagcgcccgcattacgccaaaaacgttagaagcgaagatcgttcaggacgccgatcgtctcgaatcattaggcgcgattggccttgcgcgcgttttctataccgcaggtgcgctgggacggccgttgttcgacagcgacgatccgctgggtaaagaccgtgaactggatgacgtaaagtggacgctggatcatttccagaagaaactgctgagcctgccgcagaccatgcagacggaaaccggccgtctgctggcggaacacaacgccgattttctcgtccgctatatggcgaagctgtgcgccgaactgcagggcaatctgaccgatattgatgagtccgtgttacgcgatttcagtcccataccggcacaatattaa

SEQ ID NO: 22371 - DNA, 177 bp, Glycine max
  Peptide Sequence Number=SeqID_114056
atggactcgggaaggttccaagttagcgtactaggtaacagctaccccatccccttgtacttgtcaaagtctggcaccttgaacttgggaggggtgacgatattgggtactaggaacaactcctttagcaaaggcataatcttcacctccttcaatggccctgagcctttcctctag

SEQ ID NO: 22372 - DNA, 498 bp, Glycine max
  Peptide Sequence Number=SeqID_114057
atggagacgtgtttggaagtagaggaattgttacagcggatgatagaccaaggtcgactagaagtcggcattaaaggaaaagaagagcagcatatatgcatgcaatctacggaggggagcggtgttgcgaagcccaaacccttggtgatatacttcactaaaagtgcagcctcgcaaaagcccgggcaccccttaatggccaaacctgttcctttcccgtaccaaaatagtcacgcggtcccgtggagatatacatctccggggaagaaggaagaagaagtcactgacgtcagcacgctgtcagctaaagtaacaaatatcacggggctgagcggtgtgacccgtagtggtcgtgtgttcgcacctccggacctaccagtccaacccgccgacgtcaaaggaaaaggaaaagtggtggaggaacaagatggcgaagcaccccacgcttcgagtaaagatatgccagcaaaggggccccccagagaaaagggatggtag

SEQ ID NO: 22373 - DNA, 438 bp, Glycine max
  Peptide Sequence Number=SeqID_114058
atggatgggattctcatttctagtgtggtgttgttggctgattcacgattcactcgaccggatatgggttttcacccaacaaaactcaatttcgtgcctagcgatgcggatgaggcgccactcgatgtttccatttgcctgcatgcctttggtattgtggggtgtggttcgtttagtggtgtcaagtcttgcgaacgtgaggtgccgacgattggttcctgtgttgcctacctaccaaacggtattcgtgtggctagtcagacccattccatccagggcctctttgttggggacgctggaggatttcaaagtcccacacgtgaaccactgaacgtgggtggtctagtgcccccacattgttccttaaaatcggttgtctcggatgacgcttgccctggcgcttgctttgttcaacgcgatgctactactcttagttag

SEQ ID NO: 22374 - DNA, 249 bp, Glycine max
  Peptide Sequence Number=SeqID_114059
atggagcagtatttatggcatttggttcgccagcaggcggccaaccaccgagcacatagccagggcttcgcttctttttcatgccctactccagaccagttcagggcagaggttgcatggcccggagattggcccgaggcccaagcgggagaggcgcccccagaagctcccggcgatggagaagaggcccacgaggatgaggagatggccgatttgcttgacttcttgggagggagtggagatacatga

SEQ ID NO: 22375 - DNA, 540 bp, Glycine max
  Peptide Sequence Number=SeqID_114060
atggtcgctacagacgtccgaaaagagtgtgccgggttacgagaagaaaatgcagttaccacaaaagcccttgaacaagaaaccaagagggctcgcaagaaagagcatggccgtgacaaattccgtggagcattgtggggcagcaacagtgagctcaagcttcgaagggaagagagagaccgatcacgagcacatagcatggtcttaaaagaagagttagccgcttgctcaagggtggtggacgagtatgcccaagtgtacgcggaaaaggaggctagaggaagggtgattgactcattacaccaagaggcaaccatgtggatggaccgattttctcttaccttgaacgggagtcaagaacttccccgattgctagctaaggccaaagcgatggcggatacctactccgccctcgaggagatccacggacttctcgactattgtcagcatatgatagatttaatggcccatataattagaaccgctaggggaacttgtattgtcactcagatcttgactagttataaactttttgaataa

SEQ ID NO: 22376 - DNA, 558 bp, Glycine max
  Peptide Sequence Number=SeqID_114061
atgaaaaaaggggttgaggggatccgtatatgttgttcaggtcgatcagaaggcgcagaaatagctagaactgaatgcggaaagtatggaaaaacatctcgtaatgtatttaaccagaaaatcgattatgcttctgcggaagtatctactcgttacggaatctcaggcagatgtagtaggggttgcaaaccagacggaacaaaacttggttttggaagatatggcactcaaagttgtagagctgggcgtctttcatatcgagccattgaagcagcgcgtcgggctataatcggacacttccatcgtgctatgagcggacaattccgaaaaaatggtaagatatgggtaagagttttcgcagatatccctattaccgggaaacctacagaagtcagaatgggaagaggaaaaggaaatcctacgggttggattgctcgtgtgtccacgggacaagtcctatttgaaatggatggtgtgagtttgtcaaatgctcgacaagccgctacattagcggcgcataaaccatgttcgtcaaccaagtttgttcagtggtcgtaa

SEQ ID NO: 22377 - DNA, 2191 bp, Glycine max
  Peptide Sequence Number=SeqID_114062
atgctgcaagtggctgagtttcatgctaatgctgtagtttctgtgaaacctaaaaagccttcctttaaagaaaggaaacagaagttgcttacctttctacaagagaagtatgaaccagtttgtgctaagtggactacagaacgatgtgctgaattagaattcataggtctaaagatattggagctgataaaagtggcgagatgtcaaatagccgttcatcaagaatgttatggagcaagaaatgttcaagattttacgtcatgggtttgtaaagcttgtgaaacacctgacatcaagcaggaatgttgtctttgtcctgtaaaaggtggtgctctaaagccaaccgatgttgacacattatgggttcatgttacttgtgcttggtttcgacctgaagtatcttttgctagtgatgaaaagatggagcctgcattgggtattctgagtattccattgaattcttttgtgaagattgagccagttatcaagtcccatcgacttcagcgattcgtcacaaatccacaaattcttctatgctttctttctgaagatgattgtgaagctggaattgagaatccagcgtttgaagtttgggagcaacaagaccaagtgctcctcacatggcttcaatcgaaactctctacgtcgattttatctcgcaagtcgatgcgagagttcttatcgcagattcaagcgacctctaattcgtttgcgttagccggaaatgatcgtgatgctggaattgagaatccagcgtttgaagtttgggagcaacaagaccaagtgctcctcacatggcttcaatcgaaactctctacgtcgattttatctcgtgtgctgggatgcgcacactcctacgagattcaagcgacctctaattcgcttgcgttagttggaagtctgattatgcttcaagagcatgtcgattccattcttgaaggccttttgtccgattatcatccaattattgtgattatcgaaagcaattttgaacctcagcctattgagcaagttggagtgcttctcttggctcacgaagctcgtttgaacaagatcctgaaagcttctctaactttcgtggtggatctagtcacggcggcggtttcaatggtggtttcaactacggcggtggtcggcgctagcggtggtggtggctgtggtcatggtggtggtcgtggtggtggtcgcttctccaactttcaatgtcaaaactatggtcctcagaatcagtacaatgctacctctggtcagagtaaccctaactctaattctaggcagcaatatggtgattatcacccttcaaatgaaattctcagaacattcagcagtttgaaccctttgaaggacctgaccaaatcttcattgggtaatggtcaaggtttgcccatctcttcctctggtcttgctaaaggcaatgttggtcctgatgatctatacaacttctccaacatccagcttcagcatcccttgtctacttctgttcttgcttgtgtttctaatcctgaaaagtgttgtgacttcatgccttatgataatcacaagtttgagtcctctgctccttctggtcagtccacttcttcctccactcaatattactttccccctattcctatcagtcaaccctcaaatctcccacaacctacccaaactcaatttccttctgttgctggttttcctactcattacctcacggttcaatctgattctgcttctgttcagtcttctcatgctgcacggacagaacagtctaatgctgttgcttccattccagcatcaaatacagctcaacccttccatgctgaacccacagagcagcctcacctttcagcaaccagctcagaagccacaccctcaaccattaatcccacctctccaaatggagacagtgggctcaaggaggttgtcatgtgggaaggaaattccaagggggctggggagggggttaaaatgggcttaaatcagaacgctggtgaggaaagaacagtcagatgggaaatgcagccagcaattaatagtgctgggggattactgtgtatttggagtgatgaaactttcaaaatggagaagaaggtgaagggcaatggttttatatatttggaaggaacatgggctggtgatgttggaaaaggtgggggtagccagaaggaatttaatgattggatcactgacttgaaggttgaggatgtgccta

SEQ ID NO: 22378 - DNA, 938 bp, Glycine max
  Peptide Sequence Number=SeqID_114063
atggatgacgacattcctggggccaccttttgcgacgacttctccgatggagtctccgacgatgtcctcggcggctactctgaacatcgggacgtgcttccttcgcccaacgttcgcagtgaccactgggtacaatcccttggtcgtaactgcagggaccggtccgccacattcagcgatgacgtggcccaatcccagaaggacaacgtagaaagtcagcagtgtattggtgtggaggttgcacaggaaaacttcaacggtcaagttccccaaaatggcttagctttaaatgcttgtgatgaaagaccattgcagggtagcaagctaatggaaaaggcccccattacggacagccatgcagacgagggtaactctgcctcacaacaacaatttgaatatcacgaaccacaacaagctccctctggtcaacatgatttaaaggtggcatctgagaaaatgggccaacggataagtggcccaactctttctgccacaaaggtttatgtgagaagaaaggaggtgttgagaagtaatagcaaggcccaacaggttgaggaaccaactggggacttcacctcagcttctaaaactgactctatgccttcattacaagaggactctatagagctgcaatgtgcccttttaaaggaaatgggcttgacttatggggaagatgccaacaaggacttgactgctcagtgggattgtgttccttctgtgcaggctgctggtggccagctttgtatgtggaataactccacttttgaggtggataggagggagaaaggtagaagtttcttattgcttgaagggagatgcatcagtaataatcagaggatgatgattgtcaatgtctatgctccctgtgatcttgttgggaagaaagctttatgggaagatctgaggcagctgaaggcctctaatcctagtggcttgtg

SEQ ID NO: 22379 - DNA, 336 bp, Glycine max
  Peptide Sequence Number=SeqID_114064
atgattcgttgtagagctacgctgcctactgccgatgtacctgaaagcttcaaccgggacaacgagaacaaactggggtccggaacccaagtcttagtcttattaaaaccagtcactctccgccaccgcgtacatcctgcttccgatacagcttacagctcaaatagggttttgttaggactactaaacgtgcaggttgcccttcgggccctacaggtgtggttttctaaagttgccatccggggaagcacgtcgacgatccgaagggagcggtctgaacctacaaccaatataggagttgagcgcagcagtgactcaattggccaagtttcgtaa

SEQ ID NO: 22380 - DNA, 321 bp, Glycine max
  Peptide Sequence Number=SeqID_114065
atgaccgactctctcgatgagtcgatctcttgctttctcataaggatggaccctcgggtactagtaccctggtcttcagaggactacactcctcgccaacagagggctgcacgccctcaccttaagaggactgtgtgtcctcactttcagaggactgcatgtcctcaccttcagagggctacacgccctcgccatcagaggactgcgtgtcctcaccttcagaggggttacacgccctcgccatcagaggactgcatgtcctcaccttcagagggttacacgccctcgccatcagaggactgcatgtcctcaccttcgtag

SEQ ID NO: 22381 - DNA, 321 bp, Glycine max
  Peptide Sequence Number=SeqID_114066
gcgtggaatgagacaaacgccgccataacagcggaatgcgccccccaacccgaaacgcaggaacaggagagcgcacgagggagcccccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctcccgccccgttcgtaagccatttccgctcgccgcagtcgaacgaccgagcgtagcgagtcagtga

SEQ ID NO: 22382 - DNA, 157 bp, Glycine max
  Peptide Sequence Number=SeqID_114067
atgacgttttgctatgtcacccaggctgttctggaactcctgggttctcacctcagcctctcagagtgctggaaggatgggaagggagagttcacagcaatgcttgttgaattaatgatcaagcttatcgataccgtcgacctcgagggggggcccg

SEQ ID NO: 22383 - DNA, 429 bp, Glycine max
  Peptide Sequence Number=SeqID_114068
atggataacaaagagggagtgcaagaacagatgaaggccgacatgtcggccttaaaagatcagatggcttctatcacggaagccatgctaaaaattcaaaaatcaatagaagacaatgctacggcagtcgcttccaatacagctagggaagcggaactggtgctacagcccgcaatgaacttgggccgggacagaagcgcgacgggtttcaatcggaggtatagtcctcaagcctacccttatggcttgcctacagacttcacctcccataccgctccagacgatttgagccaagcccctaccttcgaggggcaactccctcctcatgccgactatcctctgcaggaagatgatgaaggagatgcccatttaggccctctactgcccccaaaagaaccgccccccatgagtttccccaagcaaacataa

SEQ ID NO: 22384 - DNA, 1209 bp, Glycine max
  Peptide Sequence Number=SeqID_114069
gttctaccaagtcaaggtcaaaagcctagataccaccagcatcaaggaattaggacggttgatggaacccctccaaatgcaagccttccgcaagacttacggaaagatcttagagttgaccatagcagaggtgtccatagaagccattgcatcacttacccaatactacgaccagcctttgagatgcttcacattcggagacttccaattagtaccaaccattgaagaatttgaggaaattctaggatgtcctctcgggggaagaaaaccatatctttcatccgggtgtctcccctctttgagcagaattgcaatagtggtcaaggattcagcaagaggtttggaccgcataaaacagactcggaacggcatagcgggcctaccacgggagtacctagaagacaaggcaagggacctagcagcaatcgacgctttccttgcctaccaccatagcatggaaagtccggtgagaagaatagattgggaccagcttttggccgggataggaggtagaacaatcagttggttcccccgatggaaggaaggaaaagaaggagtccttttctcatgtggagggtacccaaacattccgctggtaggaacgaggggttgtattaactacaatcccacgctcgctataagacaactagggtaccccatgaggggagcaccgacggaagaaagcatgtctcctttccttgtgagggatctcggcgcacaaaattccaagactatacaaagaatccataaggcatgggaaaccccgttaaggaaagatcaagagcttagaggcattcgtaatggcatcattggtgggtaccacgaatggctgaaagttcgcatacgaggtttagattggctcgccaagttaaaagtcgtcagcgaagagaattttgaaacaccggaagaggacgaggaagtccaagctctcaaaagtgagttaggaaaggcaaaactcgccaaggagaagttcaagttggctgctacacacgttcggaaggagtgtgccgggttacgggaagagaatgcaattaccgcaagagcccttgaacgagagaccaagagggctcgcaaggaagagtatggccggaacaaatttcgcggagctctatggggtagcaatggtgaactcaagttgcgaagggaagaaagggaccagtcgcgagcacatagcatggttctgaaagaggagttgattgcttgttcaag

SEQ ID NO: 22385 - DNA, 1566 bp, Glycine max
  Peptide Sequence Number=SeqID_114070
cgtatcgcgaacggtctcgtagggttcaaggctcatcagcccggcgacgggcaaagcgatttcgcctgtcaccctgccgtcttccaccacgacaaaaccgcccttgatttcgcccagccggttagcggccagcgccatgtcgtcttcgctcaccccgacaacgcagatattatggctgtcatggccgacggtggaggcgatggcgccctttttcaggccgaaaccttgaacgaaaccattggcatggttgccgttcttgccgtggcgttcgatgacggcgaccttgatgatatcgttttcgagatcgacggtggtctggttgccgtccgtcggcagtctgtagcgacggtgctcggtaatgatcttgccgggaagcacgcccatgacagggctttcgccttccgtgaccggcacgccaaaatgcgaggcgagcacgggtctcgccttgacgctgtcgagaccgaccggtgcgaccggtttgcgcgtggcaaagagcgcatcgtcgacgatccggccgccggaaagaaccatgctggctttgcagctttccaggctgtcgatcaccacgagatcggcgcgccagcccggcgcgaccaggccgcgatcgcgcaggccaaaggctttggcggcggaaatagaggcggcgcgatagatggcgagcggttccacgccgctggcgatcgcggtgcggatcatgtagtcgagatggccctgttcggcgatgtcgagggggttgcggtcatcggtgcagagcgccagatagggcgacagccgctcggttatgatgggcatcagggcatgcaggtctttcgagaccgagccttcgcgcaccagaatgtgcatgcccttgcggattttctccagcgcttccgttgcactcgtgcattcatgctcggtgcggatgccggcagcgagataaccgttcagcgctgttccggaaagaagcggtgcgtgcccgtcgatatgctgaccctgaaaagcctccagcttcgccatgcacaccgggtccttgtggatgacaccggggaaattcatgaattcagcaaggccgatgaccttcgggtggttccggaacggcagcagcttttcaatcggcaggtcggcgccagcggtttccaggtgagtggcgggcacgcaggaggaaagctgcacgcggatgtccatgatggtttccatggcgctgtcgaggaagaactgaagcccctccaccccgagcacattggcaatttcatgaggatcgcaaatggcggtggtgacgccatacggcaaaacgcagcgatcgaactcatgcggtgtcaccagcgacgattcgatatggagatgcgtatcgatgaaaccggggacgacgattttgccggaaatatcgatttcccggtaaccctcatagctttcaccggttcccacgatcgtatcgccacaaatggcgatatccgaggcaacgagttctccggtgacgagatcgaagaagcggccgttcttgagaaccatgtctgccggttcacggcccgtaccctggtcgatgcgcttttcaagtctggaattcatgcggctttcttcggctcctga

SEQ ID NO: 22386 - DNA, 374 bp, Glycine max
  Peptide Sequence Number=SeqID_114071
atggaaaaatccgacaagaaaactttcaaagataagaaaggaaagaaagcatatatcacttgggaagataatgacatagattcatcaagtgattcagaaaatgaaatcataaatctaagcctcatggccaaagactatgaaagcaaagaagaggactccttgaagcaaaattggtacattgatagtggttgctcaaaacacatgacgggagatgcatcaaaatttactcatatttctcacaagaatagtggacatgtgacatatggagacaacaacaaaggacataggactaataatgtgtacatgatatatctagataaagccccaaatcaagctcaatgctttctaagtaaagaggatgaatcatggttgtg

SEQ ID NO: 22387 - DNA, 213 bp, Glycine max
  Peptide Sequence Number=SeqID_114072
atggctaaagaacatcaacacaggattacccttgaggattattctagtagttcagtaccgcaattctttacaagagaagccaagaagtggcttcattcattcaaaggtaacactttgaagacgtgggaggaagttgttgagaaatttctgaagaaatacttccctgagtcaaagactacagaagggaaagtcgttatttcgtcatttcactag

SEQ ID NO: 22388 - DNA, 450 bp, Glycine max
  Peptide Sequence Number=SeqID_114073
atgccatgccaacatgccattgcaacaataagtcacaaaggaggcaagcctgaggacatgtgtcatgactggctatccatagaggcttataataagacatatcaccattttattcaaccagatgacgacctactagctcaagataaacaagctttgaatgaggctgaagaagctgctgctcatgttcaagaaggtccggtggagattaatttatctcagcctaatttgtcacaagatagtgacatggagttcatggtccctgcatctattgttgatgttccaccagtagcaaggtataagctaaacataacaagacccaaacaaaagaacatttcacacacttcaacagtagacgcacctgttgtggatggcccaccaacaacacccttattttacatgccaacaccgaggttcactggaaggaaggctgctgataaagatccagtataa

SEQ ID NO: 22389 - DNA, 700 bp, Glycine max
  Peptide Sequence Number=SeqID_114074
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggaattcgatgtctttgggctagagcctgggcaattgcccagggtagccgggccttgaaaccgcccatgagtattgcattcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacaggaa

SEQ ID NO: 22390 - DNA, 255 bp, Glycine max
  Peptide Sequence Number=SeqID_114075
atgggtgaagcagagaaggtgcaagagaagatgaaggccgaaaatggaggccataaaagagcaaatggccacaatgatgaaggccatgatgagcatgaagaagataatggaagccaatgcgggcaagcagttggtggtataccctttgaaaacactttggaggccctcagtttcgcccacaaccacaaccattgcatttttgcggtgggaagagcccctcctgctatggccgaaaagggaaagcggatcatttaa

SEQ ID NO: 22391 - DNA, 678 bp, Glycine max
  Peptide Sequence Number=SeqID_114076
atgaccaccctgactcagatctggatgactttgctgctcagcaatatccagcccagcaaccataattccgacctccccctgccgaagtgtcagctggtgtacgccatcctgacgcggatgagcattcaggtggctcagttaatcgctgatgccatctatatatttgcaggtatggcgcctaccaggcaccctctggacccggataagtccaacagggccctgggatttcccgccttgatcacaggactctgccagtcgttcggagtccccgtcgtacctagcaaggtgattcggccgcccatcacccgagcttttattgagaagtattgcgtgcagagacaggcccagggggatgctccgcaggccgtagacacgccgccacctcatcaggctggtccagctgaatcatttgatacggagcagtatttgcggcatttggttcgccagcaaggcggccaaccaccaggctcatcatgcagagccagggtttttacttcttttccgtgccctacttcggaccagttcagggcagaggtcgcatggcctggagattggcctgaggcccgggcaggagaggcagaggcaccagcagaggctcccgacgaggcagatgaggcccgcgaggacgacgagatgaccgatttacttaatttcttaggaggaagcgggcccacatga

SEQ ID NO: 22392 - DNA, 642 bp, Glycine max
  Peptide Sequence Number=SeqID_114077
atggcttgcatgggaataatcatgcatgcacaaaccggaaatgtaggaatcaaaacaacaactccaacggaaacactggacgtaaacggggattcctttacaaattccttatatattagaaatccgggagaaccaaccactacgggaggtcactttctggctacttctcaaaattcattgcagatatatgatcctaatctggagagtagcggattgtttaattatattaaacttacccttacaggggtaccaggtgcaggaattacggattatgatacaaagatcgatgccgataatttccttttggttcctcacaactattcatttaagcttaatgacgggacaaccagtgttgctttggattataaagataacgggattaatgataatgcacaggggtctcctaatgtggttgcatttaaaagcaatggtacctggcatttgaaggccggatttacagacagcaagttaattgcttttacatcagctaatccttccagaacttataataactttactgtagagttttatttaatggtttacaagagattgatcactaagcagaatatcggcgatattaatactgatcttggcggaacaaatggatctgcacaaacgattaataaaccatcggggttttag

SEQ ID NO: 22393 - DNA, 527 bp, Glycine max
  Peptide Sequence Number=SeqID_114078
ggtggacccttgggtactagtaccctcaccttcagaggactacacgtcctcgccttcagagggttgcacgccctcgccttcaaagggcgacacgtcctgaacttcagagggctgcacgccctcgcctttagagggctacgcgtcctcactttcagtgcgctccatatccacaccttaagagaatttaagttcctggggccaccccctgatattggaaggtggccaactgtgcgagcacaaccagagagggaggctattgcccagctactatgcataccgggggcaagatttcacccatgcccgctgcaaaggatcgcacccacaaagacacccagtggacccgaaaaagtcaaacagggccctggggttttcagctctggttacgggcctctatcagtcctacagggtgctcggatcgcgcctgcaagacacccagtggacccgaagaagtccaacagggtcttggagttgtcaagctctaattacggggcgaaacaccacagcagcctggggatggtcggtagcgg

SEQ ID NO: 22394 - DNA, 807 bp, Glycine max
  Peptide Sequence Number=SeqID_114079
atgggattgaaccaaacaccctattttaagaaaaggttctatcatgtcaaaatcaagagcctagaggtagccagtttgcaagagctagggcagtggatggaccaactccaatgtaaagccttccgcaagacatatgggaaaatctgggacttggctatgatagaagtttccgtggaagccatcgcatccctcacccagtactatgaccaaccgctaaggtgcttcacatttggggactttcagttggtaccaaccgtagaagaatttgaagggatcttgggatgcctgctaggaggaaggaagccgtatctattttctgggttatacccctccatggcgagagttgctaaggtggtcaagatctcggcgcaagaattggaccgagtgaaacaaaatagaaatggggtggttgggataccaaagaagcacttggaagagaaagcgaaagctttggcggatcaaggagagtggactttattcaatgatgttttagcactgttggtgttcagggtcgtcctctttctaaatgtggatgggctagtggatctagcggcgatcgatgcttttcttgcttatcaccatagcaaggaaagttcggccattgctattttggtcgatgcctatgacacgttcaaccgaagatgcaagaagagcagcgcgaggatcgtttgttgcacacccgctctttatgtatggctagtctctcacatttttcgtcatgaaagtagacccgtctgtcccttacaaggtcaccgcatgtgtgccgagaaagggaaagaaaattgggaacaactcttggtgggtatg

SEQ ID NO: 22395 - DNA, 498 bp, Glycine max
  Peptide Sequence Number=SeqID_114080
atgccgatctccccctgcaaaagtatcggttggtctgtgccgtcacgacataggggtcgcgcccacaagacacccagtggaaccgaagaaatccaacacggccctggggtttccagctctagttacgggcctctatcagtcttacagggtgctcgtacccccccggcaaggtcatgccatcgcgacataaggatcgcgcccgcaggacacccagtagacccaaagaagtccaacagggtccttgggtttccagctctaattacgggcctctgtcagttgtacggagtgcccgtcacccccagcaaggtcatcaagcctcctactaaccgagctttcatcaaaaagtattgcacccccatgcagacagagggcgagacaccacaacagcttggggatggccagcaacaggtaacaaatgcaccgccgccgcctccagagcccctcagctcatccacaaaaaggttagagtattgcctacgacacatggccgaccaatag

SEQ ID NO: 22396 - DNA, 201 bp, Glycine max
  Peptide Sequence Number=SeqID_114081
atggcttctccacctgcctctcatcctcctccttctcctcctcctccttccaacacatcagctttgtcgtctgccgtgaagcggacacgcaaagcctcacgtctacgatcgttgtctactagaccacctggtgctgagagaccagtgatccatgttgatcctgataccggcaaggccgatggtccccacaggaagaaataa

SEQ ID NO: 22397 - DNA, 616 bp, Glycine max
  Peptide Sequence Number=SeqID_114082
cgcattcctggagacacctgtggtattagctgagggagaaactctacccgcatactccagatactggaggttgcctacaaactttagagagatagaggctgccttatgcatacctggtcgagggttcatcttgaactctgagggccatcctgggaagattctcaagaaggacttgactacactggctcaggtgtggagtgtcctctcatactccaacttggcccccacatcacatacctctaatctgacagtggatagagctaggctgatctttggcttagtctctcacttggatatgaacataggagcactgatctttggccagatgacctctatagcccagtctaacacttctagacttgggttccctgctctgatcaccacattattctctatccgaggggccaggagggtgagggcaaggccagccgagcttccttctacttctgcagctcctactccagcatccactttagcagccccctctgctccagctcagacaaattctcagtgctttgaatccatgctcaaaatcattcatcagggacaaatcattttactacagacttttcagataacagcacctccagactctattccttctgatgaacagtga

SEQ ID NO: 22398 - DNA, 510 bp, Glycine max
  Peptide Sequence Number=SeqID_114083
atggaggccattaaagagcaaatggccacaatgatggaggccatgatgagcatgaagaagataatggaagtcaatgcagctacaattgccgctaccagcgctgttgctgaggtggacccgattcccccatctgtcctcaaccaaataaatcatccaaccttagatatggtaggtcagggaggcaaagagttgggaagtgcgggtggaccccattttgtgcaagttcagaaaaagcatgccttccctccatatggcttgcctcccaactatacaccacctaatgttgcgcacattctcgatgagaatgtcaataactccactcccatactcattgagagccaacaacctcaatctgatcaggcacatgtctctcaacccatgggggagacacatgaaataccccaccacaatctagctgactttaagcctcacctcggatacgccaatgaggggcaagcaggttggtggtgtacccctgccaaacacttgagtcctatgaaaatcctttaa

SEQ ID NO: 22399 - DNA, 309 bp, Glycine max
  Peptide Sequence Number=SeqID_114084
atggtgacaaaaaggagcgggaaacaaaaagggcctgaaaagaagaatggagcaggaacaagttctgaggggctctgtggggcagcagtaacgagctcaagcttagaagggctgagagggcgacgaatcaaggatggaaagcatggtgttaaaagctccattggagcttgtaggccttgcatcttcttcatcaatggagtgatttgcttcttgaagatcatggcagcggaatggagaaggaagaaagatgattggatcgagatgccacttcaagaaaaagatgagtcaagaagaagctcaccaccatag

SEQ ID NO: 22400 - DNA, 741 bp, Glycine max
  Peptide Sequence Number=SeqID_114085
atggttatgggggggtttcatcaacagactctccttccccgcaaagaaaacaccgagactttttcaagtctcaccagttatccagaactacgtaggtctgagttcctcattggaggatacgtaggagcaagagcctcgcttttgtcgaccacaccgccttttgttgccatgactcaagagctggtagcccgcggagacaccttacggttatccgcacctcgtcattcagtaatcccaagtgtgattgacgagcagagaccaatatggtcatctgcgccctttccggagatgtcagcattttccgatggagacttttcaagtctcacaagttatcaagaactacgtaggtctgaattcctcattggaggatacgtaggagcaagagccttgcttttgtcggccgccccgataatctttgtcatactgaccctgaattggtcattgacatgcacccttgtatcatccagaggcggcgggcccgatgatacgcggagataccttacggttattcgcacccttttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatga

SEQ ID NO: 22401 - DNA, 180 bp, Glycine max
  Peptide Sequence Number=SeqID_114086
atgtatccgattgagtggtacatgaaggtgttgaaaggatatacaaagaatcaatatcgaccaaaggtgatgcaatcttatcctgcaagggcattggatagaagactcgaagtagattgggccaaagatgcaagagaaggccctagggttctcatgagccttaggggctccataatgtag

SEQ ID NO: 22402 - DNA, 143 bp, Glycine max
  Peptide Sequence Number=SeqID_114087
accagttcagggcagaggttgcatggcccgaggcccaagcaggagaggcacccccagaagctcccggcgatggagaagaagcccacgaggatgaggagatggccgatttgcttgacttcttgggagggagtggagatacgtga

SEQ ID NO: 22403 - DNA, 147 bp, Glycine max
  Peptide Sequence Number=SeqID_114088
atggagttaacaatattggaaaatgatgcaatcctccctaggaagggaccaatcactagaaccatgagcaagaggctccaagaagattgggctagagctgctgaagaaggccctagggttctcatgaaccttagggtagatttctga

SEQ ID NO: 22404 - DNA, 501 bp, Glycine max
  Peptide Sequence Number=SeqID_114089
atggcttctatcacggaggccatgctaaaactccagaaaactctagaggataatgccacggcgaccgcctccaatgcagttagggaagcggaaccggtgctacagcccgcaataaacttgggccgagatagaaacccaacggtgttcggtcggaggtacagtccgcaagcttacccttatggcttgcctccagacttcactccccgtgccgctccggaagatgtgagccaagcccctaccttcgaggggcaacttcctccttatgccgattatcccttgcaagaagatgatgaaggagatacccatctaggccctctgcttcacctcaaagatccggccccccatgaattaccccaaccaaacatagtcctccatgtcccatcttcacccgcacccgtaaaagaatccgttcccttcgcgggagataagggaaagattgattcacttgaggagaggctgagagcagtagagggcctcggcaattacccgttctcggattaa

SEQ ID NO: 22405 - DNA, 643 bp, Glycine max
  Peptide Sequence Number=SeqID_114090
ggctacatgcctcaccttcagaggactacacgtcctcactttagaggactacacgtcctcgccatcagaggactacatgttccccattttcaaaggggggcatgccctcaccttcagaggattgcacgtccttgccatcataggactacactccctcgccttcgaaaggcgacacgtcctgagcttcagagggctacacgccctcgcctttagaggactacgcgtcctcactttcaggaccagtagtttccttttaacggttcctgggccaccccctgatattggaggagggccaactgtgcgagcacaactagagagggaggctatcgcactgctactatgcatactgaggcaagatttcacccgtgccgctgcaaagagacgaggatcgcacccacaagagacacccagtggacccggaaaagtccaacagggccctggggtttccagctctggttacgggcctctatcagtcctacagggtgctcgtacccccccccgacaaggtcacatcatcatagggatcgcgcctgcaagacacccagtgaacccgaagaagtccaatagggtcttggagttgtcaagctctaattacggggcgaaacaccacagcaacattgggatggccggtagcgggcaatag

SEQ ID NO: 22406 - DNA, 183 bp, Glycine max
  Peptide Sequence Number=SeqID_114091
atgggtgccaagcacctcacaaggaccaaagaaaggtcgcatgtcatcaagcaaaggtccccggacgaaattaggctgtggcacgtacccggagtgggtggccaacattgtcccagtctcgaaaaaggacggcaaggttcaaatgtgtgtagactaccgggacttgaaccgaggcagtcctaa

SEQ ID NO: 22407 - DNA, 639 bp, Glycine max
  Peptide Sequence Number=SeqID_114092
atgtgggatgctaccgtgttcggggtgtttaatgaagacttccccttgtacataaagcatgaagatttgtctgaaatagcacacggtggtcaatgtctcagcatctctgttatacagttgtggactttgcatctgattgagacaagtatgcaagcagggaatttcgatgtctatggattcatcgagccacaatccatccagagatctgggcaatcacaatttgaatcaaaaagttacatgaagaactggatgcagaattcaaaatggaatgtctacctaggcgcctacatgaatgggctagacaactacgttaaaggaataattaacatgtcagtgttgttttttaatgcatttgcattatcattactcagcaacatcaatattttaatgttccttgtattcaacaatgctttgaaaggacttaacgatactccacaacctaaatccaaggccggtgctaggtggattcttgttaaatgtaatagacaaaaaggaagcactgagtgtgactattacgtgatgcactggatgtccactataatcttaggaactttcaggaataattgggaaacgaccattggaagcacagagattgaaggcgcttcgcatccaatgggaacagtattatctcaaagttag

SEQ ID NO: 22408 - DNA, 201 bp, Glycine max
  Peptide Sequence Number=SeqID_114093
atggcaaaaggtgcagaagatgatgttagtctttgcgcgtcaacgatcttgtttgcccctggttggcgaaaggtgcgggtaatcataaggacgacagaaggtgcaggagacgatgttagtctctgcgcgtcaacgagctcgttttccccctggttgacgaaaggtgcgggtaatcataaggtaaccccgcatgtcacctga

SEQ ID NO: 22409 - DNA, 339 bp, Glycine max
  Peptide Sequence Number=SeqID_114094
atggctgaaccatcaaagaagcgcaagggttcttcgagtcgaagccaacgacattccaaggctcaagaaacggagattccctcctccatttcctcttcctcattgttctcatcagaagaacaacggatacggtacacaaatcttgtctcttcttgttccattatagatcctaagttcatagacatggacttcttctccaatgagaattttgaatgcattcaagcatttcaaaattcaaatctcattcctttcatgtctttgaaatttcctgtttactctgaattagttaaagttttctactctaacctcgaaattcaagaaagcactttgatttctgag

SEQ ID NO: 22410 - DNA, 200 bp, Glycine max
  Peptide Sequence Number=SeqID_114095
agccttctgcaccagtggtaaacctaccctcacctcagcctgcagtagacccctccactcctcttctagagatgtcagaggacccgactacaccagtcctagctatggacacttctcctccaactaatccagtgcttcagctatcagatgaggaggatggtcaagcacaagacacccaagaccaatcacaggaattttga

SEQ ID NO: 22411 - DNA, 432 bp, Glycine max
  Peptide Sequence Number=SeqID_114096
atggcacatcaaaaccccccatacttagccttttgcactcctgggcaaaatgaaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 22412 - DNA, 318 bp, Glycine max
  Peptide Sequence Number=SeqID_114097
atgcacttctcaagtttaaattcaagacaaaaatccaagattacaagatacaacatcaagaacgtctctaatgatttaggaagggatttccaaattgaaacagcaaaaggtttggccaagaaatttaagctaaaatgtcattttcaagagatttactctctggtaatcgattaccagaggataactagtaaaaggattttgcaagatagtggaactcttaagcgggttgcttggggagtcgaccagtataaatttgagtttgcgcaagggtgtggccgaaccagtataaatctgagtttgcaatctttcttcccttaa

SEQ ID NO: 22413 - DNA, 102 bp, Glycine max
  Peptide Sequence Number=SeqID_114098
atggcggaaaatcttcacgaaattacccatggaaacgttttggacgcgttacggaagctcctcggtgtggattttcttcacggaaacgattttattcactgg

SEQ ID NO: 22414 - DNA, 243 bp, Glycine max
  Peptide Sequence Number=SeqID_114099
atgggtgccaagtacctcgaattggtcaaacgagggtcgcatcccaacaacggatggtccccgaaagaaattaggacgcagaatgaccataatttgtctctgcgtgttgttggacacgatcgagcctgggtggcaagacacagaatgaccataatttgtctttgcatgccaccggacacgatcgcctctggatggagaaaaagtgtgcggaatgaccctaatttgtctccgcatacctcttga

SEQ ID NO: 22415 - DNA, 312 bp, Glycine max
  Peptide Sequence Number=SeqID_114100
atgggaaagttggatcatctagaggaaaggctcagggccattgaaggaggtgaagatcatgcctttgctaacctagaagaattgttcctagtacccgatatcatcacccctcccaagttcaaggtgctggactttgacgagtacaaggggactacttgccccaagaaccatctaaagatgcagtatcagtacaattttgatatggttccggataggatgcgacaacagaacatgtgcaaaaaggggcacatatctttcaaagaatacgcccaaaggtggagagacctggcagctcaagtggcacctcaatga

SEQ ID NO: 22416 - DNA, 303 bp, Glycine max
  Peptide Sequence Number=SeqID_114101
atgaatgaaatagaggaggtgcaagaacagatgaaggccgacatggaggccatcttgagcatgaagaaaataatggaaagcaatgcggctgcagttgccactacaagtgccgccattgaggtagacccgactcacccattgggcctcaatcatgtaaatcctctagtctcggatatggtaggtcagggaggagaagcattgggaagtacaggcagcgaagaaccccgagaccatgctctgtccgacttcgagccttacctcggacatgccactgaggggggagcatttggtggcgtgccctag

SEQ ID NO: 22417 - DNA, 462 bp, Glycine max
  Peptide Sequence Number=SeqID_114102
atgaccatgattacgccaagctcgaaattaaccctcactaaagggaacaaaagctggtaccgggccccccctcgaggaacaccaacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 22418 - DNA, 165 bp, Glycine max
  Peptide Sequence Number=SeqID_114103
atggggcatgccacattgcccccattgtcttgcgagttaggcgtagacatgcgcccaccaagtgctcgggacagcatagaggatttgaaatgggttcccaaatgcaattctagcttagaacccaagctcttagcttcaatgcaaggaaacatgacttatgtctaa

SEQ ID NO: 22419 - DNA, 249 bp, Glycine max
  Peptide Sequence Number=SeqID_114104
atggaccttggagcaagacaatatggaattattttagatgtttatgagggtcttcacctgcaagaccatgaaacttgggcaacaagatgttcaaaattaccaaccacaaaatgctcagactcaccaataacagaatgctcaggatgctcaaaaggatcaaaggattgtaagtcacctggattgcctcaagtcatgcactatatgcagcagttcatgtgtttctcagacagggcaaaagaggtgggttaa

SEQ ID NO: 22420 - DNA, 261 bp, Glycine max
  Peptide Sequence Number=SeqID_114105
atggcacaacctccaccccgtgagaggattctaagggaaatggctgcacctgatttcacctacgaaagcttgtgcatccaataccctaatgaggatgtcccatatgttcttaaaactggactgattcatttgcttccaaagtttcatggccttgcaggactcagtaatatggagagaagtatgatagatactgccagtggtggagcccttggagacatgactcctgctgaagccagaaatttaattgagaagatggcttaa

SEQ ID NO: 22421 - DNA, 691 bp, Glycine max
  Peptide Sequence Number=SeqID_114106
gagggctgcacaccctcaccttgaagaggactacaaggtcctcgccaaacgtaggggctacacgccctcacctatagagggactacacgtcctcgatgagtcgatctcttactttctcataaggaggacccttgggtacagtaccctcgtctccagaggactatacgtcctcaccttcagagggctacacgtcctcgccttgagaggactacacgtcctcaccatcagagggctgcacgccctcacctccagaggactacatgtcctcgccttgagagggctacacgccctcaccttggaggactacatcgtcctcaccatcagagggctgcacgccctcacctccagaggactacacgtcctcgccttgagagggctactcgccctcgccttggggctacacgccctcacctttagaggaccacacgtcctcaccttcagagggctacacgccctcgccatcagaggactgcatgtcctcaccttcagagggttacacgccctcgccatcagaggactgcatgtcctcaccttcgtagggctacacgccctcacctttagaggactacacgtcctcgccaacagagggttgcacgccctcaccttgagaggactacacgtcctcgccaacgtagggctacacgccctcacctttagaggactacacgtcctcgccttcagaggactccat

SEQ ID NO: 22422 - DNA, 312 bp, Glycine max
  Peptide Sequence Number=SeqID_114107
atggagtataacattatgaatacactccaacatatgatcatggtagttacggcctaccaaacctcccatgaatgtttggaagaaaccattatagatattttagtggcaggattttccggacaattaaaagttaagacaggtatcaatggaaaagtccttactaatgatgaagataaagaaattcctgacgctgttaatacattaatttttccaatagctcaacacttcattggagacccatctttgtggaaatacaagtctgcagaattattgtcaaaccttaagtgtagaaccttagcagacttaaggtga

SEQ ID NO: 22423 - DNA, 402 bp, Glycine max
  Peptide Sequence Number=SeqID_114108
atggtccgccaggcatgggagacggtgcaaaagaaggacaaggaacttagaggcagtagcaacgggcccatcggtggctaccataggtggttgaaagcctacgcacaaggtctcgattggctcccgaatttgagaaccactaagggggtggaggttaaaactccggaagaagacgaagaggtacaggccctcaagatagaactcgagaaaacccaaacagtcaaacagaagttcaagtcagcaactgttaggatccaaaaggtgaacgccgaactgagagacgtcaatatagccaccaccaaggccttagaacaagagaccaagagggcccgtagggaagaacatggttggaacaaattccgaggggctctgtggggcagtaacagcgagcttaagctctga

SEQ ID NO: 22424 - DNA, 174 bp, Glycine max
  Peptide Sequence Number=SeqID_114109
gaaagaaaaatactacaatgcgaggggtatttcacttatctcagatgtgatatcaaaattcccaacggtgagaatgcttggaaatgggtttcaaacgtgctgtttaaatttcacgacgatccaacagtgaatgagtccgagatcgtcatttttctaagacaggggtattcatga

SEQ ID NO: 22425 - DNA, 558 bp, Glycine max
  Peptide Sequence Number=SeqID_114110
taccctcacctccagaggactacatgtcctcgccttcaaagggctacgcgccctcgccttcgcagggctacacgccctcaccttccgaggactacatgtcctcaccttcagagggctacacgccctccggtactagttccttccgtagaggctacactcctcaccttccgagaggactacacgtcctcaccatcagagggctgcatgccctcgccatcaagaggactagcatgtcctcgccttcgagagggctacacgccctcagcttgggtactagttaccctcaccgttgagggactacacgtcctcgccttgagaggactacacgtcctcactttcagagggctacacgccctcgcctttagaggactacacgtcctcaccatcagagggttgcacgccctcacctccagaggactacacgtcctcgccttcagaggactgcacgtcctcaccttcagaaggctacacgccctcgcctttagagggctacgtgtcctcactttcagtgggctccacatccacaccttaaaagaatttaaggtcctttgcccttaa

SEQ ID NO: 22426 - DNA, 875 bp, Glycine max
  Peptide Sequence Number=SeqID_114111
aaaaggactacacgtcttcgccttcaaaggactacacatcttaacttcagaggactacacgtcctcactttcagaggactacacgtcctcgccttcagagagctacacgtcctcgtcttcagagggcaacacgccctcgcctttagaggactacacgtccttaccttgagaaggctacacgccctcaccttcaaaggactacacgtcctcaccttcagatggctacacgcccgcgccttcagaggactttacgtcctcaccttcagagggctacatatcctcgcctttagaggactacacaccctcgccttaagagggctacacgtcctcacctttagaaaggtacacaccctcaccggcagaggactacgcgtcctccccttcaggtggctacacgccctcaccttcagaggactacacgtcctcgcctttagagggctacacgtcctcaccattagagggctacacgccctcaccttcaaaagacaacacgtcctccccttcaggaggctacatgtcgtcgccttcatagggctacacgccttccccttcagaggactacacgtcctcaccttcagaaggctacacgctcacgcctttagaggactacacgtcctcgccttcagagggctacacgccctcgcctttagaggactacacgtcctccccttcagagggctacgcgccctcgccttcagcggactacacgtcctcgccatcagaggactacgcgtcctcaccatcagaggactacacgtccttgccttaagagcgttgcacgccctcaccttcagaggactacacgtcttcgccttcagaggactacacatcctcacctttggaggactacacgtcctcaccatcagaggacacac

SEQ ID NO: 22427 - DNA, 900 bp, Glycine max
  Peptide Sequence Number=SeqID_114112
atggtgctgtctttaacaagctgccaaaatgaaacaactgaagtacttcaggaaaataccgcaaaaaaagaatcggtttccgatttgaaaaaagtattaactccctcttctcaaacacttcccgatattgttcaaacacaattgaatgattcaaagaaaaatctggaacaataccttaaaaatgatcttcagattaccggagtttcagttttaggaaagctgtctgatgcaaatggaatttcaatttctcaaaacctcatttcagataaaaatacttatgtggcgtttggtaatattacagacccggcatcagtaaaaataggcaaaatgacaaattttaattcaggagatgaactatcagttgcccaacaaagcctgaaggatgtcattagtcaggaggtaaaaccaaatacagaagtacttgaaattacatggaatcacaagggagagcaatttacttcattatgtttctacaataccaacggaattatctgggataatgtgttaggaggcctggtaatgatggatagaggaagtaacgtagaagcctctaatgacaatcaggcaaaggtactttcgaagtggtataaagaatggtggacggcaaaatggctatggggatccaagagaggagaaatcggatataagatcacgatttattataatggatctaccgtatctaatactgatgtaagtgattggggcaatatcagtttaggaaaagcaaaaagcgaaagcaaaatattaaagagaaccggagcttacggacaatgcagatatgcacttggactatgtacaccgacaggttctttaagctttaattcaagtaactttacggtatcattttccggtttgggaagtaatatcgtaagtaacggaaccaagtccctttatccttaa

SEQ ID NO: 22428 - DNA, 230 bp, Glycine max
  Peptide Sequence Number=SeqID_114113
atggaggttgaggaaccttggttggggttatggctaccattgaattatcgagtggatatgggatcaagtttagcatatgacaacggaatttggggctttgtggttgatttagggatggcctttgtggataactgggcggtgggtaaggagaaggtttgttattggatgagtaaagacattgttgggttggtgggaaacttggccgtacaggaatggcagtcacagcatgg

SEQ ID NO: 22429 - DNA, 255 bp, Glycine max
  Peptide Sequence Number=SeqID_114114
atggacacccgtctccgtgtgattggtgatcccatgaatggagttcaacggagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 22430 - DNA, 464 bp, Glycine max
  Peptide Sequence Number=SeqID_114115
atgaatggtataaagatgctctacggtaatcgtatttactgcgccgccgcctaccaaaatatcccgcaagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 22431 - DNA, 331 bp, Glycine max
  Peptide Sequence Number=SeqID_114116
gtcgacaaaagcggggctcttgctcctacgtaccctccatcgaagaggaaatcagacctacgtagttcttccttaaggcttgactttgcagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgaggtgtcagtgaagtgcttcatgtgcaggagaaaaaggctgcacg

SEQ ID NO: 22432 - DNA, 420 bp, Glycine max
  Peptide Sequence Number=SeqID_114117
atgaaaactaggcagcaagtgtcgaggtcaccttgtcgtgcacatgcaactccccatggtgatcaacctgagtctcaagggagtttcaaatcgagtgacatgcccctaagtacaaggatatccatcatggtcactacatccctcatgtacatacacaacatacatcatcataatgacattttcaacatcaacaacatctcatctcaatgtcattatcaacatcaacatcatcttgtagaagcaaagattcatggtgaatcaaaggtgattcaaaggtgttttgattataacaatgatgatgacaaaggtgatgacaaaaaagctcaaagatcaatcaagaacagctcaagtgaatctagaacaattcaagagttcaagataagaatcaagaagaattcaagactcaagaagaaagtctag

SEQ ID NO: 22433 - DNA, 192 bp, Glycine max
  Peptide Sequence Number=SeqID_114118
atgtgtctccaggcacgcgcagggagaaacaccacagcagcccggggatgtccggcagcgggcaacagacgcacccccatcacctctagagttcacctctgctcatccacaaaaaggtttgagtattgcgtacaccacatggccgaccagcaggctaccaagtccaaagacaaaggtagaaagataccttag

SEQ ID NO: 22434 - DNA, 201 bp, Glycine max
  Peptide Sequence Number=SeqID_114119
atggggtacggaaagaaaataggggaggagcttgccacccagctcacccaggcgagccaggttgcttcctccagaagcaaccgccttctagaggaacatcctggaaggcccaagtgggcctggaacttcacgtattgtgcaacaaagggtgccaagtacctcgaagcggtcaaccaaaggttgcatgccatcaaacaatag

SEQ ID NO: 22435 - DNA, 753 bp, Glycine max
  Peptide Sequence Number=SeqID_114120
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttatctgttcgcataaacccaagagtgattctaagtcttgatatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 22436 - DNA, 351 bp, Glycine max
  Peptide Sequence Number=SeqID_114121
atgcacaaaaaaagatcttttgcaggtgatttgattcccattgatttggagattaatgccacttgtagaaggtgtaatcaggagagaattagaaattttttgcaggacttagaggcagcagcaattccagaggaagaacctcaatcttatgacgcatcttctagttttcctattgtagaaaattcacatttagatcctagtgaagactacatcatggctgaagagccaagaagagttactatggaagattattcaagttctaaggtgccacaatttttcaccagcattgcacaaccagaagttcaagcacaaaccattacttatgcaccatcattgattcagttgatttag

SEQ ID NO: 22437 - DNA, 375 bp, Glycine max
  Peptide Sequence Number=SeqID_114122
atggaggccatgaaagagcaaatgaccacaatgatggaggctacgatgagcgtgaagaagataatggaagccaatgcggttgcaattgccgctaccagcgttgttgctaaggtgaacccgatgcccccatcgggcctcaaccaaatgaatcattcaacctcagctatggtaggcaaagatttgggaagtacgggcggcccctattatgcgcaaagtcaaaacaagcacgccttcccaccacatggctttcctcctaactgtacaccacccaatgtagcgtacactcccagtgggaatgtcaataactccactcccatattcattgagagccgacaatcccaaactgatcatgcatatgtctcaacccatgggtga

SEQ ID NO: 22438 - DNA, 165 bp, Glycine max
  Peptide Sequence Number=SeqID_114123
atggaggagatacatggtgaagatgatgaagaacaaggaactaaaatcattagcagcagaatggagaaggaggaaagcttattgcagatgccacttcaaggagaagatgagttaagaacaagctcaccaccagaggaagtcatggataagagcttgaaggtatga

SEQ ID NO: 22439 - DNA, 237 bp, Glycine max
  Peptide Sequence Number=SeqID_114124
atggttatcggttcaaggacgcaaggtgcccctgctttttcagggctaaataagggacctgctcaacagtgggaggaggctcgggactctgaccgacacaggattcgcaaagtcggtgaagaccataagtggagggctccgaaccgactgcccatgttgaagagtcaaggagagttgtgcgttagggtgaaagccgacgaccgactagtggttccccgtgtgaacggcggccgttga

SEQ ID NO: 22440 - DNA, 232 bp, Glycine max
  Peptide Sequence Number=SeqID_114125
aggatcccccagctttattacgggtctctgtcggttctacggagtgcctgtcacctccagcaagggcatcaggccccctactaatcgagctttcatcaagaagtactgtgtccctaggcaggcacagggcggaataccacaacagcctggggatggccggcagcgggcaatagacgcaccgccatcacctctagagttcacctcagctcatccacaaaaaggacacacctag

SEQ ID NO: 22441 - DNA, 534 bp, Glycine max
  Peptide Sequence Number=SeqID_114126
atggctaccacgtcctcgcctttagaggactgcacgtcctcacctttagagggctacatgccctcaccttcagaggactacacgtcctcacctttagagggttgcatgtcctcgccttcagagggctgcacaccctctcctttagagggttgcacgccctcactttcagaggactacgcgtcctcaccttcagagggctacatgccctcgccttcagagggctacacgttctcaccaggactacatgtcctcgccttcaaaggacaacacgtcgtcgcatttgccttcgtagggctagacgccctcacctttagaggactacacgtcttcgcctttagaggactacacatcctcaccttcagagggctacgtgtcgtcatcttcaaaggactacacgtcttcaccttcggaggagtatacatccttaccttcagtggactgcacgccttcaccttcaaagggcgacacgtcctcaactttagagggctacgcgtccttactttcagtgggctccatatccacgccttaaagtaa

SEQ ID NO: 22442 - DNA, 410 bp, Glycine max
  Peptide Sequence Number=SeqID_114127
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctctgttcctgcctttcggtttaccggtgtcattccgctgtatggccgc

SEQ ID NO: 22443 - DNA, 360 bp, Glycine max
  Peptide Sequence Number=SeqID_114128
tgttggatctacaagcatttctcgtccgttggttctgccctagttgtcgaggattatgatgagaggagactgcatgcatgccgatggacctctggcaagacactgcccatgtccatgtctcgcaggcgtctggacagactgacccctgacatggtgtgctggattacgtatggtgaccaccgttcatctagagaatttgaggtcatctcattatttttcggccatctcaaatggggtcccttgacggtcattcaccgaccggagagggttgtacgacagtttggatacatccagactattctgccacatcctactacatttgcggtctctgttgaagaaattgatgatagttggatgtag

SEQ ID NO: 22444 - DNA, 351 bp, Glycine max
  Peptide Sequence Number=SeqID_114129
atgattatgaggaaccaagacatttatagtagccaagatgaggctactacgtcaccttcctctagtgaaagtgaagaagtaaaaggggaagaatctagtgaagaaatctacccccaagaagaaggacaacctttaatggttaaggaggagtgtaaggaggtaagtgtctcctccaagagtgatcaaggggttcccaaggaccctaagagaataaagatcattcctgattggcccactccaccaagtgtcaagggaaagagcccagagtatcaagaacctcaggatttgaggtcaaatcctttccaaggtggaggggatgatgcaatcctaccccctaagggtattggatag

SEQ ID NO: 22445 - DNA, 687 bp, Glycine max
  Peptide Sequence Number=SeqID_114130
atgggaacaaatcaaccggcagaggtttacaagtcaaggttaaaagctagataccaccagcatcaaggaattagggcggttgatggactccaaatgcaagccttccgcaagacttacggaaagatcttagagttgaccataacagaggtatccataaaagccattgcatcactcacccaatactacgaccagcctttgagatgcttcacgttcggagacttccaattggtaccaaccattgaagaatttgaggaaattctaggatgtcctctcgggggaagaaaaccatacctttcctccgggtgtctcccttctttgagcagaattgcaactgtggtcaaggattcagcaagaggtttggaccgcataaaacagactcgaaacggcatagcgggcctaccacgaaagtacctagaagacaaggcgaggggtatggccgatcaaggagattgggtcccgtttatggatgtcttagctttgctaatttttggggtcatcttctttccaaacgtagatggtttggtggacctagcagcaatcgatgctttccttgcatactaccatagcaaggaaagtccggtggtagctgtcttggcagatttatttgacacatttaaccgaagcaagacacgagacatccatgtccgctccagagccatcgctcgtgtactgaaaagagaagaatag

SEQ ID NO: 22446 - DNA, 709 bp, Glycine max
  Peptide Sequence Number=SeqID_114131
gtagaatctgatgaggaacccattgccaacaggttggcacctggcattgcagaaaggttacaaagcagaaaagggaagacccccattaagaggtctggacgaatcaaaactatggcccagaagaagagcactccgatcactcctaccacatccagacggagcaaagttgtaatcccttccaagaagaggaaagaaatttcctcatctgattctgatgatgatgtcgaactagatgtctcgacatcaaagagggccaagaaatctgggaagaaggtgcctggaaatgttcctgatgcaccattggacaacatctctttccactcaattggcaatgttgaaaagtggaaatatgtgtatcaacgtagacttgcggttgaaagagaactgggaagagatgccttggattgcaaggagaccatggacctcattaagggctgctggactactgaagacagtcaccaaattggggagactgttatgaaggcctatgtgaagtatgcaattctgcataggattggcgctgcaaactgggtacccaccaatcatacttccactgttgccacagggaaagctgctgcttcaggtgctgtgtccaaggatgctctgattgctgaactcaaggacacatgcaaggtgctggaagcaaccatcaaagccaccacagagaagaaaatggagctggaacggctgatcgaaagactcacagaca

SEQ ID NO: 22447 - DNA, 235 bp, Glycine max
  Peptide Sequence Number=SeqID_114132
cgctaggcaatgacattcatggggctccgaaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 22448 - DNA, 612 bp, Glycine max
  Peptide Sequence Number=SeqID_114133
atgggttctccacctgcctccactcttcctcctcctcctcctccttctcctcctcctcctcctcctacttcggacgcatcggcttcgctgtctaccgtgaagcggacatgcaaagcctcacgtctacgatcgttgtccactagaccacctggtgcggagagaccagtggtgcatgttgatcctgctaccaaggaaggccgacggcggaatttgatatcccagaggcttctgacagtaggacgaaaaggaagttactacagacagtgggggagagatgaaggcagtttaaatcagacctcacgaggaaatggacccttgcagccgatcaggacggtgtcgaggacactgtttgtgacaaatacgacatcagcaaggaaaagtgggcccagttttgccagactcatagagacccttcttgggaggatgtgcgcatcaaggcacaggccatcaagaagcagaatattgccccccacgtttagtctcgtgggggttatgattatttggagcagaagctcctggctgagaagaccaagaagaagatgcaggaagctgcacagtccggaaacgttgatggcgtcatcgaccctccatccccagtcagacgccacgtga

SEQ ID NO: 22449 - DNA, 324 bp, Glycine max
  Peptide Sequence Number=SeqID_114134
atggcaatgatggtgggctgggtgatgttggggaatggctacgagcctggaatgggtttaggcaagaacaacagcggcaaaaccagcctggtaagcaccagaggaaaccacgggaagtttggattaggctataaacccacgcaagcggacataaggaaaagtgtcgcgggaaggaagagcagaagccaaggttcacaattgggacgacaagtcgaagggggcccgccatgccacatcagtaggagctttataagtgcgggtctaggacacgaaggccaagtcgttgcgatatgtgaggatgactctccgagtgggtcggatttg

SEQ ID NO: 22450 - DNA, 315 bp, Glycine max
  Peptide Sequence Number=SeqID_114135
atgttcgccaattctccattctccacttttattcggagacccatgaattcattgcctagcgctgttcatgtgtcctccaccatcgagtctggagccccgcgaattgattgcctagcgctgttcgccaattctccattctccaatcttatttggagacccatgaattcattgcctagcgctgttcatgtgtcctccgttatcaagcgcggaggctctgaaaataaaagaaggagtagagacgagagtcgtcatcacggaaagggcaggacggacgaaatcagtgtcttatctttgctttcctcttatcttcgatga

SEQ ID NO: 22451 - DNA, 351 bp, Glycine max
  Peptide Sequence Number=SeqID_114136
atggatgaccaagaggagatacaggaacagatgaaagccgacatgtcggctttgaaagagcaaatggcttccatgatgtatgccatgttaagaatgagacaacttatggagaataacgtggccaccgctgccgctgttaaaagaagcacactggggcacatcagcaacccccatttgggatacaaccgagtggcttacccttatggattaccacctaattacacgccaccagtcatgcgtgatgacgcgggtcatgtcccttcccccatccttgaaagggagcctcctcaacagtcagacgatgttcacgaggatcgtagagagtatgcccaaggagatatcgatttctaa

SEQ ID NO: 22452 - DNA, 597 bp, Glycine max
  Peptide Sequence Number=SeqID_114137
gtgccttcagccaggctaagctcgagactagcgctaagcccaatttcacttactcgcgctaagcacgagggtggcaatcaatgggagaggaccacttcagggcaaggatggacattctcaccctgggtcaaggtttatggtaagttgggattttggctcaaggcttgtagaacgactggacatgatatatgtcagggtgttggtttggccaacgtggtcatattggtgcgcatgatccgcactcgtctctttgcagcggcacgggtgaaatcttgccctggtatgcatagtagctgcgtgatagccacctcctctagttgtgctctcacagttggccctcctccagcatcagggggtgtggatgtggagcccactgaaagtgaggacgcgaagccctctaaaggcgagggggcatgcagcactctgaagtcgaggacgtgtagccctttgaaggcgagggcatgcacccctttgatggcgagggcgtgcggccctctgaaggcgagggtgtgcggccctttgaaggcgagggcatgcagccctttgaaggcgagggtgtgcggccctctaaaggcgagggcgtgcagccctctaaag

SEQ ID NO: 22453 - DNA, 408 bp, Glycine max
  Peptide Sequence Number=SeqID_114138
atggtggggtacgcgccttcaagctttgcggatttggtcttcgccgatgaaaggattgaagtgggtctaaaaagaggcaaatttaatcatcctgcttggacgactgagaaaactagggcaaatgaagagggtgaggatgagggagaaacccatgctgtgactgccattcctatacggccaagtttcccaccaacccaacaatgtcattactcatccaataacaacccttctccttacctagcacccagttatccacaaaggtcatacctaaatcaaccacaaaacccaccttccacacaaccaatgttaaacaccacctttagcacgaaccaaagcaccaaccaagaaatgaattttgcagcaaaaaaacctgtaggattcaccccaaattccggtgtcatatgctaa

SEQ ID NO: 22454 - DNA, 510 bp, Glycine max
  Peptide Sequence Number=SeqID_114139
atggaaagtgcaaggcacatggatacacctatgagtactggctgttatttagacaaagatgaatccaatcagtctatagacatgaaacaatatcgaggttccaatccaaccccatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatagcccttcccaacagttgcgcagcctgaatggcgaatgggacgcgccctgtagcggcgcactaagcgcggcaggtgtggtggttactcgcagcgtgaccgctacacttgccagcgctgatgtccggcggtgcttttgccgttacgcaccaccccgtcagtatctgaacaggatggacagctga

SEQ ID NO: 22455 - DNA, 336 bp, Glycine max
  Peptide Sequence Number=SeqID_114140
atggaagcaatgctttccagtctttttgggtcttcctctgcctcgaattgtttgccttctctccatctggtctactctcctcactacagagtctaccggtcttctctctacatgcccaaaccacctaagtctattttccaccatcttctctacaataggcgctactccaaccctctctctaatagctccgtttctaattttatcctgtcgagtcttaccacacatccaccgcaacatcctcatctccgctacacctactttagtctcatgttggctcttgaccgcccaacattcttgttccgtacaaaatcgccggtcttaccgcaggtcggataa

SEQ ID NO: 22456 - DNA, 717 bp, Glycine max
  Peptide Sequence Number=SeqID_114141
atgaaactcatcgtccccctccagggtctggtgctgggccgcagagggcttctcctcgggaccctcgtcccctgcacgcttttctacttcctccagcagcactcgcgactacatgacgaggaaggaataggaagaagaagagactgtgtctttgagaaagagagtgttacggttttgttctttcggaaagaggaaagaggcattgcattgggaaggagggggagaaggcatgcattgggaagaggaaagaggcattggaaagagaagtcaccaaagcgaggagatcgaggaattcaaattcaaaattgcataatagtgattggccctactttgccacttcaccagactgacttccttggcacgatagatttttgccgccgaacagtgagcaccatatggcataccatggaggttgccactatgatgagcattttttattttgcggttgatgatggagatggcggcggcagtgacgtcaagagaggccaccaggaagagcacaaggaattggcagccaccatttgtcatccttccttggaacaatttttcggaatgaggccccacgtaatcgactcgaattccctgatagaggaaaccaaggatgctgatagaaatggtccaaaaggaattatcagcgctgttaggatatccattgttgttggatggggttacattctaggcattacctttgcagtcactgacatcgtttaccagtga

SEQ ID NO: 22457 - DNA, 387 bp, Glycine max
  Peptide Sequence Number=SeqID_114142
atgatggtagattgcaggctagtgcaatacaggtatgttgattgggctgagctgcgtagaaagggatttaagggtactagattccgaccattgtcattcaacgtacctaagccactttttccattagcaggacaacccatggttcatcatccaatttctgcttgtaaaaagattcctaatttggctcagatttatcatcttggtttctacgaggaacgtgaatttgccttatatgtatcttctatctcaaatgagcttgaaatccctgttagatacttgaaggaagacaggccacatggttcagctggtggtctttatcattttagagatctgatcatggaagaggatccgattttcatctacacctatgactttgtccatgcttga

SEQ ID NO: 22458 - DNA, 487 bp, Glycine max
  Peptide Sequence Number=SeqID_114143
atggaaccaattgcatccctttcccagtattatgaccagcccctaaggtgcttcacatttgaggactttcagctagtgccgactgtgaaagagttagaagaaatcctgggatgccaactgggaggaaggaagccatatcttttctttgggttctatccctccacgacaagagttgccaaggtagtgaaaatctcagcacaagagttggaacgtctaaagcaaaacagaaatggagtagtcggagtaccaaggaagtttgtcctctttccgaatatggaagggttagtggacctagcagcgattgacgctttcctcgcctttcatcatggcaaggaaagcccggtcgtcgccattttggccatgtatgacacgttcgaccggggatgtgaaagagcagcgcaagaattgtttgttgtgcactggctctctatgtgtggctggtttcacaccttttttctccaagaagtaggcccgtctatcgctacag

SEQ ID NO: 22459 - DNA, 361 bp, Glycine max
  Peptide Sequence Number=SeqID_114144
atggtaatcgattaccaaagagtaaaaactctgctttgcttccacactttgatcacatgttcagtagacactggcgctcggggagttatatccgcttttgtcgagaggtggcacaaggaaactagcagtttccatcttcctataggagagctgaccatcacattggatgatgtggcgtcactgcttcatcttccgatcataggcgtcttcaacagcttcgagcctctgcatgtggacgaagcggtgttgatgttggtggagttgctagaagtctcgggtgaggaagctagagctgagacaacacaatgtcatggggcatacatacgcctatcgtggctacgggatttttatcagaggagat

SEQ ID NO: 22460 - DNA, 249 bp, Glycine max
  Peptide Sequence Number=SeqID_114145
atgacagaaattgtctacgcggaagatgacgtaaatctccgcgtgtcaatgggcttgttggctgcgattgacaaagggtgcagaagacgacgggaccatctgtttggtgggatgcgaccttcgcttgagcgcttcgagggtgtgcaaatagcaataaagcccacttgggccttccaggatgttccaacagaaggcggtgccttctggtgcaagcaacccagctcgcctgggcaagctgagctcgcctag

SEQ ID NO: 22461 - DNA, 432 bp, Glycine max
  Peptide Sequence Number=SeqID_114146
gacgcaagggataacttggctcccaaagttgaagagtccattggggaagaaactgaagtccctaaggagagcgaagaagtgcaagccttgaaagcagagcttaaaagaacgagaatggtcaaggaaaaagctaaagatggcagtcaccaggggcagcaacaacaagctcaagcttcgaagggccaaaagggacgagtcgagggtggagagtatgattataaagagaagctaagcttagctattagccatgggcagagactagaggatgagcatgtgaaggtatcaactctgcaagtggaaagggaagcaagggagagggtgatagaatcatttcacgaggaagctgtgaaatggatggatagattcgctctcactctaaatgggagtcaagagattccaaggctgttagctagagccaatgcaatggcggac

SEQ ID NO: 22462 - DNA, 806 bp, Glycine max
  Peptide Sequence Number=SeqID_114147
atggctacctcaccaaaagaaacttcagctcctggttcaccctctgtaccatcatctccatcatccaccaaagcaccatcaaaccaggaacaacctgaattccatatccaacccatacagatgattcctggtcaagcccctggtgtgaagatttctgaaaaccctagccttgcaacaagtcctagggaagtagacacagaaatggataagaagatccgcagtatcgtaagtaacattctgaaaaatgcctctgttcctgatgctgatgaagatgttccaacatcttccaccccagatgttactgttcctgagaaagatgttccgacatcttccaccccaaatactgaagtcctctcttcacccagcaaagaggaatcaacagaggaagaggatcaagccacacaggagacccctgcaccacgggcaccagaacctgcgccaggtgacctcattgacctggaagaagtagaatctgatgaggaacccattgccaacaagttggcacttggtattgcagaaagattacaaagccgaaagggtaaaacccccattaagaggtctggacgaatcaagactatggcacagaagaagagcacaccaatcactcctacctcatccagacgaagcaaagtcgcaattccttccaagaagaggaaagaaatttcctcatctgattctgatgatgatgtcgaactagatgtctcgacatctaagagggccaagacatcagggaagaaggtgcctggtaatgtccctgatgcaccattggacaacatctcattccactccattggcaatgctgaaag

SEQ ID NO: 22463 - DNA, 129 bp, Glycine max
  Peptide Sequence Number=SeqID_114148
atgtctagttttgctctggaaattgcttctgggatatcaaagatgtttgctcagaagaaagtcatgctgagcccggggaggcacaagatagtgatactggatgaagctgatagcaaagaagctgaataa

SEQ ID NO: 22464 - DNA, 723 bp, Glycine max
  Peptide Sequence Number=SeqID_114149
atgccttacctgtgggcgaccaccggtatcggctacaacgtggataaagtcaaagcggcgctgggcccggacgtcaagctggacagctgggacgtggtgctgaagccggaaaaccttgagaagctgaaaagctgcggcgtctctttcctggacgcgccagaagagatctttgccaccgtgctgaactacctgggcaaagatccgaacagcaacaaggcggatgactacaccggtccggcgaccgatctgctgctgaagctgcgtccaaacattcgctatttccactcttcccagtacatcaacgacctggcgaacggtgacatctgcgttgcgattggctgggcaggggacgtgtggcaggcggcgaaccgggcgaaagaggcgaaaaacggcgtgaatgtgtcctacttcattccgaaagagggggcgctggccttcttcgacgtcttcgcgatgccagctgatgcgaaaaacaaagacgaagcgtatcagttccttaactacctgatgcgtccggacgtgatcgcccacatcagcgaccacgtttattacgccaacggtaacaaggcttccgtgccgctggtgagtgaagcgatccgcagtaatccggcaatttatccgccagcggacgtgttcgccaagctcttcaccctgaaagtacaggatccaaaaattgaccgcgtacgtacccgtgcgtggaccaaggtgaaaagcggtaagtaa

SEQ ID NO: 22465 - DNA, 534 bp, Glycine max
  Peptide Sequence Number=SeqID_114150
atggcttctagaaaaagaaagagcattggtacaaggcccacatctctgtatgacacaaggagattctcttcattagatgcttggaccagatacacagacaatgttctagggagaaacattttacctgagaggaaggtagagctctatcacactgagctaaatgactttaaggctgaattggaaaggcgtaatttccataaacgcctcaccaatttagccgatgggagcatagacctagctttggtgaaagagttctatgcaaatttatatagttctgaggaccgtcaaccaaagcaatccagagtcagaggtcatttggtgacgattgatgctgacagtctcaacgcattcctggagacacctgtggtattagctgagggagaaactctacccgcatactccagatactggaggttgcctacaaactttagagagatagaggctgccttatgcatacctggtcgagggttcatcttgaactctgagggccatcctgggaagattctcaagaaggacttgactacactggctcag

SEQ ID NO: 22466 - DNA, 294 bp, Glycine max
  Peptide Sequence Number=SeqID_114151
atggagggacctggcagcacaagtggcacccccatgatggaaagagaaatgataaccatgatagtggacacactgcctgtgttctactataagaagatggcgggttacatgccctctagtttcacagatttggtatttgcaagcgagaggattgaggtaggcttgagaaggaggaagttcaattatgtcgctcctgccaacacaagcaataggagatttggagcaagtagggccacgaagaaggaaggagacacccatgctgtgacttcatctcctacatggcctaaaccctag

SEQ ID NO: 22467 - DNA, 534 bp, Glycine max
  Peptide Sequence Number=SeqID_114152
atggtcgaaaaggaaatgattaccatgatggtagacaccttgccagtgttttactatgagaaattagtgggctacatgccctccaactttgcagacttggtattcgctggggaaagaatcgaagtgggcttgaagagagggaagttcgattatgtctcctccaaaggtaccaatgctaggtggatcggagcaactggggcaaagaggaaggaaggagatacgcatgtcgtcacttcagcgcccgcatggatcaagccgccgcagatctcccacagtacccatcagtacgcgcaacatcacccgagcttctctgctcgcaccggggactcctccaactcagcactcgtacaaactagggcgcctgcacccatccagagggagcccccccaagctccggctccaaccctgattcgcccggccagcaatgcccactttggcattggttccaacgcgacaaggaaattttcctcgaggccaactccaggattcaccccgatcccaatgacgtacgaagacctcttggggatcctctag

SEQ ID NO: 22468 - DNA, 243 bp, Glycine max
  Peptide Sequence Number=SeqID_114153
atggtgaatcctgaggaaggggcaggtctggcactggtgcagatgactcaggctgagaagaagacatgtccaacactacaatggaaggctctggctcaggtggagtgggctctgaggcctctagaatgtcgtcctcctggtacggctgaggcttctaggctgcagaggcctcacaccctcccaaaggagaaggctagactcctggctaggccaacttatgcagaaactcatccatgctcataa

SEQ ID NO: 22469 - DNA, 150 bp, Glycine max
  Peptide Sequence Number=SeqID_114154
atgaggaaaactctagatgaggcttcactgttatcaagcgagtcggagacccaacatgacaacagatcaacctccactccttatggctctcatagacttagggtcgacaagggtgttgcccttgctcctacgtatcctcaggtgcaatga

SEQ ID NO: 22470 - DNA, 277 bp, Glycine max
  Peptide Sequence Number=SeqID_114155
cccaacaaggccctggggtttccagctctggttacgtgcctctgttagttctacagggtgcccgttcccccagcaagggatcgtgcccgcaagacacccagtggacccgaagaagtccaacaaggtcttggagttgccagctctgattacgggcctctgtcggttctacggagtgcttgtcgcccccagcaagcctggggatggccggcagcgggcaacagatgcaccgccaccacctctagagttcaccaataggcaaccaagtccaaagccaaag

SEQ ID NO: 22471 - DNA, 147 bp, Glycine max
  Peptide Sequence Number=SeqID_114156
atgttgatgcacaatccgcccatttgggccctccagaagattcctccagaaggcggttgcttctggaggaagcaaccctgctcgcctgggcgagctgagctcgcttgggcgagctgggcggcaaccacctcccctattttgctataa

SEQ ID NO: 22472 - DNA, 649 bp, Glycine max
  Peptide Sequence Number=SeqID_114157
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatgcgaggtaggtctacatctagaaccgtcattcccattgacttggaaatcgaagctacttggtgtaacaacgccgcaagaagacaaagggagcaggacatagatacttcacctcctccttctccaaatcacgttcaaatggacgaaggaccggcacatagggttacactatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 22473 - DNA, 336 bp, Glycine max
  Peptide Sequence Number=SeqID_114158
atgggtgaagtagaggaggtacaagagaagatgaaggccgacatggaggccatgaaagagcaaatggccacgatgatggaggccataatgatcatgaagaaggcaaagatttgggaagtacgggcggcccccatgatgtgcaaattcaaaatgagcacgccttcctgccatatggcttgcctctcaactacacgccacccaatgtggtgtacactcccaataagaatgtcaataactccactcctatacccattgagagccaacaaccccaaactgatcatgcacatgtctcttaaaccgtgggggagacacatgaaattccccactacaatctag

SEQ ID NO: 22474 - DNA, 756 bp, Glycine max
  Peptide Sequence Number=SeqID_114159
gtcgactctagaggatcccccaaggacctggcccaggcagggggattcgcctggggggcggctgcattagtccacatgtacgaccatctgaatgacgcgtcgcaggcctctacacggcagctgggcggttatattacacttctccagtgctggatatacgagcacttttctacaatgcatacatccgtcgttgatgatgcttatgatgaggggagcccacgagcctgcaggtggcttacgggtaaggctcatattacggggatcaagggagccccgtatcagagacgtttggatgccctaagtgtgactaacgtgtgctggatgccctatggtgagcactggcgagtcagggcctttgacttgatatcgtcgtacaccggccagctcagatggggtcagattgtggtgtacgttcgacctgagcgggtggcgccagactacatggagtggtttttttggatatcgcacccattcgtcacgcggaccgaggaaactgttgcgccgagacatccgcctccccctcatcatgaggagttcgtcgagccacccatccccgaggtttcagtcgcgaccgatctccctacgcattcagtggatttaggagcgattgctgaggatttggagcgggtcatcaacctcgggatggtcattgagggcactgacttacatgacatcatgactcgttgtctgaggagagctagaggtgacgctgcagatggaagtcttaggccgcgccagagacgccgcatagattag

SEQ ID NO: 22475 - DNA, 805 bp, Glycine max
  Peptide Sequence Number=SeqID_114160
atgggtgtccgtacactgcatgcgcctgatgttctcgggcaggtcgatttgtctgtgttgatgaggacgctggtcacagtgccttgcaacgaaatactggttgaggctggagcgacgctcaatggggcttttctgcaaagtggctttgtcgatgagctattgttcgagtttgctgccgatcgtgaccagatctggcaagaggcgcaggcccaaggagtgcgtgcgctggtgattccggctgtgatgcaatccacttttcaacctatcatggattggtgtgcacgccacccgcaaaccggctttgcgctggggtggcatcccctgtttgtggatcaggcccctgatgacgctttgcagcagatgcatgagacagtcactacggtattggctgggccacaggcgcagcagttgctggcgataggggagatcggcctggatttttatgtgacgcgcgagaatgaagccaagcagattgcgctatttgaagggcagttacagattgccaagcagtttgacctgccggtcattttgcatgtgcgggcagcagtggacagtgtgctcaaatacttgcgtaagcatcatatacatcgggggattgcgcatgcatttaatggcagcctgcagcaggcaacaatatttgcagagctcggttttaaattgggctttggcggtgcaatgacttggccacgcgcactcaaaattcgcaaattggcggcagaggtaccattagagcatgtggttttggagacggattccccggatattccccctgtttggctgggtcaccagggcaggaatagtccag

SEQ ID NO: 22476 - DNA, 165 bp, Glycine max
  Peptide Sequence Number=SeqID_114161
atggtgttgagtggaagacaaaggagaagaggagaggggaggcatcatccactagggaataagccatggaagaaggagtttcaccaccaagaatgtgccttggataagaagcttgaagaggatgctttaatggaggaaaagaaagagagaagggagagagcatga

SEQ ID NO: 22477 - DNA, 159 bp, Glycine max
  Peptide Sequence Number=SeqID_114162
atgagaactctccgtagattcgcgattgcggattgtggtagtttgggtgggttcacaatgcgtgaaggaatgtgcagtgatgcagtggtttccttagttttcatggaggagaaagaaaaagaagagaatagcaaaaagagaagcgaaaaagaagggtga

SEQ ID NO: 22478 - DNA, 623 bp, Glycine max
  Peptide Sequence Number=SeqID_114163
agggctacgcgcccttgccttcgtagggctacatgccctcaccttccgaggactacatgtcctcaccttcagagggctacgtgccctcgccttcgtagggctacacgccctcaccttccgaggactacatgtcctcaccttcagagggctacgcgccctcgccttcgtagggctacacgccctcaccttcagaggactacatgtcctcacctttagagggctacacgccctcggctccgaggactatacagggctacgcgccctcgccttcgtagggctacacgccctgaccttccgaggactacatgtcctcaccttcagagggctacgcgcccttgccttcgtagggctacacgccctcaccttccgaggactacatgtcctcaccttcagagggctacgcgccctcgcctttctcaccttcagaggactacacgtcctcgccttcagaggacaacatgtcctcgccctcaccttccgaggactacttgtcctcacctttagaggactacacatccttgcctttagaggactacacgtccttacctttagtgggctacacgccctcgccttcaaagggttgcacgccctcaccattagagggctacgcgttctcactctca

SEQ ID NO: 22479 - DNA, 216 bp, Glycine max
  Peptide Sequence Number=SeqID_114164
atgttatggaactttacggattgcacactaacacttccttttaatttccggcatgtcagagaacttcacggattgtgctacaacgcttttcttttggcttccggcatatctcagaacttcacaaattgcctaatgatgggtgccaagtacctcgaagtggtcaaacgagggtcgcatccctacaacgcatggtccccggacgaaattagggtatga

SEQ ID NO: 22480 - DNA, 192 bp, Glycine max
  Peptide Sequence Number=SeqID_114165
atgaccataatttgtttccgcatgtcatcgggctcgccgcctctggatgacaaaaaggcacaaaatgaccataatttgtctctgcgtgccatcagacacgatcgtttccggatggcgaaaagggtcagtatgacagagattgtgggggcggccgacaaaagcgatgctcttgctcctacgtatcctcaatga

SEQ ID NO: 22481 - DNA, 570 bp, Glycine max
  Peptide Sequence Number=SeqID_114166
atggggacaaggggttgcatcagttacaatcccgttctttctataagacaacttggctaccctatgagaggggcaccactagaggaagagctcacgcctattattgcacgaggtttcaataaaaccaacatggaggcacttcagaaggtccacaaggcatgggagatggtgcaaaagaaggaaaaggaactcaaaggcagtaacaacgggcccatcggtggctaccgtaggtggttgaaagcccacatgcaagatttggattggctcccaagattgagaaccactaaaggggtggaagttgaggctccggaggaagacgaagaggtgcaggcccttagggcggaactcgagcaagcccaatcagtcaaagaaaggttcaaatcagcagctcttaagatccaaaaggagaatgccgaactgagagatgtaaataaagctaccaccaaggccttggaacgagagaccaaaagggctagtagggaggaatacggctggaacaaatttcgaggggctctatggggcagtaacagcgagcttaaactccggagagaggaaagggaccaatcatga

SEQ ID NO: 22482 - DNA, 187 bp, Glycine max
  Peptide Sequence Number=SeqID_114167
ggtacagatgacgacgttagtctctgcgtgctactggactctgagtctgacggataacaaaagagtgtgtgcgggttaccgtatagggcgtctccgcgtgccaacagactcacaggtcacgatagtgaaaggtggggcagttgacaaaagcggggcttttgctcctacctatcctcaatcgcgatga

SEQ ID NO: 22483 - DNA, 228 bp, Glycine max
  Peptide Sequence Number=SeqID_114168
atgtcaatccttgccctggagaaaacacaaagaagaagaaaattccccaatccaagaaggggagaagacacaaaaaagagaagaaaagaaaaattcccaatcaaagagtgggagaagcaaaaaaggaaagaaaattcccgatcaaggatcggaagaaaacagaagaaacatccagaaaggtctttggaccagacaatatctgaacaatacagaattgtcaccaagtaa

SEQ ID NO: 22484 - DNA, 375 bp, Glycine max
  Peptide Sequence Number=SeqID_114169
gatacatcctttgtcgtacaagtagagggtacatctacttgggttgttgtgactgagaacaagaaaggatacatctcttgtggatcagttctagtggagggtacatccactaggttgttcaaagagaacaagggagggtacatcccttgtggatctttctttgtaaaggaatttacaaggttgaaaagaaatctcaaggaccacaggtcgcttggagactggatgtatgcacgggttgttgtcgaactagtgcgtcttccaaaaaggaaaacgcgtgggagtcgccaccaatgtttatttgaggaaaaccttaggaaaatccaaaagaggtctgcgaattttgaaaagaagggttcaggagttgtttacgcatag

SEQ ID NO: 22485 - DNA, 264 bp, Glycine max
  Peptide Sequence Number=SeqID_114170
atgtcatctgcaaaaagcatgcatctcggcgctatctcttggatttgttccgtgaggacatccagaattaagattggcactaacgtgcttctcctccattcctccggcatgcgttttgacctcataatttcattaaagagttcggtgagccactcaagacctctatctccaagagttttccacacttcaataggtatgttgtctggccccaccgccttaccgttactcattcttttcaacgcttccgttacttcctgtttctaa

SEQ ID NO: 22486 - DNA, 321 bp, Glycine max
  Peptide Sequence Number=SeqID_114171
atggagcttaagagaccctcgaaggcaatgcgagaggaacccgcgcgcacgcttcagcgcactgtggagtggatactacccacgcccacaccatatcgtctagtggagccagtccaagtgatcgaggtgacgtcatctgaggaagacccagaggagctacctcctgagcctgctgtggatgctcttgacttcctagagggtgatgaggacccactccctgaggtggattctcccgaggacgtcatgtcagtatctgaggcagactctacggaggagagaggccctggagagatggcgactagtggaggctattcatcatag

SEQ ID NO: 22487 - DNA, 129 bp, Glycine max
  Peptide Sequence Number=SeqID_114172
atgaaaattcaaaagaagaagataaaatgcaactttaataacatcaagaaaagctatgagcctgtttggaaaattattgatgagaggtgggatcatcagcttcacaggcctttacatgcaactgcataa

SEQ ID NO: 22488 - DNA, 306 bp, Glycine max
  Peptide Sequence Number=SeqID_114173
atgtcccatgctgtcaaggaccatcgagggaaatgggccccgaactacgaagggccttttgttgtgaagagggctttttccggaggagccctggggcaggatcactttgggctaccttctggagtgaagacaaaacatgaatggcagaaaccagtcaaggtacttaaggatgaacgcaagcggggatggggtcacgaccgaccgatcgttgccccttctctgtgtgaaacaagcaggaatgtcgctgcaaggcagccccgtatcctttgtcatttgcagctttcttttactatttgtttgttttaa

SEQ ID NO: 22489 - DNA, 342 bp, Glycine max
  Peptide Sequence Number=SeqID_114174
atggcacctcgccataggccggctgagtgtatgactagaggcaatccatctgacttacaaccctttgatcctgagatagataggacatttcatagattagttagacatcatttagtaccttttgagcatcctgagcatcctgttattggtgattttgagcattattattttgaacaatctgattttgaacattctgagaacatggcacaatctccaccccgtgagaggactctaagggaaatggctgcacctgatttcacctatgaaagcttgtgcatccaataccctgacaaggatgtcccatatgttcttaaaactggattgatccatttgcttccatag

SEQ ID NO: 22490 - DNA, 569 bp, Glycine max
  Peptide Sequence Number=SeqID_114175
atggcacagaagaagagcactccaatcactcctaccacatccagacggagcaaagttgcaatcccttccaagaagaggaaagaaatttcctcatctgattctgatgatgatgtcgaactagatgttcccgacatcaagagggccaagacatcagggaaaaaggtgcctggaaatgtccctgatgcaccattggacaacatctcattccactccattggcaatgttgaaaggtggaaatttgtatatcaacgcagacttgccttagaaagagaaccaggaagagctgccttggattgcaacgagatcaggacctcatcgaggctgactggtcagcctgctgaaaactggttcaccaagttgggagattgctatgaaagaaaatgtgttagattctcccctgctgtaatcaacaaatacctgggcagaccaactgaaggagtggtggatattgctgaagaagaagatcaagccacagaagagacccctgcaccaagggcaccagaacctgctccaggtgacctcattgacctagaagaagtagaatctgatgaggaacccattgccaacaa

SEQ ID NO: 22491 - DNA, 222 bp, Glycine max
  Peptide Sequence Number=SeqID_114176
atgagggtgcaacacctcacaatgggaccaaagaaaggtcgcatcatcagaatccggacgaaaattgggtatgacactaatttcgaggtactcctctcgttgaagatcgcgggtgacagaacgcatgaagaacgaatgaagaacgtcgaagaacggttgaaacctttgcgagattcctcacggaaaacgttacggaaacgtttcggaagcgcctcggcttag

SEQ ID NO: 22492 - DNA, 279 bp, Glycine max
  Peptide Sequence Number=SeqID_114177
atggggttgaacaagttccaaggggcgttgtggggtagcgacaatgagcttaagcttcgaagggccaagagagaccaattgagagtcgaaggcatggtattggaagacaagttgaaggattgccaaaggtcaaaaaggagtttgtccaagcaatcgagcaagacagaagagaacacgtgggccatcatcgaccaatacaaagagaagctaagtctagcagtagcccatgaacaaaggctagaggacgagtatgcaaaagtgtcgatcctacaagcataa

SEQ ID NO: 22493 - DNA, 180 bp, Glycine max
  Peptide Sequence Number=SeqID_114178
atgagagcagaagatgcggaggggcacggagtcgccagtgaagaagcggacggagagcgcccgtacgagaaacctatggatgtggaagagtgtgaatggggaagagcggatggcgatgctgctgagaaccacggttggcgcagtgaagggaatgacggggcgttgcgtgatgactggtga

SEQ ID NO: 22494 - DNA, 81 bp, Glycine max
  Peptide Sequence Number=SeqID_114179
atggaggaaaattggaaagtgaaggagatttggaaacgcggaaattacgcggataatgtagatgaggctgatggttactga

SEQ ID NO: 22495 - DNA, 813 bp, Glycine max
  Peptide Sequence Number=SeqID_114180
atggcgtcttcattatctgctcaattggttcaatgtcagaattcacttccacctcttcaggctaactttagccaagatgtgtctaaggttcaaaggtcacatgtggtatgttgcggtaccaaatcaccgattggttatggtaaaacattggcatcaagatcacataatgccctgaggttttctgtcacgcaacaatctgtagcaaggtcaattcgatataggagaatgacatgtgtcaatgctgcagatagtaagttggtggtgaacctgtgggcaggattgttttgggcctatttggagaggttgttcctaaaacagttcaaaatttcagtgctttgtatacagatcaagctgaacagtctttgtacagatgagaaaggatatggttacaaaggaagctccttccatcgtataatcaaagatttcatgattcagggtggagactttacagaaggaaatgtgagctctgttatagttgtttgtatgcctgcatatatggaactggtggaattagtatctatggtcctagttttaaagatgagagttttgccttttcaacactttcttgctgtgaagcatgtcggtcctggaattctgagcatggcgaatgctggtcctaataataatggtagtcaatttttcattttcactgtaaagactctatggctagacaattggcacgttgtatttggacatatcattgatggaatggatgttgtgaagacacttgaatcccaggagacgagtaggtcagatgtccctcggaaaccttgcagaattgttaattgcggagaactgcctatagagggttga

SEQ ID NO: 22496 - DNA, 274 bp, Glycine max
  Peptide Sequence Number=SeqID_114181
atgacattagaagaggggaaggtgaagatcgagaagttcgatggcagagattttagcctttggaagatgcagatagaggattatatatatcagaagaagttgtatcagttgtatcaacccttgtcaggggataagccagacgacatgaggcaagaagaatggaacttgctagatcgacaggctcatggcacattatcagatatgtacgagaagccgtctgtagccaacaaagtatacttgatgcatcggttgttcatcctcaagatgggagaag

SEQ ID NO: 22497 - DNA, 492 bp, Glycine max
  Peptide Sequence Number=SeqID_114182
atgggggcaataggcattcacatccaaagctgtatgcagacaaaattaagtttgtccaatgcggaagagaggaatgccaacaaatcgaatcagatggaagcggaaattggcgttatgggaatggttagaattggatcgaaacaagaagtggggcgaagaaaaagaggcatatttatcgatggaaaacataaaggagtgattttgcatagcgtaccagtactattatatgaggggttttcggatttgcttctgagtgggttcggtggttctgttctgagatgcttcttctgcttcgttcttcccacactgagagagagactcagatgtgtgtttatccggcgaatcctccttttccagatgccccttaaaagagacaatgctaagaaacgatcaatctcacttgacgaagttgtacccgcatgctccaccaactatttatctccacgtctcccgaaattgtcctgccttgacaatcatctactgtaccattag

SEQ ID NO: 22498 - DNA, 312 bp, Glycine max
  Peptide Sequence Number=SeqID_114183
atgtcctacaaggatggtagcaaaaacagaaacgaaaatggaatcactatgaataacgagaagtatgtccgttacatgcctaagcaggttgaagccctagaaagcaactcattcgcaagtgccctattctctccaacattgagcccaaacaaatcaagctctggttccaaaatagaagatacctaccctaaggggagaaggagttggatggcgtggtggtggcgatggatgatggtggtggtggtttctgtcgaagaaggggaagaaggaaaatggaaagaaggtgatgatgtggcattgaggtgtcaatga

SEQ ID NO: 22499 - DNA, 162 bp, Glycine max
  Peptide Sequence Number=SeqID_114184
atgagttgggtttggttaagtggtgaaaaggagagaggaaacaaggaaggagggatgaatcaacgatcggattgggaaggtatgctgctattatgttggtggtacttggttgagagtaacgcaaggaaaaaaaaaggcgggttagtgagaaaaacgccatga

SEQ ID NO: 22500 - DNA, 680 bp, Glycine max
  Peptide Sequence Number=SeqID_114185
atggttggccccattgccacgttcggtaaaggaaaccgcatgaagcatcttgaaaagaaagaaaatgaggtaaaggaagaaggtattatagagcatcgctctctcactgctccagcaagcaaagtcactagcaagacagtaaaaatgaatgtcatggtagccgtaacggttggataccaagcttactttctaaaactaaaagacatggctaacccacccccagttcgtccatggtttcgcttagcctcaattcgctctagcccacccccacccccaccccctgcacctgcccctgcccaagagccacgcctgccagcatttagaactgcttcagcaccatcatcaccacagattcagccaactcaaccagctccccagcctcaagaacacccttcttctcaacataacagattctcctcttcttcactccctacttccccagagaataaaaacattacccgtgttcccttgccaagtccctctcactctccaaacacctcacctcccccctctcctctcgccctcacaccttcccagtcgaggagcgagaccatgatacccgaccagcccgagcccaaaaccgtgctagtccagaaaaccatcgaccccaggcccaagccctggcacaatgcccgtcacggacaacacgacaccgtcaaagaaagtgatccaaggagaag

SEQ ID NO: 22501 - DNA, 2355 bp, Glycine max
  Peptide Sequence Number=SeqID_114186
atggaaatgagtttatatgaagatctgattgctgcctgggtacctgcaaagcatgagtggctgagaaagcgtcctttgggtgaagaactagtcaataaattgggaaagaggaagatgttcagctaccgtgcttatgacttgttgttcttgcattttggcacctcaaatgaagttttagatcacctcagtggtgttggttcagaactggttggtagaagacatttatgttctattccagcaaccactgcatctgacattacagcatctgctattattatttctagtaaaattgcacccggtgtctcaattggagaagattctctcatatatgattcatccatctgtggtggaatacatattggctccttatgtatagtggttggtgtgaatatctctctagacaactttttaagtgttgaaaaatcaatcaagttcatgcttccagatcgccattgtctttgggaggttcccttgattggaaatagggagcgagtcctagtatattgtggccttcatgataaccccaaaagttcactttctaaagatggtacgttttgtgggaaaccttggaagaaaattttacatgatttgggtattcaagaaagtgatttatggggctcctcaggccctgatgaaaagtatttatggaattccaaaattttccccatacttccttatgcccaaatgatcgaggtagcaatgtggttgatgggcttagccaatgaaaaaagtgaatccatgcttcctttatggaaatattctcagcgcatcagtttggaggaattgcatagatcaattgatttttcaacaatatgtatagattctagtaatcatcaagctgatcttgcggcgggaattgcaaaagcttgcatcagctatggaatgctggggcgcaatttgtcacagttatgcgaagaaattcttcaaaagaagggtcctggagttgagatatgtaaggaattcctagctatgtgtccaatagtcaggaagcaaaactctaatatacttccccaaagccgggcataccaggtggaagttgatcttcttcgtgcttgcaatgatgaagggacagcatgcaagttggagcacaaagtttgggctgctgtggctgatgaaactgcgtcagcagtaagatatggattcaaagactcttatgagtctacgagtcgacttgtagaagctctcacgagtctgcgtagactctcgatattgataaccttgatggtggaacatttatcagagtctcctggtagcctttcctgtcaggagttccagaataaccaacatgataactgcactcatctgcctttccatcctagaagggtagaagtagaattaccagttcgtgtagattttgttgggggttggagtgatacccctccatggagcattgaacgtgctggatgtgttttgaatatggcaataagcttggaaggttttcagccaattggcaccatcatagagacaactaaaacagaaggaatattatttactgatgatgcagagaaccaattatttgttgaagattatacatctatttgtgcaccgtttgatggagatgatccatttcggctggtcaaatctgcattacacgtgactggaattattcatgataacattcttgtagatatgggcatgcacatcaaaacatgggccaatgtcccccggggcagtggattgggtacttctagtatcttggctgctgcagtggtgaaagggcttctccaagtaattgatggggatgatagcactgagaacgttgctagacttgttttagtgttagaacaacttatgggtacaggaggtggctggcaggaccaaatagggggtttgtacccagggattaaatgtacttcaagctttcctggaattccacttcggcttcaagttgtccctctgttggcttcacctcagttgatttccaagttgcagcaacggcttcttgtggtatttactggtcaagttcgacttgcacataaggtgctgcagaaggtggttgttagatatcttcgccgtgataaccttcttgtatcgagtatcaagcgccttgttgaactggctaagattgggagagaagctttgatgaactgtgacgtagatgaacttggtgagatcatgctggaggcttggagattgcatcaggaacttgacccttactgcagcaatgagtttgttgacagactattttcttttgccactccttactgctgtggctacaagctggttggagctggtggtgggggctttgctctgttacttgccaaagatgcacagcttgccaaggaactgagacagagactagaagatgacaaacattttgaagtgaaagtatatgattggcagatattcctatag

SEQ ID NO: 22502 - DNA, 240 bp, Glycine max
  Peptide Sequence Number=SeqID_114187
atggcggcgaaggacttgaaggggggtttcgtcggggtgtgtttggaccttgatggtgcgaccattggaatagtggtggcggaggggggagggaagggtgaggaattaggttttggagtcttagggggagagggtggaggaggtggtgaagagatgcccaggattcaataccttcaaacttggataagaagggaattgtgtatgcctcctctcctgtttcatcatatgttggtaatatga

SEQ ID NO: 22503 - DNA, 222 bp, Glycine max
  Peptide Sequence Number=SeqID_114188
atggaattcgaaagcagcgagtacatgccaccatgtcagaagtcaaaagcatcatcgacaatggtgcacaccaaagagcgatggatgtggaactcaacaagcttttgtcgcggcacaccgaccttgatcgccacctcctccagttctagcgctcctctgacgtcttcgacatcatccactttgacgcccgactacatgctctccaacttcgcacctctatga

SEQ ID NO: 22504 - DNA, 777 bp, Glycine max
  Peptide Sequence Number=SeqID_114189
atgtcctgtagtataggtttgttcggcgtgataaaacatttgattgtgacacaagttgtttgtcactcattattcaaagaatgctcttttagcacctcgtttttgaaaggttgttgtgctatccccatcaccgatacatcagaggaattgaatgagacacgagatgaatttgaagagattgaagattgtggtgaagaggatgatgattgtggttgttctaaatctgaatctaaagatgataccttgttggttgacaacttagaaggcaatttttgcgaagaaagtggtgaacctattccaattattataaatggtttggtggaaattacatttgtgtgttctagacaaggtgttcataaggataggaggttgactgcaaaaactaggaagcatgagccaagaaatgatataagatgcaagtgtttggctaaatttgttcatgtcaagaagaatcatggtaggcggggagttaaggagttcactaatgaccacaaacatgagttgttagaaaaagattattgttctcttgtaccatcccacaagaagatgacaccaggtgatgtattgaaaattaagaatctaagaaaaactgacataatgactcctcaaatatttggttctttagccaacatttctggtggatatgacacgcaatttatcgatacaatgaaagggaaggcactagtgttcataataactgatggggatttggctatgaaaaatgcaattgaggtagttttcctagtgcaaatcataagctatgcacatggctcctaa

SEQ ID NO: 22505 - DNA, 948 bp, Glycine max
  Peptide Sequence Number=SeqID_114190
atgattgatgcagtggaggatcctgtggattctcacaaactaaagattgacactagtaactctgactgttttgaatccccaaatcatactaacgccatcatgcaagaaggtgaagagttaagggtcagtttatctccatcaagtcaaggtgattcccagggcatcccgtataagaagttatctgcatctgcagctccattcaatccgtcgccaggcattgcacgtgctgcaccatttgccatgaatacaacacttccttcggctgctggtgctgtttcaccaattggcccatggccagtaaatatgaatgttcaccatggacctgctaccatgttacctgcagttatcccaatgtgttcctctcctcaccatacatacccatcacctccaccaacaccaaacatgatgatacaaccgttgccatatatgtatcctccttacactcagcctcaatcaataccaaccaacaattttccagttactagcagtggatttcatgtcaatcagttctcatggcaatgtaatatgaacccagctgtatctagttttggtcccaatgctgtctggcctggttgtcatccaggggaatttcctcttccagcacctagcatcaaaccaatccctgatcccattttggagccacaaaaacagtgtcatgacattaataatgtcagtgaaaacaagaaagatgtgcaagctttagaatcagagactagtgatgatgaagtgggtagagttaatgcagaaagtgtaaaggaaaatggaaatcctaattttcatgggtttgaaaatgctgcgaacaaaccaaatcgtaacattggcttgaataacattagcagaaatgaaaagaacattgatggttttatatataaccgtgtggtcagaggaagtgatgtacccaagtccatcagcttgtcttctagaagggattgtacagctactgcttaa

SEQ ID NO: 22506 - DNA, 1368 bp, Glycine max
  Peptide Sequence Number=SeqID_114191
atggagcagaagaggagcagtagcaagatgtacaacctgtttgtgaagcacttggacgggaaaaccctaaccctcctattcccctctccgatcctctacgcgagttccatcagggatcgcctcttccaactcaccggaatccccgcccaccaccagcgccttgttaccggctgccgccacctcaacgacgacaaatctgccatccaatgcctcccggaggacggcaacatgttcccctccgtgcgcctcctcctgcgcctcaagggcggcaagggaggcttcggctcgcttctccgtggcgccgccaccaaggccgggcagaagaagaccaacaatttcgacgcgtgccgcgacatgagtggccggaggctgaggcacgtcaacgcggagaagaggttggaggagtggaaggccggagaacaggagaggaagctcgagaaggtggccgaggagtttctcaagaagcagatgaagaagggaaagggtaagggtgaaggtgagggtggggctcaaaaatatgtcgccaaatatagggaggaatctgaacgttgtgttgccgaggttgccttgtccgttaaggaggctctcactgccaagcgcaagagcccttcacaacctcaccatgatgctaagaaattgaagatatggatggggaagaggaaattgaatgaaagtgatagtgatgattctgatgaagaggtggagatcgagaaatcagatttgttgaatggtccgaatgagtcgggctctaataaggctgagggcagtttgggttcggtaaatgggggcggaggctcttctggtgctggctcgtgtgaaagtgggtctgaagaagagaaggaagctgctgtagaaggaaatgtgggatctgttgcgatgctgggtggtgaaagtattcaggctgcagctgaacctgtgataaatgatgaggctactgaaatgccaaaggagtcggtggttgctggaattaatgctgaagataatggatatcaggattgctatgtaggcgtgcctgacaagttcgatggtgctgtgaatcaggcctcaactgttatgggctctgaaactgtcgccagtgctggtgaatctaattatatggaaattgatggatctcttgagcataaagcagcagtcaatgaagaaagctcaccaagcactagtgttcctgtgttggaggagcccctgaattttgatgcctttaattcagctgctgaacttgaggttcttggcttggaaaggttgaagtctgaactgcagtcacgtgggttaaaatgtggaggtactttgaaggagcgtgctgccaggctttttcttttaaaatcaactcccctggatgaacttccaaagaagctgcttgcgaagaagtaa

SEQ ID NO: 22507 - DNA, 921 bp, Glycine max
  Peptide Sequence Number=SeqID_114192
atgtataaaaagttagatggatcctttaatgttaagctttcctaccgactgattttgcctagagttgttctggaagcatcaccagcagtgctgttgggaaaggaaaaacaaaggaacaaagccattaaccttatagtaacagagtgcaaggaaatgggatatgatggtattgttttggaatcttggtcaaggtgggcagcttatggtatcttgcatgatccaagcatgcggaatttggtgacagttaaaactatgaactctatttcggagaactcaactaatctctctcaggcattgcagtttgtaaaacagcttggagatgcactgcattctataagctcagagaaaattagtgggcagcagctgcagttggtctatgttataggttcaccttctgagaagttgcaagagcatgattttggtcctaaagatcttgagactttaagtgaagctgtggatggattctcgttaatgacatatgatttctctaatcctcataatcctggtcctaatgcacctttgaaatggattcaaattgttctacagctgcttctcggtacctctggcaatagagcccaaagccttgcccccaagatacttcttggtatcaacttctatggaaatgatttctccctttcaagggtgaaagttaagaatgcagatgcagatgcagggggtggagctattattgggagagattacctggcacttttggagaagcactggcctgaactgcagtgggataagaatagtggggagcattttttcttttacactgacgacaaggatatcaggcatgtggtattttatccatctttgaagtcaatttctttgcggttagaggaagctcgttcatggggatgtggcatctcgatctgggaaattggccaaggtctggattatttttttgaccttctgtga

SEQ ID NO: 22508 - DNA, 276 bp, Glycine max
  Peptide Sequence Number=SeqID_114193
atgtggaccatgatgagatcgttgatgaggctaagttggctaactacttcacttatacttatcatagatctattttccttccgattaaaagatgcagagaagtgtgatctatttgtgggagattgggtggcggagccaaatggtccaatggacactaatgagaacagccgtgtgattgaagatcatcaaaactgcatgaggaatggacggcctgattcggggtacctttgttggaggtggaacccaagggcctttattggtgattccttcacatga

SEQ ID NO: 22509 - DNA, 429 bp, Glycine max
  Peptide Sequence Number=SeqID_114194
atgcttggcttcttggaaacaacaacaacagcaacgttagaaagggaagggtcgaaggtggtgatgtcgttaaacaacaacgctttcgttcagaaagtgaaagcaatacattcatacgctcggagagagagagagagagctattttctcgctttttcttttgcagctgcagctgctgcttcttcttttgggttttctaagtatttttctaagaatccaaacaccaaagacaaggaaaaataaaaagaaaggagaaggggcgtactggtcctatggcaacgaggagaaacaaccaaataattgtgtccaaaaaccgaaagtgaaacgacgtcgttcagaggtaattttggctacatgtgcattgggaatgatggaagtagtggaactgcgtctgttagcaaagattattattaaagtgaaatcaggatag

SEQ ID NO: 22510 - DNA, 207 bp, Glycine max
  Peptide Sequence Number=SeqID_114195
atggaagaaaaatcatctgaatttatctgggtgaaaattgaatacctgggggagaatcttggtctgtgtaaggagtgcgttgtgttggatcctggcgaggttgagtttgttattgttattattgggttgggtgcaagttggagagtgagagagaaagaaaagaaaatggttgtgcgtgtgacttggcactttggtgcagcagggtag

SEQ ID NO: 22511 - DNA, 1257 bp, Glycine max
  Peptide Sequence Number=SeqID_114196
atggcttcggagacgaaggtcgtgaatctggctgaggaagccaagctcgccagagaaggtgtaacgactccctcatatgcttttaccaccatctgcaagtccctcgtcgctggtggagtcgccggaggagtatcacgaacagcagttgctccactggaacgcttgaagattttgctacaggttcagaatccacacagcattaaatacaatggaacaattcaaggtctaaaatatatatggagaactgaaggttttcgtgggctgttcaaaggaaatggtactaactgtgcgcgaattgtcccaaattctgctgtgaagttcttcagttatgagcaagcttccaaaggcatactacatctgtaccggaagcaaactggaaatgaggatgctcagctgactcctcttttacgtcttggggctggagcatgtgcgggaataattgccatgtctgcaacttatccaatggacatggttcgaggcagaataactgtacagacagagaagtccccttaccagtacagaggaatgtttcatgccctgtcaactgtactcagggaagaaggtccacgtgctttatataagggctggcttccttcagtcattggagttattatgctttcactattggctttttgggaaattcatattgcatctggtagtaacaatgtaggacctgtaggctgcagttgggggagggggagaacctatacagcactaaagatttcaaatttgtcgagtgctagacaatgtctaccctccttaggggacaatttaataggattgctttctaaggctgcttatagatgtgggatagatagcgtctattcaattccttatgtgggtctcaactttgcagtgtatgagtctttgaaagattggttaattaaatctaatccattaggtctagttcaagattctgagttgagtgtgacaactcgcctggcttgtggtgctgcagctggaactattggacaaactgttgcttaccctcttgatgtcattcgtcgaagaatgcagatggtgggttggaaccatgctgcttctgttgtagctggtgatggaagagggaaggtaccacttgaatacacaggcatggttgatgcttttaggaaaactgttcggtatgagggatttggcgcattatacaagggtctggtgccaaattctgtaaaggtggtcccatccatagcaattgcatttgtaacatatgaggtggtgaaggacattttaggagtggagatcagaatatcagattga

SEQ ID NO: 22512 - DNA, 885 bp, Glycine max
  Peptide Sequence Number=SeqID_114197
atggaagctagattcagtgagcggaaggttgtcacttacaaacatgtcaaacctggtgacattttgaatgcagcaccaaaggtagttcggatttctgtgatggatccctatgccacagatgacgaagatgaagatgaagggttggttattcatccaagaatgaagaagtttgtgaatgaaatcagaattgtggagaagagttcaactaactgtgagtctgcaggtgtaaatcgtactagtaatgtgtcgctgagacagcattacaagggaaaaactggagatagtcttgaaaaaaagaggcttagaggagttcgtcaaaggccatggggaagatgggcagcagaaatcagagatcctgtgaagcgaataagggtgtggttagggacttatgacactgctgaagaagctgctatggtttatgacaaagcagccattgcctttagaggctctaaagctctcactaatttcatcaagcctcctacaagggaagatctttgtgattgtggccctaatgaaactgaggctagtgtggctgtgagtggtgagaatgattcaagtgaagagtctcatttgtcttcacctacttctgtgcttggacttcaatctgtggaacttatgttggatgaggtttctgaaacagatcttccaagcaaagaagagtcaagttctcaagacagcttcttgtttttagattcacattcaccgtccattgattgttatttcaattttgaaactcttccaccagtgtttcttcatgaaactagcataacacagcagcctgatttccatgacaaattcagtgacatttcccatcttgtcaatgaggattttcaatcatggaattgggatatagatagttacttcagtgatcctttgttgatctga

SEQ ID NO: 22513 - DNA, 2829 bp, Glycine max
  Peptide Sequence Number=SeqID_114198
atgtctgtttcccatcgacgcggagttattctgcctaaagctggttttgacttggtagccgattcagtattaatcaaatacgaggctgctcatcccgacccgttccattgcaagaaacagaacatggccctttcaaaagaacttatgggtttttcctcatttttttctgcttcctccaaagtgtttctgcacaacaagcatggcaccttctgggtcaatcctatcttgcttccttcggaaaacccacgagttatgaggttgaggaagggtgcaaagtttccggtggcagctatcagtgaggatttgataaagaccacactgacagtgcaagcagagaaaccagtacaattcaaggtcagagcggtggtgacagtgaggaataaaatcaaagaggatttcaaagagactatgttaaagcattttgatgccatcaatgataggataggaactagaaatgttgtgctggagcttatcagcaccgagattgatccaaaaacgaaatctccaaagaagagcagcaaagcaacgctaaaggactggtcgaagaaatccaacgtcaaagcagagagagttaattacacaactgaattcattgtggactcgaattttggagtccctggagctattaccgtgacaaacaaacaccaaagagagttcttcttggaaagtataaccatcgaagggtttgccagtggagcagttcatttcccctgcaagtcgtgggtacaaggagagaggatattcttttctaaccagacatatttacctggtgatacacctgctggacttagagtattgagggagaaggagctgataaatcttagaggtgatgggaaaggagttagaaaattatctgatagaatatatgatttcgatacatacaacgatctgggaaatccagatgaaggagttgagcttaccagaccaactctcggtggatcccaaaaccatccatacccaagacgctgtcgtactggccgcgcccccactgatacagatatgcatgctgagagtcgtgtggagatgccactgcctatgtacgtaccaagagacgagcaattcaatgagtctaagctgaacacattcgtaatcaagaggctcaaggcagtgctccataacttgatcccgggccttaaggctagtctttctgctaataaccatgacttcaacagattttcagacattgacgacctttacagtgatgaaattttgaataaaattcctttgccacaagtgctcacaaagatacaagattgcggccggggacttcttaagtatgacactcccaagattatttccaaggacaaatttgcctggctgcgagatgatgaatttgcccggcaagcaatagcaggagtcaaccctgttaacattgaggggcttaaagttttcccaccggtgagcaaacttgacccggaaatatatggccaccaagagtctgcactcaaagaagagcatattctgggacaacttaatggcatgaccgtgcaacaggcaatagtggaaaataagctgtttatgataaattaccacgatgtctatgttccatttcttgacgagatcaatgcccttgatggtagaaaatcctatgctacccgcaccatatttttcttgacaccacttggcactctcaagcctattgctatagaacttagcctcggaccaagttccggatggaaacgtgtagttacccctcctgtggatgcaactacaaattggaagtggcagcttgccaaagctcatgtttgtgccaatgacgctggtgtgcaccaacttgttaaccattggttgcgcacacatgcctgcatggaaccatttatattgtctgctcataggcaattaagtgcaatgcatcctgtttttaagctgttggatccacacatgaggtacacattagatatcaatgctttagcccgtcagaaactgatcaatgctgatggaatcattgagtcttgttttactcctgggcggtactgtatggagatcagttgtgctgcatacaaaaacttgtggcgctttgacatggagggcctccctgcagatcttatacgcaggggaatggcggtacctgacccaacacaaccaaatggtgtaaagctcctaattgaagactacccttatgcaacggatggacttctgatctggtctgcaattgaaaactgggtccgcacctatgtgaaccactactaccaccattcaaattcaagcctgatttgcaatgacaaagagctacaagcttggtactctgagtcaatcaatgtgggccatgccgatcttaggcatgaaaggtggtggcccacattgaataatagcgaggatcttgtgtctatccttaccaccttgatttggacggtatccgcacagcatgcagctattaattttgggcagtacccttacggaggttatgtgcccaatcgtcctccgttaatgagaagattaatcccagaagcagaagtcgagagtactagtactgaatatgccaatttcttagctgatccccaaaagtttttcctaaatgcgttgcccagcgtgttacaagctacgaaatatatggctattgttgacatcctctctacccactcatccgacgaggagtatttgggagagcggcgacactcatccatttggtcaggtgatgcagagatcattcaggcattctatagcttctccacagagatcagacggatagagaacgagattgagaaaaggaaccgtgatccaacactcaggaaccgttgtggcgcaggggttttaccttacgagttacttgcacctacctctcaacccggcgttacatgtagagggattcctaatagtgtgtccacgtaa

SEQ ID NO: 22514 - DNA, 1515 bp, Glycine max
  Peptide Sequence Number=SeqID_114199
cacaagaatcccgaagccgacattgccaaccctttatttcccgccaattccctcaatccgttccaatccttcaacgccgccgtcgttctcggcgacgacgaagacgacgccgtccaagactccccttccccttcctccgtgcaaaaattctcccaagattcactcgacagcatttcctcttccttcggtttctcctccggcgctgccggagccgtccatcaccatggcgccgatgttcatgaccccgtggaacctccccgacgggcgccggatctggaaggcgctgaagcagggcgtggcgtcgtcggcgtcgggggagaacatgttgctgatgaggaagcgcacggtgccgacaaggtggtggcggaaggtgccgacggcgtagatggcgacgcagacgctggaggtgtcgccggcgagaaagtcctttgtgacgccgaagaggaacttgtcgttccaggtagggttgtggccgccgagcttgtcgacgcgtgttcggagcttggtggcggggtcgatccacgtgacggcgtaggtttggagcctccgccgtggagacgaaggcggcttcatgccctgcgcagagatcaagttgatctccaatacttgaaagaatcaacggttgtgactccggtggaagaaagaggggtgaaacagaaacagaaagctagcaatggcggagacatagtggtttactggggccaagacgagagcgagggcacattgagcgaaacatgcaactctggactatacaaaatagtgaacataggctttctggcaaaatttggcggtgggcgggaacccgaaataaacctagcaggacactgcgaccctgcatcaaacggttgcaaaagtttgagcaaagacataaagaattgccagaagaggggcataaaggtgattctctcaattggaggtggcgagacaggttactccttgtcgtccgctaatgatgctacaaaggtggcagattacatatggaacaacttcttgggaggaaaatcatcaaagacaagaccattgggtgatgctgtgttggatggcgtggattttgacattgaagttggtggcggtgaaagcttctacgctgtgcttgcgaggagactctctcagcacagcaaaggagggggcagaaaagtgtacttaacagctgcaccacagtgtccattccctgatgaacaccagaatggagcactgtcaacagggctctttgactttgtttgggttcagttttacaacaatggtccatgtcagtttgagtctagtgaccccaccaagttccagaaatcgtggaaccagtggatctcgtccatcagggctaggaaaatttatgttggacttcctgcatctccatcgccagctacggctggtagtggctttgtgccaacacgaacgctcataacacaagtgttgccttttgtcaaaagatcgcccaagtatgggggagtaatgctctgggatagggctgctgataagcaaaccggatattccaccaacatcaagcccagtgtttga

SEQ ID NO: 22515 - DNA, 5239 bp, Glycine max
  Peptide Sequence Number=SeqID_114200
atggcggcggaatcattgcaatctctcgtttccctctccgaattggtttccacttcctccacgaaccaccgtgttcggatattccgtcgcgaaatccctgcgttcttgaattcctctacttcagaaatgtcaacggagctcgcttcgttactcaccgatataatattcagaacggttgcgatttacgatgatcttagatcgaggaaagccgttgatgatgtgattgtgaaagccttgggtggaacggtgttcatgaagacttttgcaggagctctcgttcagaacatggaaaagcaatccaagtttcaatctcacttgccggatatttataaagtctacatggaagagcttagaaatggccgaattcctttcaaggatagtccggaattattaatgctgttgctggagttctcaagtcgatctccgtctttatttggggaattcaagccagcatttcttgatatatatgttaatgcaatactgagtgcaaaagaaaagccaggaaagagtcttactgaagcatttcatccactttatttgcaaatgtcacatgaagattttcaaagtattgtgataccatcctctgttaaaatgctaaagcgcaacccagagattgtgttggagtctgttgggattctgttgaagtctgttaaccttgatctgagtaaatatgctgctgaaattctttcggtagtattagcacaggctcgacatgctgatgaagggagaagggatggggcattagctatagtccagagtctgagccaaaaatctagcaatccggatgcattagacacaatgttcaatgctatcaaagctgttattaaaggaaggctggcttttccataccagagagttggaatggtgaatgcgatacaagaattgtcttatgcacctgatggaaaatacctcatcagtctgtctcgcacaatatgtgattttcttctatcatactacaaggatgatgctatagcttcttgggcagttagatctacagatatcattcaagagagtttggtttcctttttggcttctggcctcaaagagaaggaaactttaagaaagggttttctgcgcagtctacatgctatatgcaaaaatgaagatgctgtcttaaagatgttacctttgattggcactcttatgcaacttgttaaaactggctttacaaaggcagtgcaacgtttagatggcatatatgcattgttactagttgcgaagatagctgctgttgatatcaaagctgaggaaacattggtaaaggaaaagatatgggctctgatatcacaaaatgaaccttctgtcgtgccaatttctatggcttcaaagctttcaattgaggataacatgacatgcgttgatctacttgaagtgcttcttgtggaacatttacaatgtacattgtccaatttctcggtcagattgatgttacagttaatgatcttttttatgtgtcatccgagatgggatattagaagaatggcttatgatgttgccaggaagattatcccatctgctccacagttatctaaagatctattgttggaattttcgaagtaccttactttgattggagagaaacatttagctttaaaaacaagtgattctgatatttctttggaccctcaagttccgttcattccatctgttgaggtgttggtaaaggctctgcttattatgtcaccagcagctctgaaacatgctccagaatcatttttcagaataatactttgctcacatcacccgtgtgtagttggtggtgcaaaaattgatgcagtgtggaagaggctctccaagtgtctgcagacacagggttttgttgtcattgatgtcatttcagctaacgtggggaatttcttacaggtcttactgggaccaatgggcttgaagagtgctaatccactagaacaacaggcagcgatattgtcactgtgtaacttgatgtctataatccctggagatacatatatagagtttgaaaagaatttgctaaatcttcccgagcggtttgctcatgatacacttttggagaatgacattcagatcttccttacgcctgaaggaatgctttccactgagcaaggggtttatgttgctgaatctgttactgcaaagaacacaaaacaagcaaagggtcgcttccggatgtatgacgatgaagatggcgaggatcatacacgttctaatcattctgtgaggagagatcaacctagtagagaagctgctggtgcagggaaaaaggatactgggaaggctgcaaagaaggctggcaattcacctaagctgctttttacttatgatgttattgtgattcatttagacaaagggaagacggcaaaggaggaggcaagagaattgctacttaaggaggaggcttctgtacgtgatagagtccgtgaaatacagaaaaatctgtctctgatgctaagaactcttggagatatggccatcgctaattcagtttttgctcatagtaggctgccttcaatggtcaagtttgtcgaaccattaatgcgatcgcctattgtaagtgatgaggcttttgaaaccatggtgaagttagcaagatgcactgctccccctctatgtgattgggcccttgacatttccactgctttgcgcttaattgtgactgatgaagttcatcttctgttggatctagttccatcagttactgaagaggaattcaatgaaaggccacatggcctttttgagcggattttagatggcctatctatttcttgcaaatcaggagcacttcctgtactttaccatgtactcggtgttgttccagcgtatcaagcatcgataggacctgcactaaatgagctgagtcttggtttgcaacctgctgaagttgcttctgcactttatggagtttatgcaaaagatgttcatgtaagaatggcatgcttgaatgcggtcaaatgtatccctgctgttgctaatcgttctctacctgaaaacgttgaggttgcaacaagtatatggatagcattacatgatcctgagaagtcagttgctcaagtggcagaagacatatgggatcattatgggtttgattttggaactgacttttcgggactttacaaagcactttctcacattaactacaatgttcgtgtggcagctgcagaagcattagctgctgccttggatgaacatccagattctatacaagagtccctttccactttattttcgctgtatattctggacatgggtgttggagatgacaatgttgatgctggttggctgggtaggcaaggaatagctttagcattacatgctgccgccgatattttgaggacaaaagacttacctgttgtcatgacatttctaatttcgagagcactggctgatctgaatgctgatgttagaggcagaatgattaatgctggtatattgatcattgataaaaatggaaaagataatgtctccttgttattccccatctttgagaactacttaaacaaaactgctccagacgaagaaaaatatgacttggttcgtgagggtgtggttatcttcactggagctctggcaaaacacttggcaaaggatgatcctaaggttcatgctgttgtggacaaattgttggatgttttaaatactccttctgaagcagttcaaagggcagtctctgcgtgcttatctccattaatgcaatcaaaacaagatgatgcagcagctctttttaatcggctgatggatcaaatgatgaaaagtgaaaaatatggagaacggcgtggggctgcttttggacttgcaggattggttaagggatttggtatctcctgcttgaaaaagtataggattgtgattacacttcaagaaagtcttgctgaaaggaattctgcaaaatctcgtgaaggagctttacttggatttgaatgcctttgtgaaacacttggaagaatatttgaaccgtatgtgattcagatgttaccactacttttggtttcgttctctgatcaagttaatgcagtcagggaagcagctgaatgtgctgcccgtgcaatgatgtctcaacttagtgctcaaggagtgaagcttgtccttccatctctcttgaaggagaatttatgtttgcttcctacttatagaattatcatttactatgcttctatttcaatgaactatttcatagctaatctatttgctcagggtcttgaagataaagcttggaggacaaaacaaagtagtgtacaattacttggtgctatggcatactgtgctcctcaacagttgtctcagtgtctccctaagattgttcccaaattgactgaggttttgactgatacacatcctaaagtccagtcagctgggcaaatggcccttcaacaggttgggagtgtgataaagaatccagaaatatctgctcttgtccctactctacttaagggacttagtgatcctaatgagcatacaaaatactcccttgatattcttcttcaaacaacctttgttaattcaattgatgccccttcacttgcattattggtaccgatagtacatagaggtttgagggaaaggagtgctgacactaaaaagagggcagcacaaatagttggaaacatgtgttccttggttacagagccgaaggatatgattccatatataggattgttgcttcctgaagtaaaaaaggttcttgtggatcctatccctgaagttcggtcagttgctgctagagccattggatcccttataggaggaatgggcgaagaaaatttccctgatcttgtcccatggttgtttgacacactgaaatctgataatagtaatgttgaacgctctggagcagctcaaggactgagtgaggtcttagctgctcttgggattgatttctttgagcatgtacttcctgatattattcgacattgctcccatcaaaaagcatccgtacgagatggatacttgaccctgttcaagtatttgccacggtcactgggagtccagttccaaaactatcttccccaggtgctgcctgctattctagatggtcttgccgatgagaatgaatccgtacgagatgctgccctaggagctggccatgtcctggtcgagcattatgcaacaacttctctaccacttctccttccagctgttgaggatggcatttttaatgatagttggcgtattcgacagagctcagtcgagctgttgggtgatctattattcaaagttgctggaacttctggtaaagctttgcttgaggggggcagtgatgatgaag

SEQ ID NO: 22516 - DNA, 1077 bp, Glycine max
  Peptide Sequence Number=SeqID_114201
atggctgtacccgtcgaggaagccattgcagctctatccacattctcgctcgaggatgagcaaccagaggtgcagggacctggagtgtgggtgtcaactgagagaggtgcaacagaaagtccaatagagtatagcgatgtttctgcttacagactatctctatcagaggacacaaaagctctcaatcagctgaatgcccttacccaagagggaaaggagatggcatcggtgctttacacatatcgcagttgtgtcaaagcccttcctcagctacctgattctatgaagcaaagtcaagctgacttatatttggaaacatatcaagttctggatttggaaatgagtcgtctacgtgaaattcagcgttggcaagcatctgcttcctcaaaattagctgctgacatgcaacgtttttctaggcctgagcgacgcattaatggtcctacaatatctcatttgtggtctatgttgaagttgcttgatgttttggtgcaacttgatcatcttaaaaatgctaaggctagcatacctaatgacttttcatggtataaaaggactttcacacaagtcagtggtcagtggcaagacactgattcaatgagggaggaattagatgatttgcagattttcttgagcacaagatgggctattttgttgaatttgcatgttgagatgttccgtgtgaacaatgtagaagacattcttcaagttcttatagtctttgttgtagagtctttagaattggactttgcacttctctttccagagcgccacattcttttgcgtgttttgcctgttcttgttgtcctagtgacatcatcagagaaagacagcgagtctctgtataagagggtgaaaatcaacagactgatcaatatatttaagaatgaagcagtcattcctgcatttccagatctgcatttgtctcctgctgcaatattgaaggaattatcaacatactttccaaaattttcttcccaaactcgtcttctcacccttccagcacctcatgagcttccacctcgtgaagcacaagaatatcctccaaattgttttatgtttttaccgataaattga

SEQ ID NO: 22517 - DNA, 1437 bp, Glycine max
  Peptide Sequence Number=SeqID_114202
atggcaatgtggggtggacactcaatgttgttaaccaatggggaaggcacaggcactcccaatgtacgtataaaagcaggccttacggttagaggtgatttaaggtttcacagaacagcagggtttaaatatggtcctagtgtggtagtgctcaaagttttttccaccgccaaaaggccaacacgcttgcgcttgataagaccttattgcagtttgaggggacaacacaaccaagggaaaggatattcttctctcacttctacacaaaaaccacggcaactgatgttgaaattcgaggcagatcgaatgcttgtttttctcaaagattggagtaatatacgcatcacggcagtagctgccatattggtatccattttaatgatcattccaccagctgatgctgttgatgctctcaaaacttgtgcttgcttgttgaaggattgcaggatagaactagctaagtgtctttcaaacccatcttgtgcggccaatatcgcttgtcttcaaacttgcaacaatagacctgatgaaaccgaatgccaaattaagtgtggggacctgttcgaaaatagtgtggttgatgaattcaatgagtgtgcagtctcacggaagaaatgtgtacctaagaagtctgatgtgggagaatttcctgctccaaatcctgatgtccttgttaatagctttaacattgctgatttcagtggcaagtggttcatcactagtggcttgaatcctaccttcgatacctttgactgccaattacatgaatttcacacagaatccaacaaacttgtgggtaatttgtcatggagaatacggactccagatgctggatttattactaggtctgctgagcagagatttgtacaagatccttcctatcctgggatcctttacaatcatgacaatgagtaccttcactatcaagatgactggtatattttgtcatccaagattgagaataagccagatgactacgtatttgtatactaccgaggcagaaatgatgcatgggatggttatggaggtgctgttatatacacaagaagtgcagttttgcctgaatctatagttcctgaacttgaaaaagcagctaagagtgtgggaagagactttagcacgttcatcaggacagataacacatgcgggccagagccttccctggtggaaaggctggagaaaaaggtagaggaaggagaagagaccattgtaagggaagttgaacagttagaagaagaggtggagaaggtggggaaaacggaggccaccttgtttcagaaattggcagaagggttcaaagtattccaagaagatgaggagaatttcttaagagggttatcaaaagaagaaatggagattcttgatgggctcaaaatggaagccggtgaagtagaaaagctctttggacgtgccttgccgataaggaaactaagataa

SEQ ID NO: 22518 - DNA, 735 bp, Glycine max
  Peptide Sequence Number=SeqID_114203
atggccgatgttgccggagccacagtgagtccctctatcggtgaaaccaacgatgcgcagaagaatgtgttcgatttgggagcgtttgttggagacctaactttggaagatgatccaagcagcgatgatatatcattggaaggactagaacaggaactagaagagtgtaagaacaatgatgtagttgcaaatatactgtctaaaggtaccaaacttagggattatacaaaaggagttgagaacgatttgcgcaaagttgaattggattcaattcaggattatattaaagaaagtgataatctagtttctcttcacgatcaaattcatgattgtgatagtatcttgtcacagatggaaactcttctaagtggatttcaggctgaaattggttccattagttcagacataaagattctccaagagaagtctatggatatgagtttgagacttaagaatcgcaagaataccataacccccatttctgggcacactggaatacccattacaaaaagtatctatggtctaatccctcccttgtacaagaatccagatttaatattatctaaatgtctgagccacgtccagcagaagaaaattgcatcctccatcaatttctgtccattaaactcctcatttgagaatacaattctgtttctgagattccaaatgcaccatgtgagggcaacccatcaaatccaccatctgttttggactattcctattgccttacagtaa

SEQ ID NO: 22519 - DNA, 1065 bp, Glycine max
  Peptide Sequence Number=SeqID_114204
atggagattgcggcaaatgacaatggaagcttccagttagagatgaaacctttccatctacattcaatgatgagggaagcttcttgcactgccaagtgtttgtgtatatataaaggctttggtcttgaagttgatgttgacaagtctttgcctgatctggtcattggtgatgaggcaaggactttccaaataaatggtataagttcccagtcagatgaatcagtttcaacaagaaattatactggtagaaggcactacaacaatgaacctaaggaaggcctgagcttcagcatgtgcaaaacgctggtgcagatgatgcaaggtaatatttggatatcaactaactctctgggtttggcacaaggaatgacgcttcttctcaagtttcagataggatcatcccatggaagattcactcttgctcctacagatttttcaaactctcagtttagagggcttaaggttgtgttggctgatgatgatgatgtaaacaggactgtgaccaagaagctgcttgagaaactggggtgtcaagtaactgctgtttcatcaggattcgaatgtcttggtgctataagtggctctggtaactcattcaaaattattctgttggatcttcacatgcctgaaatggatggttttgaagttgcaagaaggattcggaaattccaaagccataattggcccttgatcatagcttttactgcaagtgcagaagaacacatcaaggagagatgtctacaggtgggaatgaatggattgattcgaaaacctatcctccttcgtgagatagcagatgaacttggaacagtcttgcaacgtgcagttgtaagtgggcttttacttcttgcacctcctgaaagacttcaacggcttaacaacccaaatagacccggaccactacgagaaccccactccttcatagtgaccgaaatctatgcctccacctggctctacaacgtcctcgtcgccaacctcttgccccgcaaatcaaaggtccgctcacgggtatccaagagctctggtgcctgtcctggaaaatggggtgggcggcaatggagatga

SEQ ID NO: 22520 - DNA, 1515 bp, Glycine max
  Peptide Sequence Number=SeqID_114205
atggaggtcattagcgatacggcgtcgttggaggtcgatttgttgcagctccctgaggtgtcctctctcgcactcaaatctaacctaactttcgtcgagacgctcttcgagcagtggctttcgcttcccgaaagcaaccgattggtgacatcattggtaaatgaagcaaagtcgggtgctcccttgaatgtccccgggaattgctctagtccaaatgctgcaagcaattctttgccttccatgtttcctgctggcactgcaccacctctttctccaagaagtacatctggttcccctcgcatagtgaaacagagagttggcccatctaacttgggttctcctttgaaggttgtcagtgagccggttaaagaagtgatacctcagattctctgtgggtctcttgttgtgcttggtgttaaaccagaagttactgttgcagagtgctatttcagttcaatcgggcaagcgtatgccccgataatggttccatacatcgtttgcccgagagattctctgtgggatgattttaaacctgtgctatgtgagcttttggcaactcatccagggctggagttcctgcagagcacacctgagtttcaagagagatatggtttgtcttccatcttggttataaccttgcatttaggggcatgtacatgttcttctatgctggagctgttgtttgttgatgctgaaactgtcatatacagaatatattactacattaatagatcaggaaatggccgtcttaccctgagggagcttaagcgtggaaacataattgatgcaatgctgcatgctgatgaagaagaggacataaacaaggttttgaggtacttctcttacgagcatttttatgttatatactgcaagttttgggagctggatacagatcatgatttcttgatagacaaagagaatctcatcagatatggtaaccatgcgcttacctatcgaattgttgatagaatattttctcaggttcctagaaggtttaccagtaaggttgagggaaagatgggttatgaagattttgtttacttcatactgtcagaagaggataaatcatccgagccaagtcttgagtattggttcaagtgcattgatttggatggaaatggagttctgacacggaatgaactgcaatttttttatgaggagcaattgcatcgaatggagtgcatggcccaagaacctgtgctttttgaggatatactgtgccagattattgacatgattggacctgaggaagagagctatataactctgcgtgacctgaaaggtggtaaactctcaggaagtgttttcaatatcctgttcaatctgaataagttcatggcctttgaaactcgtgacccatttttgattcgtcaggaacgtgagaatcctacattgacagagtgggatcgctttgctcatagagaatatattaggctttctatggaagaagatgtagaggatgcctctaacggtagtgcagaagtttgggatgaatcactagaggctcccttctga

SEQ ID NO: 22521 - DNA, 1203 bp, Glycine max
  Peptide Sequence Number=SeqID_114206
atgggttctcggggggtactatgctctccctctcttgaacaccacatggattcttccttgggtgatatagatttccaaacacaaggtccatgtctccatgatgtgtctgtcaatgtccttgatagttttataaggaattcatggcgtgaactagcaactgtattttccactgaaaagactttgctcttgttggacactgctcaccagcgatctcttgcacaaacgcttgttcgttcggcttcaggcataagaaattcagaggcatctagtcagtatgtaagaaatctcatgggtcctattgcaacatacatagtggagatatccagcaagagtaattttaaaagtattgcccagcaaccagatattctcctttcggtcagctgcatgttagaacggctacgtggagctgcaagtgcttccgaacctcggacacagaaggctatatatgatctaggattctctgtaatgaatcacatactagtttttcttgaagtgtataaacatgagtctgcagttgtctacctgctacttaaatttgtagttgattggattgatggacaaattacatacttggaggcccaagaaactgctgctgttgttaatttttgcatgcgtttgcttcagctgtattcatctcacaatattggcaagatatcactaagtctttcaagcagcttacttagtgaggctaaaacagataagtatagagatttacgtgctcttcttcaacttctctcaagtctttgctctaaagacatgattgatttctcatcagattcgattgaagcccaaggcactaacatatctcaggtggtttactttggtcttcatatggtcacaccattgatttctatggacctcctgaaatatcccaaactttgtcacgattatttttctctcctgtcgcatatgttggaggtttatcctgaaacatttgcacaactaaatagtgaagcctttgctcatatacttggaacccttgattttggtcttcaccatcaggatgcagatgtggttagtaagtgtctgagagctctgcaagctcttgcttcttaccactacaaggagactggtagtggtaatataggcttgggtgcccacactgtgggtcataaggattcgagtgggaatgttcaggaaggtcttttgaaccgtttccttcgttcattgctgcagctactcctttttgaggattacaggtga

SEQ ID NO: 22522 - DNA, 555 bp, Glycine max
  Peptide Sequence Number=SeqID_114207
atggagagcgtggcatccccaatagtaacttgttcaagcaacaacaatggtagtggtagtaataacagtactactactactcctagcaggtatgagaaccaaaagcggcgagactggaacacgttttgccagtacctgcggaaccagcggccaccgctatcgatggcggtgtgcggcggggctcacgtgctggaattcctgcagtaccttgaccaattcgggaagaccaaagtgcacaacccgacatgccccttcttcggactgcccaaccctccggcgccctgcccctgcccgctccgccaggcctggggcagcctcgacgccctcatcggccgcctccgcgccgcctacgaagaaaatggcggcagagccgaaaccaaccccttcggcgcccgcgccgtcaggttctacttgcatgatgttcgtgattttcaggccaaggccagaggagttagctacgagaagaagagaaagaggccaaaacaacaaaacattgctaatgcagcagcaacatctgttaccacttcccctaatgcaaccgccactgccacttaa

SEQ ID NO: 22523 - DNA, 1602 bp, Glycine max
  Peptide Sequence Number=SeqID_114208
atgagtgaggagagtaagaagaagcaagcatgggtgagggagagacgaggagactctggtgaaacggtgggagagaagcagcctcaacctgaatctaaggtactgcaatctcttatggtttctattggttcaaaaacattggtgtcaagaagctcaatgggcgagcacgactatgaacccctcaaacaaggcaaaactaagaggaggaagcataagaaaggaggatccactcatgcattcgattccaactccttcacttctccgcctcaactatcccgtgttaggaaacagcttgaccctgaaacaacccaatacttctctgaaatttctaatctttttgaaagtgacggggttgaattggaggatcgatcacttatatgtgctaatgctctcgaagaaaccaaggggaaagaattcgaaattgcaactgattatattcttagccacactctcgagaccattctccagggctgtgatgtacaccatctttgtgatttccttcacacttctgctaaccacttcccctatattgcaatggatagatctggttctcatgtcgctgagacctccatcaagtctttagctgttcatctccaggacgacgatgacgtcgttcgccctctcgttgaggaggcgttaaccatgatatgcaaggtggtgattgcagcaaattctgttgatgtcatgtgcaactgctatggttctcacgtgcttcggactcttctttgcctttgtagaggagtaccattagataagtccggatactatttatcaaaatcaactacagtattagcagaccggttgaattcgaaggagttttcttcaaaaaaatatgatgcaacaaattttcagcctggatttccaaatttactgaaatcacttgtgtcagatatgttaaagcatgctaagaaatgtatcaagatactacaagttgaccaattcagcagtttggttttccagacagtgctgagggtcttggcaggcgatgatgaagagttgttacatgtgattcctatccttcttggctgcaaggataagaataatgcagaggacaattttataggcactagagtagtagcggagctcaagaatttgttaaaagaatctaaatttagccatctaatggaggttgttttggaagtatctcctgaggccttattcaatgaattattcactaaagtattcaggaattccttgtttgagttatcatctcatcaacatggaaactttgttgttcaagcattaatttcttatgcaagcaatcaagatctgatattttcccagatggagttgatttgggaagaacttgggccaaatttggagggtcttttcaaaatgggaaggtcaggagttgttgcttcacttgttgctgccagtgaaaggcttcatattaatgaacacaagtgctgtcaagtccttgctgaagcagtgtgtccagtggatgagtctccaaaatggattgttccaagactattgtttcttgatagctgtttcacaagtgaagataagtccaattggagctggcaaagtggttctaaaatgcatgtcatgggttctctgatcctacagacagtattccgttttagaagtgtccaaatatga

SEQ ID NO: 22524 - DNA, 1515 bp, Glycine max
  Peptide Sequence Number=SeqID_114209
atgtctggagaagcagatcgaacgagcatcgaggaagaggtggacacaggaaaggagactgcagagaagaacctgatgaagccgaaagacccaaaggtaccatgggcaaagctacgccgcgtagattctctcaatttagaagctggaagagtttctatggttgcacacgatccctaccagatggattggaggacgacgctgagcttagcatttcaaagcataggggttgtatatggtgatattggtacatcaccactttatgtgtatgcaagcactttcactaaaaaaattaacaacactgatgacattcttggtgtcttgtctctcatcatctattccattgtgctcatacctttgcttaaatatgtcttcatcgttttgtgggccaacgacaacggcaacggtggagcaattgcactctattcgctaatctttaggcatataaagatgagtttgattccaaatcaacaaccagaggacagggagctttctaactacaaacttgaaacaccgtctactgagtttaaacgagcccagaaactaaagcagaagcttgaggacagtcatgttgcgcggattgtgcttttacttttagctataatgggaacttccatggtcataggagaagggattcttacgccatcaatttcagtcctttctgcggtaagtgggatcagtacatctttaggtcaagatgctgctgtggggatcactatagcaatcttggcagtcctattttatgtgcaacgatttggtacagataaaattagcttttcttgcattacatgtcctgcaatagtggttgcatacattgggcaagcagcatttctacggaagttccctgagaaagtggctaataccttctatgatagtgtaccggatcccttatattggccaacatttgttgtggcttttgctgctgccattatagccagtcaggcaatgatttcaggagcattctctattatatcccaggccataagtctaggttgtttcccaagagttagggtagtgcacacttccgttaaacatcaaggtcaggtgtatattcctgaggtcaactacatgttcatgattgcatgtattgtggtctgtgctgccttcaagaccacagaaaagatttgccatgcatatgggatggcagttattggtgatatgatgatcacaacaactctagcatcgcttataatgcttgttttgtggaaaaagagtcggtggcgcgtgggtgtgttctttttgggatttggcttcattgagattgtttatttctcttctcaactaaccaagtttacagcaggagggtatcttccaattgtatcagctatgttcttgacggcggtgatgggaatatggcattatgtgcacaaagaaagatacatgtttgaactgaaaaacaaggtttcaagtgcgtatttgaatgaagtggccaacaacccagacgtaaggcgagtgcccggaataggacttctgtacgaattgatacttggacactccaacattctatttaaccattaa

SEQ ID NO: 22525 - DNA, 939 bp, Glycine max
  Peptide Sequence Number=SeqID_114210
atgtcttttatgttctactataaagtatattataggtgtgagtggggggaagggggaaatactctgaaagggaaggtaaggaggaaagagtggagagacggagattggaaagggagagaagtgttcctcagctggatgcaaaacaaaattggtggaaaacaagatatcagaaaaccaaacacatatacagctactaatgatgcaaaactagtgcgtcgagaagaattaagcgattggcctgatggtttactagcaattggtacatttggaaataacaatgaagtaaaagaaaagacagagaagaacattcttagagaggatccatcctcgtcagaggaaatagcagacttcactcctgaagaaatcggtaaactaaaaaaagagttaactaagctgttgagacaaaaacccaatattgtggaaaaggaaattgctgagcttcctctggacagatttctcaattgtccatcaagcttggaggttgataggagaatcagtaatgtacttggcagtgattccgaagataaagataaagatgaagaaaaagaagaagaaagagaaaaagaggaagaagaagaagatattgaaaagacacttagtgtcatacttggtaaattcaaagagatttgtgcaaacaacagcaagaaagcaattgggaagaaatcgatttcatttttgctgaagaagatgtttgtttgtagaagtggatttgctccagcaccgagccttagagacacccttcagctccaagaatcaagaatggagaagcttttaaggacaatccttcacaagaaaataaattcccaacattcttctcgggcattgtccctcaagaagcgcctcgaggacaggaagatgccaaaggaggatgaagctgaaaatgatgatggctgtaaatgggtcaagactgattctgaatatattgttttggagatttaa

SEQ ID NO: 22526 - DNA, 984 bp, Glycine max
  Peptide Sequence Number=SeqID_114211
atggctctgggaatctctaacatactgcactgccccaaattgagtttctcccacaataattttctccccaaagttccaacctctatcagcctcaggtttccccagacagcagcatggagtgatagaaagattatctgtgctgctgcatctgcggcaggaagctctaatcccgatggtgaatttaatccttatgaggtgctaggtgtaagccctattgagaaatttgacatggtcaaggcagcatatgctaaaaaaaagaaggaggctgagatgaatggcgatgaagcaactgcttcaagagtagtctgtgatgtcattgctgacatgaaaactagttttccaagtttcaaatgggtgaggttgattgtttgcaatcatgtttggaaattgaaactggaaaaggcatatgacaaactcatgatggctcaattgtctaatcggaaaaagggtgtgacttttggatcatttaaggtttcaaaggagatcaagtatgctgacaagcttccagttataccttgggggccaaggcttactaaatcaagtcaaaatgacatgcgcatcaacttggcaatatctgctgtttttacagcttggatccttgtcaagcgcagtgctgaatataaacctttgcagtttttagcctttgcctttgtttataggctttttgagaagttaaaagcctctgaatctcctgtaacccccaaatataatgaagagggtgaagacacaggagaaggactccgcatgggaaaacgactgctccgatcactagccttggtttttggatgtgtagctatttcatctttggcatacactttcattttgaacataattgagtttgcaggtggttttattcctactcttttgtacaacagtcagttcatgtggtgtgaaggagttgagaaccagctgaagtacatattagtgtaccagagtccagtaactaataatacagctgagaaccacccaacaacaaaaaattag

SEQ ID NO: 22527 - DNA, 1758 bp, Glycine max
  Peptide Sequence Number=SeqID_114212
atggcccctaatccaagagttaataaggcctttagctttatgaaggccttaggaatttctgataaggatgtgaagccagtgttgataaagctgttccgagtttatgaaggaaactgggaacttattgaagatgacaattaccacacacttgtagatgcatactttgattttgagaaacacaagggagtcgaaggtgagagaaaagctaatgacagttgtcatggtggagaaaaaccaaaacggggaccgcttttggtagatgatgatgatgacgacaaggatttgcaaacaatggacagttcaagtcaaatgttaagtgcagaagacaataaaatatcaccaaagacatttgaacagaaaatcattgagccatctcaaacattcatgaaagatattaagcccaaaaccagttcacaagcatcacatacaatgttgagtgaggtagaaaagatctcaaatttacctcgtgtggcagctaaagatagaaaatcataccctgagaatgcatcatctgcagttgagaaagtgctagtgaagccaagaactaagaaactcaagatgcaacttgcttcaacgaatcatattggtttacctgatgcgtcggatgaaaaactgtgtctcaaacctctgtcaactcaggatcaggatatggaaagtaaagatgatgttatatccgcctgcgaccgtaataccccagcttataatggaaatattacgattgctagttcttcacgtctgggagaagtaaaaatatctttgaattgtgactctgcgttgggacaaccaaacttcagtattcctaatttggatattgttatgaagttcatggacaagaagtacattcgctcttgcaacactgttgagcctcaattttctatggcaaagctattggatgacctttgcaggatttatctcaagttgggatatcgaaagggatcaaattccaagcgtgccaatttacagcaatatgttaatcaaggtgaaaggaatccctttcgttttatcagtgacataacaaaaggttcagaaaaggtgaaaatatcattaatagatgaaactggcagtgaagacttgccaaagtttaattacataccatgtaatataacttatcaaagtgctaatgtaaatatttctttggctcggatttcggatgagggttgctgttctgattgttcaggcaactgtctttcctcaccattgccttgtgcatgtgctcaggaaactggtggagagtttgcttacactcctcatggtttgttgaaagaagaatttttaacagcttgtgtatctatgaagaatgaacctcaagaccatcattatgtgtactgtcaagagtgccctttggagaagtccaagaatgagtacatgcccgaacgatgcaagggccatatggttagaaaatttataaaggaatgttggagaaaatgtggatgtgacatgcaatgtgggaatcggatagtgcaacggggcatagcatgcaaattgcaggtgttttcaactcgtgaaggaaaaggctggggccttagaacgttagaagatttaccaaaaggaacttttgtatgtgaatatgtaggagaaatattaaccaatatggagttatatgagaggattatgcaggatactggcaacgagagacatacatatcctgtaactcttgatgcggactggggctcagaacaggggttaaaggacgaggaggcactatgtttagatgcaacaaagaatggaaatgtcggaaggttcatcaatcataggtaa

SEQ ID NO: 22528 - DNA, 2592 bp, Glycine max
  Peptide Sequence Number=SeqID_114213
atggctaacactaaaatttcatcttctgagtggcgtaagctctctccgagtgttaccacggccttggcgtcggcttttcttgaatggttgctgattcttttcctgtttattgatgctgttttttcttatgttataacaaagtttgctggttactgcaaattgcaaataccgtgcctgttatgctcaaggcttgatcatgtgttaggcaaagagaaaggaggatattattgggacttgatttgtagtggtcataagaccgagatctcttatttagttctttgttgtgcacatgataagcttgtaaatgtgcaaggaatgtgtgaaagttgcctcttctcttttgctaccatcaacaaatccaatgctgaaacttacaggttattggtgggtaaattaggggagggatctgagaccagatttgatcaggatccattacttggtgaaaattcaaaatgctgttcttgttgtaatgaacaattggttttaaaaggctatgatcaaaggttggtaattacgaagtcaattgggtctggcagtgctgattttgatggatcgaatgttgttggaaacaaatttcacaagaaaagaagagttaaaccatttgtatcatccagagctgcacaccttagaaataaacatgcagatcctttgtctcatgttggttacaccgagctaaagattacttctgatactgagtctgaaccggatgtttccttatttgatgatgatggtacaagcataccagttcagggtacagatgacaccaaggaagatatagaggtttcatgtgaacatatggagcctcacatccccgattcaaatgagaatttggcttttgagaagctagggacttcagcttctggacttcaaccatcattatcagagtcaggaatgcgattagaaaatatagatgttcatggcactaaatctacagcaacaacagaaagtagagatggcttggccaaacttgattctcagcagcatgttgagagaaatgatgtttgtccttccccaagagagcttatttcctttaatgaagtccctgcatcatcaaataaaataggagttcctgttgaagtatcaaaggaaaactatgatttgacaactgatgaagtagggataaaatctaagcaaagaataaccacagactgtgggggaataattgagtcagttgataagccaacaacatctgaagtaggtttagaatcaacccccttttctagtgatattggtcagcaaaatcccaatttactagatcttggcgatgcctataagctagctgtcagtaacagcagaggaagacctggcatgcttgtagagcattggcttggaaaggattctacaagaattagtgaagatttgaagatattgctgtcacaattttcagctactcgagggactgatctgtccgttaatgatatcagtcctagattgtctataaacagtgatgaagtgaagacttgtgatgtttctaactctgctggaatccagatacttcaaaaaatgatttcacttgagcgaaatgaatctggtttgtctctggatggaagccttgtcagtgaaattgaaggtgaaagcgcagtcgacaggctaaaaagacaagttgaccatgacaggaaacttatgaatgctttgtataaagagctggaggaagaaagaaatgcttctgcagttgctgcaaatcaagcattagccatgatcacaaggctgcaggaagaaaaggcaacattacatatggaagccttgcagtacttaagaatgatggatgaggagtctgagtacgaaacagaagctttgcaaaaagctaatgaccttcttgttgagaaggagaaagagatagaagagttggaagctaagcttgagttctataggaagaagttccctgatgaatctgtgctggaaaacatggtggatacaaactctgaaatgaaggtgaaagatattggattggatcattgcattgaaaaggatgagagtatccttggaaagtcggttactgaaaataccaatatatctgacaaagctgaagttctatccacatctctggaaaaacagaatgttcaatctataaaaaattccccattggagtttcaagatgaaaggttatatatttcccaatgtttgaagaagttggagaagcaagtttactttttcctgaatattcatcaatctcaggacaattggctaaattctgaaaatgatgaaaaggaatccctggaaaactgtgagaacttggataataatattctaattcaagaatctgtttcttcacctaaattaaatttggataacatgggtgatgattcctcatccaaggaacctccagtttgcaagaaaattggtgaacttggatacaatggacatagctcccttgcgctcggtgggaataatgatttatcttctactgggagtttggtttcagattttattggaaggttgcaagttcttgaggctgatttgagtttccttaagcatagtatcaacttatcgagcaatggagaagaaggacttaaattattgcaggaaatagctggtcacctacaacaattgcgccagattgggataagagaattagatcaacctgttgcttga

SEQ ID NO: 22529 - DNA, 3120 bp, Glycine max
  Peptide Sequence Number=SeqID_114214
atggaacaagaagaatacaagaaggagcaaatcgattggagctacattgaatttgttgacaaccaagatgttttggaccttattgaaaagaaacctggaggaataattgcactccttgacgaagcttgcatgtttccaaagtctacacacgaaacattttcaaacaagctttatcaaacatttaagaataataagcgctttattaagccaaaattgtctcgaacagatttcactatttctcattatgctggcgaggtgcagtaccggtctgaccaatttttagacaaaaacaaggattatgtggttcctgaacatcaagatttattgggtgcttccaaatgtccttttgtagctggcctttttcctccacttccagaagagacatcgaagtcttccaagttttcttcaattggttctagatttaagctgcaactacagcaattaatggaaatactaagctctacagagcctcattacattagatgtgtgaaaccaaacaacctcctcaagccagcaatttttgagaatgccaatattatacaacaacttcgctgtggtggtgttttggaagcaatcagaatcagttgtgctggctaccctactcgccgtgctttctttgaatttgtaaaccgattttcccttcttgctccagatgtcacagaagcacaccatgatgagaagattgtttgccaaaagatactggaaaaagcggggcttaaaggatatcagattggaaaaacaaaggtattcctaagagcaggtcagatggctgaactagatgcacagagagctaaaaaactcagtaatgcagcaaaaactatccaacggcgtatacgaacccatcaagctcgcaaacattatcttgaactacgaaacaagactatatatatgcagtctgtgtgcagaggaagacttgcattcaaactttatcaacacaagagaagggaggcggctgctgtgaaaattcagaagaacatacgcagatatgaagctaggaatacctatattaaactccaagcatcagtacttactttgcaaacagctttaagggcaattgcttccctcaaagagttcagatttaggaaacagactaaagcttccatcattattcaggctcggtggcggtgccacaaagctgcttcatattataagaagctcaagaaaggttcaattgtcacacaatgccgatggagggggcgcatgggcagaaaagaacttaggaaaatgaaaatggctgcaagagaaactggcgcgcttaaagacgcaaaggacaagcttgaaaaaagagtggaggatatcacttggcgtcttcaactagagaaaagtttaaggaccaacctagaagaatccaaatcacaagagatagcaaaactgaagaatgcactgcaggagatgcagaacaaagttgatgaatccaatgcattgcttataaaggagagagagaatgcaaagaaggccattgaagaagcacctcctgttgttaaagaaattcaggttattgttgaagacactcagaagattgaatcactaacattggaagttgagagtctaaagacatcccttgagtcggagaaacagaaagctgacgagaaatataatgaagcccaagcttgtagtgaagaaagggggaaaaaattagaagacacagagaagaaggttcgtcaactccaagaatccttagccaggctagaagagaaaattactaacttagaatcagagaatcaagttctgcgtcaacaagccctgtccatggcacctaataagttcctctcaggacgctctagatcaatcattcggagaacggacagtggacatcttggagttgaagcaaagacaactttggatatgcatagcacatcaatgaaccacagggaatcttcggaagtggaggataaaccacagaagtcactaaatgagaaacaactagagaaccaagacttactcattaaattcattcctaaacagataggttttgctgggaatagaccaattgctgcttgtatcatatacaaatgcctcttgcattggagatcatttgaagttgaccgtactagcgtttttgatcgtataattcaaactattgggcattcaattgagacccaggataacaatgatgttttggcttattggttatccaacacctctacacttgtcttgttactccagcgcacacttaaggcaagtggtgctgctggaatggctcctcaacgacgtcgttcttcgtcagggacagtgtttgggaggatgactcatagtttccgtggaactccagcaggagtcaatctttccctaatcaatggtagcatgagcggaggcatagatgcgtcgagacaagttgaagccaagtaccctgctcttcttttcaaacagcagctcacagcttatgtggaaaagatatacggaatgattcgagataacttgaagaaagaaatttctcccttgcttgggttatgcatccaggcgcctagaacatccagagcgagctttgttaagggatcatcacgttcagctgcaaccactgaagcccagaaagctttgattggtcactggcaggagatagttaagagccttgggaactttttaaatactttgaaagcaaatcatgttcccccatttttggttcgtaaggtgttcactcaaattttttccttcatcaatgtccaacttttcaatagtcttcttctaagacgggagtgctgctcatttagcaatggagaatatgtgaaatctggtttggctgaattggagaattggtgtaataatgccactgatgaggtcatacatcagaaaccaaggaaaacgctgaatgaaataactcatgaactgtgtccagtcctgagtatacagcagctatatcggataagcaccatgtactgggatgacaagtatggcacacatagcgtatcccctgatgtcatatccaatatgagagtgttgatgactgaagattcaaataatgcagttagtaattctttcctgttggatgatgattcaagcattccgttttcagttgatgacatatcgaagtcgaaggaacccatagatatctctgatatagagcccccaccagtaatacgtgataacactggctttagtttcttgctgccacacccagactga

SEQ ID NO: 22530 - DNA, 1080 bp, Glycine max
  Peptide Sequence Number=SeqID_114215
atgggcgcaacgaagagtggacgagttaaacttggaacacaaggccttgaggtggtttcaaaattgggattcggatgtctgggtcttactggagcgtataatgagcctctcccggaacaggatggcatatctattatcaagtatgcattcagtaaaggaatcacattttttgataccgctgatgtttatggagccggtgctaatgaaattttgcttggaaaggctctgaagcagctacctagagaaaagatccagctagccacaaaatttggtattgcgagattagatttttctaacatgctgatcaagggttcgcctgaatatgtgcgctcatgctgcgaaactagcttgaaacgtcttgatgttgaatacattgatctctattatcagcatagggtggacacatctgtacctatagaggaaacagttaaggatttcttcctctcaatgattttgatcatagtgggtgaacttaagaaactggtggaggagggcaaagtgaggtatatagggttatctgaagccagctcagatacaataaggagagcgcacgcagttcatcccatcacagctgtgcaaatagagtggtctatatggactcgtgacattgaggaccagatagttactatctgcagggaacttggtattggaattgtatcatatagtcctcttggtcgtggtttctttggcggcaaaggaattctggaaaatgtgtctgcaagtagctccctgaaagtacatccacgctttcaagccgagaacatggacaagaacaagaatatatatgaacgaattgaaagccttgcaaagatgcatcggatcactcctgctcagttggcattagcgtggctactccagcaaggcgaggatgttgtacctatccctggaacaactaagattaagaacctggatcagaatataggtgccttagcagtgaaactgtcagagaaggacctgagagaaatttctgaggcggttcccattggtgatgtagcaggcggaatacactactatggactggaacacattacctggaagtatgctaacacacctccaaaagattcgagcatctcaacctga

SEQ ID NO: 22531 - DNA, 525 bp, Glycine max
  Peptide Sequence Number=SeqID_114216
atgtgcccaacacaagcaattattatatcccagaataatcaccccaaggcacaagtggtggggtggccaccagtgaggtctttcagaaagaacattgttcaaaggagtaacaacaatgagggcgaaaaagccgccacaagtagtagcaacaatgtgaacacgggagcagctttcgtgaaggtgagcatggatggtgctccttatttacgcaaggtggatttgaagttgtacaagagctaccaagagttgttggatgcgctggctaaaatgttcagttcattcaccattgacaagtgtggatcccaaggcatgaaagacttcatgaacgagagcaaattgattgatcttctcaacggctctgattacgtaccaacctatgaagacaaagatgctgactggatgctcgttggtgacgtaccgtgggaaatgttcgtggaatcatgcaagcgcctgcgtataatgaaaggatctgaggcaatcgggctagcaccaagagcagtggaaaagtgcaagaacagaagctag

SEQ ID NO: 22532 - DNA, 1185 bp, Glycine max
  Peptide Sequence Number=SeqID_114217
atgaatcatgaattaggtactatctttgtctcttcaatgaccgatctggcttttaaacgatgccttgctgcagagctacttgggcaccatcatcttcagccttatgttcttaaggtccatctcaaaatcaatagcccaaggcgaagtacattgccagaatccaactacatgaagaaaactagatttttgaagtctgaagatgatcatgtttccctctctgggaataagtggcattcttttagctatgatcggactttaaatcctagtgtatcaggagcagagcaagattctctatgctctacgctagagattgattgtactcctgataatttaaatcaaagatttgctgaactttctgttggagacaaccccgatgtaaagtcactccataagccagctgtttccagaacttctattaatgccaagactcctagattagctgcatcaaaagcttctgccacccccaagaaatcaatggtattctcaaagaatcataagacgcttcctgtttcatacaatacgaaagaacctgtccatacaactcgcagagcatcattgccattcccaagaagttgtgccatacagcagcctcctcgcaggcccagtattggtttacttgaccatgtaaattcaccaaatatttcagttaactctccccgtattgataggatagcagaattcccattagcatcatatgaagatcaattgtttcccatcaatagatcttctccaaactcggcacagggttccgcaggctctccttgtggcaatgattcaactttgatagacaaatgcacaatcaaggtatgtgacacatcctatgttaggccaggatgtacggatgcttggcagggaatcaagcgcagcaggttcaagaaaaatgatgaggataaaagtggctcatctgatcaaaatgcaactactggagcatcaagccacaactcttcagacttgcgccgccgacagtttgatacatcgtcattccgacaaagggctgaggccttagaaggcttgcttgaatttagtgcaagattactacagcaggaaaggtatggagaactaggagttttattaaaaccgtttgggccagggaaagcttccccgagggaaactgccatttggttgagcaagagtttaaaggagaacactttttcagcagggaacaattcacctaaactgctgtaa

SEQ ID NO: 22533 - DNA, 924 bp, Glycine max
  Peptide Sequence Number=SeqID_114218
atggcgatgaaaactgcagaagaacacgaagtgggtatctcctgcttcatttccgaccttcctggcttccgcggaattttaaagcaaaggtattctgattttatcgtgaatgaagtggacagagatggaacagttgttcaattgtcctcgcttgatgcccctcaagaggagccagagagttctcaggaaaatggaaccaacacatccgacaatgttgtaagttatgcctctcagattgaatctttcaagtctcttgctggggactctgatgctgttcttttggaagaatttattaataaaattaatgccggtggagaagatggtgtttcgcccattgttctttctccagattctgataaatctcatcgaaaggcaatgcataacttctttaaggaaaactttaagttcctggtcactgatgtggttgatggacccgatgcttcatcaaaatgtatccgtgtgagattgaattctgctgaaccaaacaacaaaggcaaaaactccaagaaacgcaaagaaagaggtgataagccctttgacagccgaggttcagaaaattggcctaaaaatgttggcaagttccttaggtttcatctttacaaggagaacaaagatacccacgaagccttgggggttattggaaatatgctcagtgtccagccaaaatcatttggatttgcgggtacaaaggacaagcgtgctgtcacgacccaaagggttactgtttacaagcagcgagcaagtcggctagcttcccttaacaagcgcttgtttggtattaaattgggtgatttctgctttatatttgtatccatagcattgacatattttctcagaggtattgttgcagattctgaagatatcataaaagcatctgcagatgccttaggaaggcacggcttcattaactactttggtctccag

SEQ ID NO: 22534 - DNA, 255 bp, Glycine max
  Peptide Sequence Number=SeqID_114219
atggaaggcacagacaatttgtttcttgtagattttataattttgtatataacaatcttggctgctgccgaaggagaccataaacttccaagcatcaatggaagtggagacttgaagcaagctttacagaaacttggttccattccgtcaagcagattattggcagttgaggtgttatggacaccacagaatgagaacgatactctctcagaacgggagttacttgaagattacccgcttttacggcctttgtaa

SEQ ID NO: 22535 - DNA, 1359 bp, Glycine max
  Peptide Sequence Number=SeqID_114220
atggcctcatcatctccctctccctctccctctccaatgttcacagtgcgaaggttgcaacccgagttggtggctcctgccatccccactccccatgaacttaaaccattatccgacatagatgatcaagaaggtcttcgtttccacattcctatgatacaagtttatcgtaaccaaccatcaatggcagagaaagacccagttcaagtgattcggaaagcactggcaaaaacacttgtgttctattacccttttgcgggtaggcttagggagaggcctgaccacaagttaatggtggattgtactggagagggcgtcttgttcattgaggctgatgctgacgtaacacttgatcagcttggtgatgctctccaacctccattcccatgcttcgaacaactgctatataatgttccagattctgaagaaattactgacactccccttctactcatacaggtgacacgactcaagtgtggtggtttcatccaggccctccgcttgaaccacaccatgagcgatgcagctggtcttgtacaattcttgaacgcatgggctgaaatggctggaggtgcaaagagtccttccattgcacccgtgtggcgtagggagcttctaatggcaagagatcctcctcgcatcacatgcaagcatcacgaatacatggaattcgtagacaccgagatcgaggaaggaagccttactttgcatgatgacgacatggttcttcgatcattcttctttggaccttcccaaatagcttcccttcgtcgcttggttccccattactgtgccacgtttgatctcatcacagcatgcttatggcgttgtcacacaaaagcattgaagatagatgcagataaggatgttcgaatgatggtcgccgtcaacgcacgtgctaagttcaatcctcctttacctgttggttattacggtaatgccattgcatacccagcagcagtcaccacagcagggaagctttgtggaaatccatttgggtatgcagtggaattaataaataaagtgaaaggtaaggccacacaagagtatatgcattctgtggcagatctattggctattaagggacgatacataccaagaatggtgaggtctcttactgtgtcagatttgagaggttttgatcccagacaaattgattttgggtggggccatgctctctatgctggaccagctcaaggaggccttggaccctttccaggagtaacgtttatcactccttttaagaatgcaaaaggagaagatggtttagtattgccgatttggttgcccacagaggctatgaataggttttccaaagagttggatggcatgtttggtttcatttgtagctcattatga

SEQ ID NO: 22536 - DNA, 2067 bp, Glycine max
  Peptide Sequence Number=SeqID_114221
atggagcattgtgcaggcataaattgtctggctctacttacatctgctgcatctgatgggtctgattatctcttcactgggagccgtgatggcagtttaatgagcttaactctaatagaaaaggttaatgatgctgttgttgtaggtgatagtacacttgtttcttgttcttcagatacaacccttaagacatggaatgccttgtcctttggaacctgtactaggacactccgacaacactctgactatgttacttgccttgcagcagcaggaaaaaatagcaatattgttgcctctggtggccttggcggggaggtttttatatgggatatcgaggctgccctcactccagtctctaagtgcaatgatgctacagttgatgaatcttcaaatggtatcaatggttctggcaacgtactaccattgacaagcttgcgtcctattaactcgagcaacaatatgtccatgcacactactcaaactcagggatacattccaattgctgccaaaggccataaagattctgtttatgcattggctatgaatgaaagtggaacaattcttgtctccggtggcacagaaaaggttgtgcgtgtctgggatgcaaggtcaggatcaaagactctaaagcttagaggacatacagataacatcagggctctgcttctggattctagtggcagatattgtttatcaggatcttcagactctatgataaggctttgggatataggtcagcagagatgtgtgcattcttatgcagttcatacagattctgtttgggcacttgccagcaccccaacatttagtcatgtttatagtggagggagagacttttcattatacttgacagatttgcaaactagagagagcagtttgctttgcacaggcgagcaccctattcttcagttggctttgcatgatgatagcatatggattgcatcaacagactcttcagttcatagatggccagctgaaggatacgacccacaaaagattttccagagaggcaattcttttttagctggaaacttgtccttttcaagagcaagagtgtcaatagaaggatctacccctgttcctgtatataaagaacctatcttaactatcttgggtacacctgcaatagtacaacatgaagttttgaataataagagacatgtgctgacgaaggatgcatctggttcagtgaagctgtgggagattacgaaaggcgttgtgattgaagattacggaaaggttttatttgaggagaaaaaggaagagctatttgagatggttagcattcctgcatggttcacagtggataccaggcttggaagcttgtcagtccatttggacactccccaatgtttctctgcggagatgtattcggcagatcttaacgttgtaggcaagcctgaagatgataagattaatttggctcgagaaacccttaaagggctactggctcattggttgagaaaacgaaagcaaagaatgggatccccagctccagctaatggggagttattatctggaaaggatatttcttctaggagtcttgcccattctagaattgaggttgatggtagttctgagaatgatgctatggtttatcctccgtttgaattctcagttacttcccctccttccattattactgagggcactcatggagttgcattaagtcacatggttgtagttgaaaggagtaaaccatgcttatgcagtttctatttgcaaccatgtgaaggctcttcagtccagatcctcacacaagggaagctaagtgccccacgtatattaagagttcacaaagttattaattatgtaatagagaagatggtgcttgacaaacctttggatagtttaagtggtgatggtagttttgcccctggacttactggatcacagtcacagcttcaagcagttggggatggatcttttcgatctggatttaagccttggcaaaagcttagaccttctattgaaatattgtgcaacaaccaggcaagtagtctgttgtctacttgtcttatatgcaatcttatgacagtgcatatagcatggttttctagatgctga

SEQ ID NO: 22537 - DNA, 3732 bp, Glycine max
  Peptide Sequence Number=SeqID_114222
atggccttggtgacgggttttctagcctcacatgtcggtgctgtaaggcaccaccggtttgaagttggaattggagttcgggcggtgtcgtcatctgaatctgaaacagtggcagctgtgaacggatcttcttcgcggaatggttccttgctactgaaggaggaaaagaaggtgcctttcttgcgagttgaagagaagaagaataagaggggagaagaagaagaagaaggtttggcagcactttgggatgatgggtatggaagaaggagtgtggaagattactttgctgcagctaaggagatgtgcaaatccgatggaggcccacctcgatggttttgcccacttgaatgtgggcctcctttcaaggattctcccactctcctgtttttacctgggatggatggcacaggattgggtctcactttgcaccatcaagcccttgggaaggcttttgaagttcgttgcttgcatattccagttcatgatcgaacaccatttgaagggctggtgaaacttgttggagaagctgtcaagctcgaatgtgctttgtctccaaataaaccaatctatctggtaggtgattcttttggtggaagtttagcacttgctgttgctgctcgcaatccaacagttgacctagtactgatattagccaatccagctacatccttcggccaatctcagttgcaacctttgtttcctttcatggaagctttgcctgacgaactgcatgttgctgttccctttcttcttagttttatcatgggtgatccagtgaagatggcatcagtcaatattgacaataagcttcctcctgccaaaaaaattgaacaattgtcatacaaccttactgcattgctgccgtgtcttcctgagctggctgatattataccaagggatactcttctttggaagctgaaacttctcaaatcagctgctgcatatgctaattcacgtattcatgctgttaaagctgaagttcttgataacatgcttcccagcataaacgaagctcaaagactcatgggattattgcaaaactgcaaagttcgtgtctttaaggacagtggacacacacttctcctggaagatggtattggtctgctgacaatcatcaagggaacttgcatgtaccgtcgctcaaggaggcatgatttggtcagggatttcatacctcccagtatgacagaattcagatatgcaatggatcaagtagttggaatgctccaaccatatgagatcagcataggcttaaaggagcactcaaacccggtgacccccaaggcctacactccgaagagtccgtcagggcctctccctcctgattcagacagctctgggtttctgcgggaaagaaaaaggctacaatgcgaagggtgtttctctcagttcagacatgatatcaaaattcccaacggtgagaatgctcggaattctgtttcgaacatgatactcaaatttcacgacgatccaacggtgaacgggttcgagatcgttatttttctgagactgctcgtgttcccaaagtttaaagctgatatgctactgatgtatggcagatcatttcgttctgttactggatctgtatttttctcaacattggaggatggaaagattacaaaaggtctctctggtgttccagatgaaggtcctgtcttatatgttggttatcacatgttgttggggttagagcttatctcactcacagatggatttttaagtgagaagggtattgtgcttcgtggaatagcccatcccgagctgttcaggcctaaagttgagtcttggtcttctgagttttctatgattgattgggtgaagatatttggtggggtgcctgtttcagcaagcaatattttcaaattgctttcaacaaagtcacatgttctcctatatcctggtggtgcgcgtgaggctctccattataagggggaagcatacaagttgacttggcctgatcacccagaatttgtgagaatggcagcacgatttggtgccacaattgtgccatttggagctgtaggtgaagatgatttagctgaagtagacatgtataagaatcggttgcaagaattggctcaaagaagctgttttaatttgccggcctattcatgcattcgcgaagggccagatcatgctcctcgttttaaagcaactgtcaactttaatggagagacctttgaaagccctacattctgctctactcttagacaggcagaacatgcagcagctgaagtggctcttaacactcttgcaaaaagaggtccctctagagctttggcagcaagagttctggatgaaacaggagtatacaagaatttgctccaggaaactgctcatagagctggactgaatcttcctgtttatacaaccattcgttctggaccaggtcatggtcctaacttctcatgtaccgttgagattgcaggaatgcattttactggagacccatctaggaccaagaaacaggctcagaaaaatgctgccatggctgcttggtctgcattgagaaaatgtgagcattttgcttctgtggacttaacaacttataatctatttgttttaaatttcattctagtgtcggagcatcatctatcttcttcaacttcatcctcattttcgctagagtctaaaggcaatgaagaacaggaacaagtaatcattgctcgggtccttgcaagtttacacccatctggttcaaagaacttttccaaaagtgatattcaacttggatggcaaaagtccactacaacctctttggtgtcaactcagccaactacagacttgtatcctatgcattgccagcattttggaatctctagtttctcaccagaggtggctctatatcagatttggcagcaacaacaaattatgcagcaacaaaatcgtctattggcactaaccattcaaccaattattccatctacttcacagatttatccgttaatgcaatccgtgttccagccagaccactgcctttattttccagctagagagttggcatcagttcctgtaggaccaaaattatcaattccttcatcgagcccttcattttattcttcaaaccaaattggtccagagttaaacacgggcaggtcaacactaaccatcaaagagatacaagaagaaaaaatagaagatcccccagtttgctcttttagcaatgaaactagagtcctaacaccagctacagaggatgagagtcagaggcatggtggctctggaagcagaagtataaatgctgagctgggaggagaacattgtgagaaatctgaatgtgattctcattggggaacgggatctgtacacagacccgttaatcctgagctgcaaaacccatccagtattgactcatctgttctcagagcacactcacaagcaagttccaacagaagttttagaccaccagctgcttcatcatcctccattgtgagaaccatgtgccctacttcatttgtgggttcaaggccacaacatgttgcaccaaggttgagaaccggaactccacgtagtccgggcattcctatctatgaaaggtttggcatgataagagctcctacccctctattcatggcaccagctgtgagaatcagatcagtagttccagtctgctcagctcctccaaggagatccatggcagaggtgtcccaaagcaaggaaaaagaagatttaaaacctgaagacaaagaggtgccaagaactagctctgagcttggccatcttagaatatga

SEQ ID NO: 22538 - DNA, 1737 bp, Glycine max
  Peptide Sequence Number=SeqID_114223
atgcatctccaaggtttggcctatggtgctatactgttagtaggtattgctgatacaatgggatgtttgcaaagggagggtcgtttgcttcagggagagcataatcttttaggtgaagcttttcttgttatggcttcttctgctgggatccaacagcaacaagatgttttaaggtggttactagaacctttgagcattcagtggacacaatcggagtggcaggataaatatttgtcaggtccacacggtttggttcagttgtgctcagatgcgcctgttatgtggtcaatttttcatacattgacattctttgagagggcacttaagaggagtggattgaagaaagccaattggaattcagaaaacagctcaacaccaaactcaactcctttaaatccaatggcctctcacatatcatggatggtgactcctctcttgaaactactgcgctgtatacattccctttggtctccatctgtaagtcaagctttacctggtgaggtcagagctgcaatggtcatgggtgatgttgagaggttcagtcttcttggagaagggaactctaaattaccaaagggtgtcacagatggatctaaggttgacatgaataaagaaggatatgctgaacccaatgaatcagatatacgaaactggtttaaaggcatcagagacagtggatataatgtattgggtttgtcaacaaccgttggggattcttttttcaaatatttggatgtgcactctgttgctgttgcactaatggagaatatacagtcaatggagttcaggcatataaggcagcttgttcattccactttgattcctttggttaaaaattgtcctttggatatgtgggagatttggctggaaaagcttctacacccattgtttgtccatgctcagcaggcacttagctgttcatggtctagtcttctacaagatggtagagcaaaggttccagatgttcatgacattcttagtggatcagacttgaaagtggaagtgatggaggaaacaattctgagggatctcacacgtgagatgtgttcactcctctctgtcattgcttctcctccccttaatactggaatcccttctttggaacaatctgggcatgttagtcgattagatatgtcttctctaaaaaacttggatacagttgcatcatgctccatggttggtttccttctaaagcatgaaggtctggcccttccaacactacgaatgtgtttggaagcttttacatggacagacggtgaagctgtgactaaaatttcttcatattgctctgcattggtagttcttgcgatagtaacaaatcacgcagaactcattgaatatgtttctagagatctttttacatccattattaaaggtttagcccttgaatcaaatgcaataatcagtgctgatctagttggcatttgtcgtgaaatatttgtttacctttgtgatagacacccagctcccaggcaggttttgatgtctctccccaatattaccactcatgatttagttgcctttgaggaatctttaacgaaaacattcagtccaaaggaacaaaagcagcttacgagaagcttgtttcaattagcaactggtaacaaattgaaagcacttgcagcacagaaaaccgtgaatatcattacaaatgtttcaacaagaccgcgcccagccaatgctcctgagtccaaagttgatgatggtgatgttgtggggttggcagccatcatgtga

SEQ ID NO: 22539 - DNA, 2214 bp, Glycine max
  Peptide Sequence Number=SeqID_114224
atgggcgcacagaaaaaaagcggtgctagggtttcagaggaccccgacgaactggttcgggttccgttgcaggccgttctcttggccgatagtttcaccaccaagttcagacctatcacgctcgaacgccccaaagtgctgctgccgctcgtgaatgttccgatgataaattacacgctcacttggctcgaatccgctggcgtcgaagaggttttcgttttctgctgttctcattcaaagcaggtcattagctacctcgagaaatctgagtggctctctcaacctaattttacggtaacgactgtagagtcgcagaactctgtcagcgccggagatgcgctacgtgtaatttatgagcgcaatgtgatacatggagactttgtccttatcagtggagatactgtaagcaatatgtcgcttactcaggcacttctagagcataaagagaggaagaagaaagatagtaatgctgtaatgactatggtcattaaacggtcaaaacctaatccagctatccatcagtctcgacttggtactgatgaacttttcatggccattgatcctaataccaagcaacttctgtattatgaggatagggcagatcaatcgaaaggaacactacatcttgacaagtcattgcttgctgataatccttcactctctctgcatcatgacaagcaggattgttacattgacatctgctcacctgaagtccttagcctatttacagacaattttgactaccagcatctacggcgtcattttgtcaagggattgcttcttgatgatataatggggtacaaaatttttgttcatgaaatccactcagactatgctgcaaggattgataatttccgaagctacgacactgtcagcaaggatataattcatcgatggacatatccactggtgccagatgtaatgaattttggcgacacagctactaaacttgaacgacaaggaatataccgtgcttcgggtatggatgaaaattttgtagtgtatattgggaatgctgaaatatcacaatcacagtctgctgttattggccctttcactgtcataggatctggcaccaaaattgggcataacactaaaattttaaattctgttattggtgaaggatgtaaaattgggtcaaatgttatcatagagggatgctatatatgggataacatcagcatagaagatggctgtaaactccagcatgcaattgtatgtgatggggtgattataaagtcaggggctgttctggaacctggtgttattttgtcttttaaggtcgtagttgggcctgagtttgttgttcctccatattcaaatgtatctctgttacagcagccgattgaggaagacagtgacgaggagcttgaatatgctgatagtactagtgtcataggcagccaagtggataaatcagatgtagagattgcttccaaagtattggagacacattttagtcctgcctcggagttgggtatgggtggggctggtcatgtgtggtcaacatgtgaaggaagccatgaagaagagtggaggcattcggtggcgcctattcctaaagataaagttatggaggcaattaaaactatgaaagatgatctggagaatgatgatagttttcttccaccttctggagaactgaaacctaattctaattattcagatgatgatgatcatgaagattctagagatgactcttactactttgagaaagaggttgaagcaacctttctcagggctgtgcatgaaaacatacaagaaagccatttgatcttagaaatcaattctttgaagttgtcatacaataagctagctgctgattgtgctggagctgtattttctgccatgatgaagtatgctttagacaccccccatagttcagctgatgttttgcttcaaaatgttcaggctgtatttacaaaatggaaaaaggctcttacatcctatctgactgacatagatgagcagatcgaagtaatacttaaatttgaagaaatatgtgaggaatctgctaaggaatttgctccattgttcacaaggattttgcactacttgtacaatgaagatgttgtagaagaagatgctattttgagttgggaagccgagttaaaagatgctgacgaggcagataaagtttttgttaagcaggcccaaaagttaattcaatggctaaaagaggcacctgaagaagacgatgatgacgaggaatag

SEQ ID NO: 22540 - DNA, 1356 bp, Glycine max
  Peptide Sequence Number=SeqID_114225
atgggtcaagaacctccacaatctgtgagaggcatgccgagtgttcgatcatctgcctcttcaaatgctctagctgagcaacctccacctcgaacacccactctaacgaataacgcagagcaacaaccgccttctgctcgtttaacgccaggaaaccgaaccctggaattgtctccttccgctcgcactattataattacacggtcgcctcaacccagcagtgccaacaatgatcagcctccctctgctcgctcaacctcgggccgtcccagtggactttctaaggtggttcccatggtgccacctagtgtacctattacactcagaccggtctcctctgttggtgttcctccctctgagcctcttcttgatattagaaaagacagaaggcatgctgctgctactgtaagggaaaatgccaatcagcagcagcgtcctaccagtgagcttgaggacgagcttcgacttgcagaagagaagtgtgaagaagctgaatcaagagttaggcaactagaacaacaggctgctctgagaaatgcatcaaagaatcatggaggttttcaaacagcgcttcaggcggatgctgagactgcaagggaggagaccgcgtctgctttcgaaaaactacggcttatgactcaacgaatgatactcaccccggaagaaatggaagaggttgttttaaagaggtgttggctagctcggtattggggtttatgcgttcgacatggtattcatgctgatattgctgaagcaaaatacaaatactggtctatgttcgccccgaatccgattgaagttgtattagcagcagcaaagaaagctaaagaggaaaaagacctcgatgtagaggatacagagggtcaacttgacctgaaggaactttctggagagggaaatattgaaaacatgctttttgttgagcaaggtttgcggcaattggcttcactaaaggtagaagaagcattggcggttgcattggctcaacataggcgaccaaatatgttgaaagctggtttttcagatgacctaaaattaccaattgaagggcagtgtgatgcatttgaattgagtcaggaggaggctgaagatgtatcttttaaacaggcttggcttgcttacatttggaagagagcaaaaaggcatgagatagaacctgacatagcaaatgagcgtttccagcactggatcaatcacaactcaatgactcctacctcacaagacgcagttgatgttgaacgtggacttgtagaaatcaaaaggttggatattgaaacgcaactatgggatgaatctcgaagagaattggagcaagagattggcaattcaaacatacccggtcgttctgacttttga

SEQ ID NO: 22541 - DNA, 1596 bp, Glycine max
  Peptide Sequence Number=SeqID_114226
atggttgtagtgtatgcaaagaaaagagatggtaaaatggaagaaataggtcgcactgaagtcattctgaattgtttaaatccagagtggattgagaaaattagtgttgcttttcactttgaaattgtgcaaccacttgaatttcatgtgtatgatgttgatacaaaatatcatagcgttcccaccacgacactaaaactgggagatcaagacttccttggaatggccagttgcacgttatcagagattgtgactaaaccaagtaggagcttatcattaaggctcaaaaacaaaagtaggcatgatgttttgagaaacctaggggaaattactgttcatgctgaagagaccgttgcttcaaggagtgcagttgagatggtcttacgttgtactcacttggataacaaggactttttctctaaaagtgacccttttctaagaatatcaagaatggttgagactggaggttatgttcctatatgcaagactgaagttatcgacgacaatttaaatccaaaatggaaaccactttgtcttagtgtccagaaatttggaaataaagataatccattattgatcgagtgttttgatttcaatagcagcggcaatcatttcaaggatgcaaagcgtattgatgtcaaatttattgccatcagtaaaatgcagaagtcagtagcagaccttgaaaagctgtacaaagagagaacaggcgcaaattttgtcataccatccacacgccacagacaagagaaggttctgaagggtcaactgtttgtggatcaatattgcgtaaaagagcaaatcagttttattgactacatatctagtggttttgagctgaacttcatggttgctatagatctcacggcttcaaatggaaatcctcaccattcagattcgttgcattacattgatgcatatggccggttaaattcataccaaaaggctgtaatggaggttggagaagttattcagttttatgattctgataggcagtttcctgcttggggttttggagggaagctacctggtggtactgtatcccactgttttaatctaaatgggaatcctggtgcctctgaggttgtaggagttgaaggcataatggatgcttatgccagtgctttacgcagcgtcactctctcaggacccactttatttggtccagttatcaacatggctgcacaaatggctgtccagtccatcacatcacataacaacaccaagtattatgtattgcttatcataacggatggggttgttacggatcttcaagaaacaataaatgctgtggttaaagcatctgatcttcccctgtcaattcttatagttggagttggaaatgctgatttcaaaagcatggaggtgctggatgctgataatgggcgtcggttagagagtcccaccggtcgcgtggctacacgagatatagtgcaatttatccctatgagagaagtacagagtgggcagatatctgttgtgcaagctcttttggaagaactacctgatcaatttttgtcttttatgcgaagcagggacgtcaagccactaccttgttccgatttccctcaagcatcatcatccactgtgaaatag

SEQ ID NO: 22542 - DNA, 735 bp, Glycine max
  Peptide Sequence Number=SeqID_114227
atggtcccaattgaccccgctttcaacgacaagcacaaaaaacgaggcattgtgtatacttgccctgcttctgtttctgcccaagatttgggagaatttgatttggagaaagagaaaagtgtggtaactctaaaagaacttttagaagactgcattagagatactgacaactctcaacaactatctgaattggctgttagttgtccaagcttaaggacacagttttattggagcaagtttttgaaactatggaaaagaagatcttttaagcacctaccatcttttcctccgagttgtgtgccaaacataacaaagactaaaaacagaaccattcaagaaatttctgttgtatgtaattcatactgttccagaactttgatgaattttagtctcgataacctgagaaatgcaaccaacaattttagcaatgagaatatgattggaagaggtggctttgctgatgtttacaagggtagcctccaagatggacaactaatagcagttaagcgactgaataaagggactccagaaaacagaacatcaagctttctgtctgagctaggcattcttgctcatgttgatcatcctaacactgccaaacttattggatgtggagtagaaggaggaatgcaccttgtcttcgaactatctccactgggaaatttagggtctcttcttcatggtgtgcacttggttccaagtattccactattctcctatgtgaaagctttctaa

SEQ ID NO: 22543 - DNA, 237 bp, Glycine max
  Peptide Sequence Number=SeqID_114228
atggcgttcagaagaaggctgcacgatttctaccttataaatccaagaatacaacagccgtgtgcaactttagagggtgctactgtcattttcacctacgtgaagggggcaagaggacagggaagcgagtgcacgcttgagattataaaaaaggctaaggctgaagatgccaaagatccattggctatacctgttcatgatttgggttatgaagagaattgcaagagtggtggatga

SEQ ID NO: 22544 - DNA, 765 bp, Glycine max
  Peptide Sequence Number=SeqID_114229
atggtgttgtgctcagtatggccatcaagtctgtttctatctgagttaatactttctcatccagaattattttcaaataaatcatgcttcgagattggttcaggagttggcttagttagcccatgtgaatgcttccaagttgaatttagtcaactcgaagttttggctactgtctatcaacagtttaatttggagttgaaccacctgaacgttgaagatgacaatgacatgccgcaaagaaacaaaaatccaaacacggtaaaatgcttgtatctgccttgggaatctgcatcagaaagtcaactacaagatatcatgccagatgttgttttaggtgcagatgtgatatatgatccagtttgcctgccacatcttgttagagtacttgccatggttttgatgaatcagacgaatttgggctcctgcagacagcatgcaagttgcaagggccactctccaaacattgaacatgagaatggtgaacataatcatgaagatgctattaacaaatctgatggtggatgcaaagcgatttataatgatggtagtaatagcctgtcaaaggaagcaccggtggcttatattgcatatgttatccggaatattgaaactttcaactattttctctccctaggcatacaggctaaccttgatattggggaccttactgattcattgaagccggtaaatctcctctgctgcatgaaatcatacaatcaagccactgtaagactattgcgtatcaccagcagtaatatacaataa

SEQ ID NO: 22545 - DNA, 1407 bp, Glycine max
  Peptide Sequence Number=SeqID_114230
atgagtaaacaagacttgttgaaagttcagcagagctgtgttctcaaggttaatatccactgcgatggctgtgagcaaaaagtcaagaaactgctgcagaaaatcgatggggtttattctgtgagagtagatgcagatgaagggaaagtggtagtggcaggagatgtggatccagcgaaactggtaaaaaagctaaagaggggagggaagcatgctgagatatgccagaaccagaaaggagaaatgatgtgtaatcagattcagaactatcctatcaatccccaattccagaacatgcaacttggtattgggggaaaggacaacaataataatcacaagggtcagaaagagaaaggtactgctgcggctgctggtcaactagcacacttccctattcttaaaggggttcaggatctcaaggtacctgccaaggaacaaaagtctgtcaagttcaacttgccagaggaggatgaatttgatgccagtgatgatggttatgatgaggatggattaggccatggacatccaatgcagaacaagatcatgcccatgatgattaatcacaaccataaagacaattctggtgggagtaggaatattaatggaagtgttaagaaagctgacgtcattgatcaggcaatgctgttcaagggcaaaggtggaaatttcgatgaggcagaagctgacaatgatggaggaaagaaaggtagtagtagccaaaaagatgaaatcaagaagggggatttggataagcctaaggcagtcggtgaggtagattttcataagaaaaagaatgggaaaagtgagaatggattacttggtcggtttctaggctttgggaaaaagagcaagaaaggagaattagaagaaacaacttataccaataagagcaagaaccaaaacagtggtgctgaaaataagaaaggcaaggaagggaaattggaggatcatggtaacaatgactttgattttcatgattacgatgatacccctcctcatcccaaaaatggcaaaagtggtaagggtagtaacaatgtcaaagaaggccagatgggcccgggcccaataatgggtaataatcttccaatgcgtcatcagatggagaatattcaagcagtacaaggacttccggcgatgaatggtgatggtgggtattatcaaggggtgcaaatgcaacatgctccatacaataaccttcagcagcactacatgggtatgatgatgaaccagcatcaacatcagcaagcaaatatgaacaacaacatgtacccaacacccatgatgtatggtaggccgcatccatctatgaactacatgccaccacctcctatgccatctcacccaattgccgatcctattactcatactttcagtgatgagaatgttgagagctgcagtatcatgtaa

SEQ ID NO: 22546 - DNA, 804 bp, Glycine max
  Peptide Sequence Number=SeqID_114231
atggtagaacctggaagaggtaagaggaagtttttcaaaacgcaaggccataaaaagtcaagtaagaaagcaaaagtgatgccaccacaacatggacaaaagaaagttaaaatagacaaaaaaatgaagaaacttttccgcaagcgagcacgggagtataattctgatgatgaagaagatgatgaggccactgtccctgctaccttagagcctaaaagtctggcatctatcaccaataaaagaaatgacaaggatggcatagaaagtgaggataggtctgaggatgaaggagctgctggaccacaaaaaacatggaataagaatgctactgatatgaattatcatagctctgatgatgaaggggaagatgatgatgaaattcagccaggaattacaaaattcacggaaggatgtagagcattcaagatggcctttaggaatcttatgaagaagagtgttcctgacgacatgttgggtccaatattgtcagggcaaaggaaacttgttgtagataaacttgcagaagaggaagcagaacgcaaggtcaagggagaggccaaaaaggaaaagcagatgttggcagaaaaggggcatgtcaaacctgctacttacttggattcacatgaaaagtttttaataagtgttgctacaaaaggagtggtcaagctgttcaatgctgtcaataaggcacaaactgctcagagggggctggacccctcaaggactaaagatgcaaaagtactacaattagggatggaaatgagccaagccgcttgtcaagagcctatggctcggcctatttaa

SEQ ID NO: 22547 - DNA, 2928 bp, Glycine max
  Peptide Sequence Number=SeqID_114232
atggcggagcaactccgcaagacgacgctggattccgggtgggtcgcggcgaggtccacagaggtccaattcaccggaacccagctcaccactactcactctccaactggccccacttctccatggatggaagctctcgttcctggaactgttctggcgaccttggtgaagaacaaagccgtgcccgatcctttctatggactgcaaaatgaacacatcattgacattgctgattctggaagagactattacaccttctgggataccactaattacttgacctttttgcatttgcagtcaagcaatgagcattgtgatcttaactttcgtggaatcaattactctgctgatgtgtatttgaatggccacgaaatcatcctaccaaaagggatgtttcgaaggcactcccttgatgtcaccaatattcttcatccggatggcaccaacctgcttgctgttcttgttcatcctccggatcatccagggagaattcctcccgaggggggacaaggcggtgatcatgagataggaaaggatgtgactacacagtatgttgaaggttgggattggatggctcctataagggataggaatactggaatatgggatgaggtttctatttctgttactgggccagtaaaaataattgatccactcttggtttcaacattttctgatgattataagaaggcatatctacatacaacaactgagttggaaaacaggagctccttgactgctgagtgttctttgagtgtcctagtgacaacagaacttgaggatagcatttgcttagtagagcatcatcttcaaactcaagatctcacaatcccggcaaactcacgggtgcaatatacatttcctgagcttttcttctccaatcccaatttatggtggccaaatgggatgggaaagcaatctttgtacaatgttgttattagcattgatgttaaaggatttggtgaatctgattcatggagccatcactttggattccgcaaaattgagagccatattgatgatgctaccggtggaaggttatttaaagtcaatggagaaccaatttttattcgaggaggtaactggatattgtcagatggactactgcggctctcaaagaagcggtataatacagatatcaaattccatgcagatatgaattttaacatgattcgatgctggggtggtgggctggctgaaagaccagagttttatcattactgtgattgttatggccttctggtatggcaagagttttggattactggggatgttgatggacgtggtgtcccagtgtccaatccaaatggtccactggaccatgaccttttcttgttttctgcaagagacacagttaagcttctaagaaatcatcctagtcttgccctatgggttgggggaaatgaacaagttccacccgatgatataaatgctgctcttaaaaatgatctgaggcttcatccttattttgaaagtgaggatgaaaatagcaaacctgtaggagactggttcccaatgtcaacagatttcagtcagtatcttgatggcacacgcatttacatacaaggttcaatgtgggatgggtttgctgatgggaaggggaacttcactgatggtccttacgaaattcaaaatcctgaagatttcttcaaggatcacttttataattatggattcaatccagaggttggttctgttggaatgcctgttgcagctaccataagagcaacaatgccctcagaaggatggcagataccagtgtttaagaagcttccaaacagttatgttgaagaagttccaaatcccatatgggaataccataaatatattccttattcaaaaccaaccaaggttcatgatcagattcaactttatggtgatgctaaagaccttgatgatttttgtttgaaggctcaacttgtgaactacatacaatatagagctcttctggagggatggacttctcgcatgtggagtaaatatacaggtgtattgatatggaagacacaaaatccttggactggtctgagaggtcaattttatgatcatctacttgatcaaacggcaggtttctatggttgtcggtgtgctgcagaaccagttcatgtacagcttaatctggctacatatttgatagaggttgttaatactacatcagaagaattgtctaatgtcgctattgaagcttcagtgtgggatcttgacgggacatgcccatactacagagttcatgaaaatttctctttgctgccaaaaaaagtagcacctattgttaagatgaagtatccagagtcaaaagatccaaagcaagtctactttcttcttctcaaactctataacatggcagataatagagttatatccagaaacttttattggttgcatctttctggtggagattacaagttattggagccatatagggagaagaaaatacctctcaagataacatcgaaggtttcagttgaagaatccatttataatattcaagtgcttgtgaccaacacatctacaagatcagactctacaagttcaacaggtaggttaagtgatggtttttatggcacacactcattggaaactctggattgtggggttggaatagaacaagaaactggtgggtccaagaggatacataaatgtttttctgggaaaagtgatggtttgaaagttactgaaataaatggacctgatgtaggcgttgctttctttcttcatttttctgttcatacttcaaagagggactacgaggaagggaaggacacaagaattcttccggttcattactctgataactatttttcactagtcccaggagagaccttgcctataaatatatcttttgacgttcctcagggtgtcactcctcgagttatcctgcatggctggaattatgatggaggtgaaatcatttgtgaagttgtatag

SEQ ID NO: 22548 - DNA, 2394 bp, Glycine max
  Peptide Sequence Number=SeqID_114233
atgggttatggttacggtcctttctctctcctattaaacagacgcctccatctctcttcttccctaaaccctaaaccctctttcccactccttcaccttctcaccaagcccttctccaccgccccaccagaccctaaccctaaccccaaaccctcttccctctccgcccgtctcagcttcgtcttcgaccaaattgatgccatcgaaaaacagcgctctcagaagcatgaaacgcttcagcgcattcgggcctggcgtgaatccaaaaacgcccccccggagccggcactgtccgtctccgcagacgacgaaagccctccggagccgccacccaagaaggcggtggagttggtgcatccgtggccggagtggatccaattgatggagatgctcgtacaccagaattacttcgatcacaaaaggagggacgaggataaaatggtccacgacttaggattcaatgcacccgaggttgctgaaggattcgatttcactaaggattttaagagcgttcacatggcgtgtctcagtttcgggagagaccgttttgatatattgaggtccttgtcaaggaaggatattcaagttttggttggttatggatgccccactgtggacagaaaagtggttttctctgcaaaacttttaaggaagcatgttcaccttgacgaaggagatgtctgtagttcctgcagcttgagaagcaattgtgaaagggggtatttgctaacaaacaaagaggatgaggcacggactcttgatgtcatgaggctcctgctgacttttggttttgatcctgttgatggatcagtgatcaataagtcacttctaaagcagaagtctgtgaaaacagtggttcgtaaattgcttcatgaggttgtcaagctgagttcagttcccattgatccaaatcttcctcctccggtgattaaaaaaccaccaccaaaagtgaaacaacctcctcctcctccaaagagacgtgttgggcgggatgacgttgagatgaaaagaggggactggctgtgtcctaagtgtgaattcatgaattttgcaaagaatactgtttgcttacagtgtgatgccaagcgtcctaagagacagttgctgccaggagaatgggagtgccccaagtgcaatttcttgaattacagaaggaatatggtatgcttccattgtgagtgtaaacggccacctgatgagtttctggagaataaaatgcaagatagaatacagaattccaaacctaagttggataagaagggcagccgacaagaggtttccaatgcctggaattttgactttgatgacaatgaatcagatggtgcagatgtagctgcttttgagtatgcagatactcatgctatagatgagaattcagataatcatgctcaacgtggaaatgatagggggtgggaagatgattttgagaagaacaacagagtgcaagggtcccctgatggagaatatgctaatcctggtctttatagatctagaacagggtttgatgattttgaggatgaagatgatatagatagttatgagctagaaactgctcaaaatagtagtaaaagagtggaagaatctaaatataatttctcagaaggtgaaaacttttctgaatcggaagatattgaaggcactgatgataagatgcatgcacgacacaaaacagcttctggaagaagtgttcagtcccgatcaattcgcaagaatacgtctttctctgggtccaaggatgatgaacttgattttggtaccgatgaacaactgtctgtggtctccaatttcaaatatgggcacgtttctgcttctgacagaaaaagaaaaggcagaggtccttccaagaaattaagctttggttctgaatctgaggaagacatgggtggtggcttatactctgatgaggatgacaaaataaggggaatagacacgattctggaagaaggaactttaccaaagacaggaagtcaggatctattggtggtcgccgagcaaatatgctcagtgatgattttgatggatcatcccagcagtcttataggaacagtagggggtctcagggaaatgaccgtaatcggaagagttttgaagattttgatggaccgtctcggcaatcatatggtgatggcagagggtcccgaggaaacaaccgtaatggatcatcccggcagtcttatgggaatggtagggggtctcgaggaaatgaccgctataggcagagatttgaagattttgatggaccatctcaacgatcatatagtgatggtagagggtcccgtggaagcaaccgcaatggatcatcccggcagtcttatgggaatgatagaggatctcaaggaaatgaccgtagatggcagagatctgaagacagggagaatagcacaggacggttaa

SEQ ID NO: 22549 - DNA, 1269 bp, Glycine max
  Peptide Sequence Number=SeqID_114234
atggaggttaaatccagagctcccgggaaaattatcctaaccggcgaacatgctgtggttcatggatccaccgctgttgcttcttctattgacttgtatacctacgtttctctccacttctccactccttccgacaacgaggattcgttgaaactgaagctgcaggagacggcgttggagttctcgtggccaatcacgagaataagagcagcgtttcctgaatccacggctcagctatcttccacgccgaactcatgctctgtggagaatgccaaggcaattgccgcactcgttgaagagcttaacattccagaggccaaactcggactcgcctctggagtttccgcctttctctggttatactcttccattcaagggtccgaaatctatcaactctctatccatttttcttctatttcatcattcaaatccttttctcctgctactgttgttgtcacttctgaacttcctctgggctcaggattgggttcatccgcctcgttttgtgttgcgctggcggccgccttgttggcttatactgattctgtctctctggatttgaaacatcaaggatggctctcctttggggagaaggatcttgagttggtaaataaatgggcttttgaaggggagaagatcattcatggaaagccctctggaattgacaacacagtaagcgcatatggtaacattatcagcttcaagtcgggtaacttgacacatatgaagtcaagtgtgccgcttaaaatgctcattactaacaccaaagtagggaggaacacaaaagcattggtggctggtgttggagagaggatgctaaggcatccagatataatggcttttgtgtttagtgctgttgattctattagcaatgaattgacttccattctcaagtcacctacaccagatgagctctcggtaactgagaaagaagagaagatagaagaactaatggaaatgaatcaaggtatgctccagtctatgggggtcagtcatgccacaatagaaactgttcttcgaacaacattgaagtataagttagcctccaaattgacaggagctggtggtgggggctgtgttctgacactgcttccaacatcacattttagaaacttcaagcattttccctctccttcaaatcctctaaatattggaggtgagacaaaaatattagggaaggggtttttacttccttatttcccctccaacaaaacactatgccaaaagggttgtcctgaaagttctgatatttatgtgctacctggttaa

SEQ ID NO: 22550 - DNA, 1803 bp, Glycine max
  Peptide Sequence Number=SeqID_114235
atggctcacaaaaaagatgagaagtctgttttacctgaaggaaaatcaacaaggcaaaacagagataaaattaaacttcagggtttgaaacagaaggttgatcatgcagtccctggagttggttcatcaactaaacatagaagtagacgtaagacgattttacagagaccattcacacctaaagagaaatcttctgagaaaatattgaaaagtaaacagaataagaatttgaccccggtccacggtggggcattaaacattttagttggtacgtatcaggaaaagctttctggttgtttgtcatcttatatggttcgtcgatggtgtatgtttgaatggttttatagcgcaattgattatccatggttttccaaaagggagttcatggaatacttaaatcatgttgatctagggagaatcccaaggctaactcgtgttgagtggagtgtcattagaagttcccttggcaaacctcgcaggttttcagaacgctttcttcacggagaaagacaaaaacttgaacagtatcgtgaatccgttcggaaatattacgatgaactgcggactggtatcagggatggacttccaacagatttgtctaagccgttatgtgttggacaacgagtaattgctttccactcgaaaaaaacaagagagattcatgatggcagtgtgcttacagttgaccatgacaattacagagttcagtttgaccgtcctgaattgggtgttgattctgtcatggacattgattgcatgcctttgaatccattggatactatgccagaaactctgaggcagcagattagtgctagtaatgttcctcgcataagtaaaaaaccacacaagaaaggaaattcacgctttggggggaacatgacatataattcaagtggacctgtggagaaggcacccacctcttcaagtactttagcattagctaagcccaaaaaggcactgtcaccggggaaattgttattggaacttaaaaatgcaaatagtgagatagtgggaaaccaaaatgatgcagactgctttaatgatcggaggctttcaagaagcattacgccacatgttatacagcttaaggaagccagtggacaggcatgtggcttccgtggattattgttttgttattacagcttaagtatagtttttaatgctctgtgttattcgaggaaacataatacagagcacatcagaaactctccgccaccacagatgaatcccaaagcaagttttgacaatcatgacagccttcccaatacaatggatggttctctggtgcaagagttagggtcagctgttgaaattattaaaggatccaaacttagagcacatgctatggtggatgctgcatttcaggcattgtcttcgacgaaggaaggtgaagatgctttgacgaggattgaacaggcattggattgtgcggataatcagcagctggcaaccaactcaaggttacctgtgattaggtcccaagggcaaattagtggaagttttgattaccataatcggtcaatttctcatccatcgaagcctctactcaataatgcatctggtagaaaactgcataatgattctgacaaagttaatactcaaattctcctggacctcatcacttcctgtgtcgccacagggatcacgatacagacttgtgccaaccaacaatgtcctccagctgatgtgactccaatatttgatactgctgttaccatcctgcatccacgcagatatgctgaaatagaagtttctggccatctatatcatggtcaacagggtcaagcgctggaattagtatag

SEQ ID NO: 22551 - DNA, 381 bp, Glycine max
  Peptide Sequence Number=SeqID_114236
atggcaaactcgtatacgtggctcttcctcgcgatttctgccaccctcttgcttcttctgtcttcgtcgccgacagcggaacgcgggagcgctgggcatggaaatgacatggataccctccatgcccatggaagaggagttccagctggacagcgagatcagccggcgcatcttagccacgaccaagtacatcagctacggtgcgctgcagaggaacactgtcccctgctctcgccgcggagcctcttactacaattgccagcctggcgctcaggccaacccttacagccgtggctgcagtgccatcaccaggtctttcttaagattgatgagaatacaaacacggaagatacaaagttgggaggtggagtgaatgaatag

SEQ ID NO: 22552 - DNA, 936 bp, Glycine max
  Peptide Sequence Number=SeqID_114237
atggaggattggggggagcaggtttttggtaataatggtgtttggaagtgttgtgctggctggctggctggcaatgcatatcatgatatgctgggacaacaggctatatttgcagaacatacagctgtatcatctgctagtcatccttgcccgtatattgcctactttggaccaatacatccctccacctccaattctggcttaactgtttccgaagcttctaatttcaaccactggaatggtccacctgtacctggtgacatgccaacctcctacacatttcctgcagtggatcttcattatcacagttgggaacacaattcctctcatttctcttctgccaacagccgtctaggcacctcagaacagacctcagtatcacctggtagtcaaaggcctgcccggggtggttcagatgtccctagatccgggtcttttatgcatcccttccttgttggtcacagttctgctgctagggctgggaactctgttgcatcttcaatgatccctccttatccaggcagcaatgctcgggcccgtgatagagtccaagctcttcaagcatattatcaacctcagctacctcataattctgccacaatacggacacctgttgcttctagcactcgaagatccagtagtcatagtgggtcagttcaattagcaccagtggcctcgtcaccagaccgaagtgctggcttcgtatatattccatcaggttcttcaggacacaattttcaggaagaaacccatctgccaagtcgattccatgctagggaaagagagcacttgccttcattgccattaaaccatgttggtagagaatcaagttggcgagcataccaccagactgccagtgtgtcagacccaagtatcagatccagcagctttcgattaaggcacgaatccgacagaatgccttcacaaaatcggtga

SEQ ID NO: 22553 - DNA, 324 bp, Glycine max
  Peptide Sequence Number=SeqID_114238
atgcatctccatctctcaaacccaaaccagagcttagatccactctcaccggaaattgaggggatccgctaccgtgaccctatcgtgtcgccgtcgtgggactgggcgcctctgggcttacggcttgcacagaggacgccgccaagctctttggagaaattctccatcaaagttgaggttgagagttttggaatggatggctctggcaatgtgtaccattgccaaagtttgctaactaatggcaagtatgtttatgtgattggaactaaaggcttggagtcatcctctggtgaccccaacgtgtatacttttgttcttctatag

SEQ ID NO: 22554 - DNA, 1968 bp, Glycine max
  Peptide Sequence Number=SeqID_114239
atgaagataaaagaagctaaacctgtgtcaagctcaaggttcagacgaaagaaaagtcaagtcaatgaagggcaccaaccaagggagagaaaaaggatagcttttgactccaagcctcacatttttgcaacagacatagccaactttggaaacgatctttcatctaaatacacacacatatttcaaatcatcacaatcgcaccaacgcgctctcccgagggctttgtcggaggattcttacgcctgaacgagtcctctccttgcgtactaggttggtgctcaattaaaaagaatggggggagatgcacagaagaagagaattgccataattggcgtgtctaccttcttgctggtggccatggtggtggcagtgacacttcctcgatcaaggccgtgaaaaccctttgcgcacccaccgattacaagaaggaatgcgaggacagtcttattgaacatagcaacaacatcaccgacccacgagaactcataaaaatcgcgttccacgttaccatctcaaaaatcggagaaggacttgagaaaacagaactcatgcaccaggtcgagaacgaccccagaaccaaggaggcactcgacacttgcaagcaactcatgaacctctccatcggggagttcacgaggtcactcgataggtttaccaagttcgacttgaacaacctcgacaacatcctcaccagtttgaaggtttggctcagcggtgcaatcacgtaccaagaaacatgtttagacgcatttgagaacacaaccaccgatgctagtctaaaaatgcaaaggctcttgcaaagtgccatgcacatgagtagcaatggcctttctatcatcaccgagttgtctaaaactctctcggaaatgcacatcggcaaacctggccgccgacgccttttgaacaacaacgttcttggccacgactactttgaccttcccgaatgggttgatgatcaagttggtgttcgcaaactcctacatatgactggacggaaacgcatggcccatgtggttgttgcaaaggatggcagtggaaatttcaccaccatcaatgaagcattgaagcacgtgcccaagaaaaacctaaggccatttgttatctacgtcaaggaaggagtttacaacgagtacgtcgaagtttccaaaaatatgacccatgttgttatgattggtgatggtggtaagaagtcaaggatcaccggcaacaaaaacttcgtcgatggggttgggaccttcagaaccgccagtgctgccattctaggagatttcttcgttggcataggtatggggtttgagaactcagctggtgctgaaaaacatcaagcagtggccttgagggttcaagctgacaggtccatcttttacaaatgccgaatggatgggtaccaggacacactttacgcccacaccatgcgtcaattctatcgtgattgcataatttcaggtaccatcgactttgtctttggtgatgcagtggctgttctccaaaattgcacttttgtggtgcgaaagccattggaaaaccagcaatgcattgtgactgcacaaggcagaaaagagatgaaccaaccatcaggattaatcatccagggaggaagcattgtggcagaccccatgtactacccagttaggttcgacaacaaagcttacttggcccgtccatggaagaatttctcgagaaccatatttatggattcctacattggtgatttgatcacacctgatggttacatgccatggcaaacattggagggtttgaggggaatggatacttgtttctactctgagttcaacaaccgtggtcctggttcagacaaagccaagcgtgtcaaatgggaaggaatcaaggccctcgattcagatggaatatcaaacttcttgccagccaagttcttccatggagatgactggattagggtcactagggttccttactactctggccaaccctcccccactcattga

SEQ ID NO: 22555 - DNA, 228 bp, Glycine max
  Peptide Sequence Number=SeqID_114240
atggcacaatacaacgaagtgacgaacagagacgcgcagttgacggtgattgggaaagagcacgatgacgacggtcgagagcacgacgacacgattacgcttgtacgcataacctggaatctgagaggaggtaaggccaaatttggacaaacaaaaaagaagataaaatgtaaatacaagaaaaagaaggacttatattggcgatttagacaaaagccaggggtataa

SEQ ID NO: 22556 - DNA, 654 bp, Glycine max
  Peptide Sequence Number=SeqID_114241
atgtttcaggcatggagaagtgaggaaaacaagctatggacaactgaggaagacaaggttagtatggccattttgaaaaattgggaggtgcaggaagcaaaaagaggtgcaggaagcaaaaggccgcgaaatggatatatgttttgggcgtatttgtttacgtcggaatcgatcttaaggctggggctttatcggttccttgttcgaaggactggcagcaatttcaatgctgttatactcaagcgcttgttcatgagcaaggttaacaagcctccaatttctttgtcaaggttaattaagtatacaaaggggaaggaggataaaattgctgtaatagtggggactgtaactgatgatatcagagtatatgaagttccagcattgaaaattacagcactcaagtttactgagagagcacgtgcaagaatagaaaaggctggtggtgaatgcttgacatttgatgagcttgcccttagggctcctttgggacagaatacggtccttcttagaggccccaagaatgctcgggaagctgtgaaacactttggtcctgctcctggtgtgccacacagccataccaagccctatgtacgagcaaagggaaggttcgagagggctagaggaaggaggaacagcagaggatttagagtttaa

SEQ ID NO: 22557 - DNA, 225 bp, Glycine max
  Peptide Sequence Number=SeqID_114242
atggcagattcagatgctgtctgggagaagtttttgccattgaatcatcaagaaattgtttcaaggttggtgcccccctcattgctgtgttcctctaagaaagaattgtttgtcaagttatgtaaaccacgaccaattgacgacggtaacaaggacttgaatagtcactttcttaggaaacttgttgaaaagcaaaaaatcacttttggaatggagaatttataa

SEQ ID NO: 22558 - DNA, 2445 bp, Glycine max
  Peptide Sequence Number=SeqID_114243
atggcgaatacgatgcctgcatgttatgaggtatatataaccaatcctagtcgaatctggcaaactgataaagtcctcaaaacagagctccctattatcgctttccaaattgcctttgtcgttgtgttgtctcgtattttcttcattatctacaaacctctccatcaaactcgcctcatttcacaaatctctgttggtttcttgctaactccaccattacttgggagatacacaccaatttttgagttcatatttcctgtaaatggtgtcctaaatgttgaagttctttcccaccttggtctcatattttatgcattcctcagcggtttggagatgaacttagataccattttacgagtgaaaaagaaggctgctagcattgcggttgccgggatcgtctttccgatggtgatgggcccatgcttatatgctttgtaccgaaaaatttacggcagtcatggagtattcccccttgaagaaagtacagttaatgcttatttactttggactttaattctcacagtcacaggttttcctgtcatagctcacacactttctgagctcaagctcatttatactggtcttggcaaagctgctttaacagcagccatgatcagtgacacctacagttggattcttttcactttacttgttccatttgcaattaatggtcaaggagctatctacacggtgctaagcacgttagtattcattgttgtatgcatctttgtggtacgtccaatcattctacggtttatggataacaaggtagacaatgatgagtgggatgataacgaattactctttgtggtgatgggggttttggcttgttcactcattacggatattcttggtgctcatggcattgttggggcttttgtatatggattgattttacctcatgggaaatttgccgacatgatgatgtctatttcagatgattttactggaggctttctggcaccactcttcttcactggcaatggaatgagacttatcttatcctcagttttccaaggaaattggcccttaacactactgattatactcttgttgtgttctctaaagattttaagcactttatttgccagtttcttctttggtgtgcacactaaagatggtttagccatgggcttgcttctcaataccaagggtgccatggcactgatcatgctaaacattgcttgggatagagcgattttttctgtacctacctatgcggttatggcttcagctgttcttctaatgactgtagtagtatctcctgtcatcaatgcggtctacagaccaagaaaaagattcgagcagaataagctaaagactatacaaaaactaagagtcgatgcggagcttcgaattctagcatgtgtccacaatactcggcaagccacaagcatgatcagcataattgaaacttttaatgccactagacttacccctatacatgtttttgccatgtaccttattgaacttactggacgtgctgctgcccttgttgctgcacatatagagaagcctagtagccaacccggagaacaaaatctcaccaaatcacaggcagagttagaaaacattgccaatgcatttgatgcatttggagaggcatatgacgctgccagaatcgaaaccttaaatgtggtgtcatcctatgcaaccattcatgaggacatatacaactcagcaaatgagaaacacacaagcttaattgtccttccattccataaacaattaaattcagaaggtgcgcttgaagtaaccaatgttgtgtacagagatataaaccaaaatgtaatgcagcatgccccttgctctgtgggaatatttgttgatcgtgattttgggtcaatccccaaaacgaaccttcgtattcttatgctttttgttggaggccctgatgatcgtgaagccttagctgttgcatggaggatggcaggacatccaggaattaaactatcagtgattcgaattcttttgtgtgatgaagcagcagaagtagattcttcaattcatgctgaagcacgagggatattgtcttctgtaatggatagtgagaagcagaaagagttagatgacgattatataaattcatttagatatacggcagtcaacaataaggattatatatcttactcagagattgatgtccatactggtgaagatattcccgcaatcctcaatgagctagaaaaaaatggttgtgatttgtacgtagtgggacaagggaattgtaggagctctaaagtcttctcaaatttgctagaatggtgtgaatgcttagaacttggagttataggggatattttggcctcaaacaattctggttcgcgctcatctttgctagttgttcaacaatatgggtatggaggaatggcttttggaaataatctccaccaaaagggcaccaataacgatggatttgagtcacttgttgtgaagacagagtaa

SEQ ID NO: 22559 - DNA, 306 bp, Glycine max
  Peptide Sequence Number=SeqID_114244
atgactgatgacagtgaagtgtcattcaataacttatgtgtagccttccacaggttgcacgaatactctatagagacaggcctagcaacaattattgatggtgatgacattctaaaagttagtaccaaacatctgagggaccttacttttcaagttggctctgtctaccaattcattagtgaactccttatccaagctgtaatgaggcgtggtgttctgcagactacagtgctcatcatggtcatggcatcaaagatcgttaggtatgagttaggcttagctgggatgcttcacgggggcatttag

SEQ ID NO: 22560 - DNA, 1824 bp, Glycine max
  Peptide Sequence Number=SeqID_114245
atgtcgtatcgaccttccgccaacgccaggaccgaggttcgtcggaaccgctacaaggtcgccgtggacgccgatgaaggtcgccgtcgccgagaggataccatggtggagatccgaaagagccgtagggaagagagtttgcagaagaagagacgcgagggtctccaatcgcagcagattccttcgtcacttcactctactgtaatagagaagaagttggaacaccttccagccatggttacaggtgttttcaccgatgacaataacatgcagttagaggccacaactcaatttcggaagttgctttcaattgaacgtagcccaccaattgaggaggttattcaagctggtgtagttccacgctttgttgatttcttgatgagggaagattttccacagctgcagtttgaggcagcttgggctttgacaaatatagcttctggaacatctgaaaacactaaggtgataattgatcatggtgctgtcccaatttttgtaaagctacttggttctcccagtgatgatgtccgtgaacaggctgtttgggcattaggaaatgttgctggagattcacctagatgccgtgatcttgttctcggtcatggagctttgcttcctctattggcacaattgaatgagcatgccaagctttctatgctaagaaatgctacctggacactatcgaatttctgcagggggaaaccacagcctgcttttgatcagaaattaacaaagactagtggtgaaggtagaagggaagggggagagaggtcgcaggttaaacctgcacttcctgctcttgccagtcttatccagtcaaatgatgaagaagtcctgactgatgcttgttgggcactttcatatctttctgatggtacaaatgacaaaattcaaggtgtaattgaagctggtgtttgtagccggcttgttgaccttcttttgcacccttccccttcagtgcttattcctgctcttcgtactgttggaaatattgttacaggagatgatttgcagacacaggtcatcattaaccatcaagctctcccacgtcttctgaatatcttgactaataattataaaaaaagcataaagaaggaagcatgctggaccatatcaaacatcacagctgggaacaaaaagcagattcaggatgtaattgaggctagtataattgctcctttagtccatttgcttcaaaatgctgagtttgatatcaagaaagaggctgcttgggcaatctcaaatgctacttcaggtggatctcatgaacaaatcaagttcctggtaagtcaagggtgtattaggcccttgtgtgatcttctcatatgtcctgatcctaggattgtgacagtttgtttggaagggcttgaaaacatcttgaaggtaggagaagctgagaaaaatgttagcaatactgatggtgtgaatctatatgctcaaatgattgatgatgctgaggggttggagaaaattgaaaacctccagagtcatgataacactgagatttatgaaaaggcagtgaagattcttgagacatactggatggaggaagacgacgagactatgcctccaggggatgcttctcaatcagggttcaactttggtggcactcaaccacctgcggtgccttctggagttttgactggtctatcagtaaagtcctccagtttgacagtccaacagtttggggtcaagtcaatgtcctttgattgcccttggctcctacaaggttcagccttgttttccttgaataataatctcttgttgacaaccaaaccaagagttagcgtggactcttcttccatcgttgacatgacacattaa

SEQ ID NO: 22561 - DNA, 540 bp, Glycine max
  Peptide Sequence Number=SeqID_114246
atgtttttgtgggattggttttatgggattctagcgtcgcttggcctgtggcagaaggaggccaagatcttattcttgggcctcgataacgctggcaaaaccaccttgcttcacatgctcaaagatgagagattagtccagcatcagcctacccaatatcctacatcagaggagttgagtattgggaagatcaagtttaaagcttttgatctcgggggtcatcagattgctcgaagagtttggaaagattactatgcccaggtggatgcagtggtgtacttggttgatgcttatgacaaggaaagatttgctgagtcaaaaaaagagctggatgctctactctctgatgaatctttagcgaatgtccctttccttgtccttgggaataagatagatattccatatgctgcctctgaagaagaactgcgttaccatttgggcctgactaacttcaccacaggcaagggtaagtattgtgaagaaaatgggttatggggatggtttcaaatgggtttcccagtacatcaaatagtccgttag

SEQ ID NO: 22562 - DNA, 432 bp, Glycine max
  Peptide Sequence Number=SeqID_114247
atggaagaggtagagcccagaaattataatcgtcactgcctctggcttgaggaaattttcaaccttgttggcgtgctggatactactgctcagtttgtgagtgtgtgtaaaccgtttgatgaaacacaggttcaggaacgatttgaagttcttaagaagcgtaaagatgttggcagcttcacagagcaaggtaaagccttggataagagaagtccacaccaagatccgccactaggcgtggcaaatagtcccatacccgtggatcttgatgagcggattttaaaacagcagcaagaagaggaagaaagaaagcgactgcgtcgagaaaagaaaaaagaaaagaaggagaaggcagttgaagaacctgaaattgatcctgatgttgctgccatgatgggatttggaggtttccggtcatccaacaagaaatga

SEQ ID NO: 22563 - DNA, 330 bp, Glycine max
  Peptide Sequence Number=SeqID_114248
atggaggacctaattcccattttattccaatacgttcgaagtcgtgagaagcctgggggagatgtgttatttgtagctcacaatgctcgctgttttgatgtgcccttcatcatcagaacaacactttcttcatcatccctagctgcccttcgtgacctctacggaattaaggtggatggatcagctcacagggctatggtagatgtgaacacattgtcgttgattctttccaggttgacctctgatctgaaattgaccctatctgaccttgtcgacaaatcattcacagaatcagatattatcaactctaagaagaagaagaagaattag

SEQ ID NO: 22564 - DNA, 234 bp, Glycine max
  Peptide Sequence Number=SeqID_114249
atgtctagcgacttcagcagcactgttacggcgccaccgcaccacttcacgcattccaaacatttcaattcggtctccgttgttcagctgaatgtgagtaggggaagcagacacgtcacacggacacgtggcagcgctgccactgtattttacaaaacaagaagggcattccggtcattgagtaggattgatcgagtgaataatattggaaatgatggatctgaatgtgaatga

SEQ ID NO: 22565 - DNA, 708 bp, Glycine max
  Peptide Sequence Number=SeqID_114250
atgttggatatgttatcattccacttgagtaaggaagacctttggaatgatcctgtgcgtgttggtaagataagccgagagcatggctcgctcctgggaaaaatgaaagaggaatcattgaaagcattgcttaacatgagaagaaatgcaaaagagaaagagctagaagcattgctttctggggagcaagattcttgttcatgctacattgagatgtataagttatgggcacagcgacgtggatataaagtaactgtagtggatgaaatgcctggtgagattacaggaatcaagcgagctaccatcaaagtagatggtgagtttgcatttggatatgccaaagcagaaataggagtgcacaggctggtaaacatatcaccttttgacagtaataagcaccggcatacttcatttgctgctgtggcagtgattccaattcctggtgatggatctacccatgtacaaattaatgaatctgatcttcgtattgaacgatttcgtgctggtggccaacatgttaacacaactgagagtgctgtaagaatagttcatattcctacaggagttactgcaacttgtcagaatgagagaccgcaacatcagaataaggcttcagcgatggctgtactacttcagtcaaagattagaccaactggagattgcacgccaggcacagttgaatgcacaacatacacaatctcttactga

SEQ ID NO: 22566 - DNA, 432 bp, Glycine max
  Peptide Sequence Number=SeqID_114251
atggttaacccaagtactataactcccccatcctccgaagtacacacttttcataatgctattgaatcttcctctcaccaaataccaccatcctcaaacaagagtcgtggtaggccccttggatccaagaacaagccaaaaatacccctcgttattaaccaagatagcgatcttgccttgaaacccatcttcattcaagtcccgaaaaattctgatgttattgaggccgtggtccaatttgcgcgccaatgtcaagttagcatcacagtgcaaagtgcatctgggtctatcttggaagccactctctgccaaactcttcctgacacttctactttcgttaactttgagaatcacaaggctggtatcaaaggtgctggtgaggaaagggatagtagcaagaaaccttatgcatgtcatctagatgacaagtag

SEQ ID NO: 22567 - DNA, 1569 bp, Glycine max
  Peptide Sequence Number=SeqID_114252
atgagttcttcgctacctcaagttgccaagaacaaagcaatgtggctgcatcctaaggttttgggttttaatcctcctgaaagatggggccactctgcttgcttctccaacgggcttatgtatgtctttgggggttgctgtgggggactgcatttttgcgatgttctcacattggaccttaacaaaatggtttggagcaagcttactaccacaggtgaaaagccagggccaagagatagccatagtgctgtttttgtggggcataaaatgatagtgtttggtggcacaaatggcttcaagaagatgaatcacattcatgtacttgatctcgttaccaaagagtgggttcgacctgagtgtaaagggactcctccttctccacgtgaaagccatactgccacacttgttggtgatgaaagaatagtgatatttggtggtagtggagaaggtcatgctaactatttaaacgatttgcatattcttgatcttcgaaccatgagttggacttcctctgagttgaaaggtgattttcctgtccctagggacagtcatagtacccttgcaattgggaacaagcttattgtgtatggtggagactccggtgatcagtatcatggcaacgttcatatgcttgatatgacaacaatgacttggtctaaattgtctattcaaggttctccaccaggagtcagggcaggtcatgctgcagtgaacattggaacaaaggcaagagttggagataaacgttactataatgacgtttggatctttgatatctgcaattttacatggactcaacttgatatagattttcaccagccacaagggcgattttctcatacagctgttgctgctggcatggatattgcaatatatggcgggtgtggtgaagatgaacgtcctctcaatgaattgttagtgttgcagcttggagcagagcatccaaatggacgttactacattcccatgtgcaaaccttttggaacttattggaatcaagaaaagaagattatcccaggagaagcagatacccactcggtacagaagttcatgaataatgtggaaacttttggacaaggagcttatgaggttgcatcagaaaaatcgccaccttatcactttgattcaggtgggttgagttttatgccttatttggataaagttcttagtagagttgatgaaccctttgactcagtttccctctctcctgcagctgtgaatggaaggattttcaggggagtcatattttcacccggagcaggagttgtctcaaaagtggccaatgtcaaaccaaattgttctctaacaagttcttttccttcttcctctcaagcatttttgaactctaatcatgtgggtaattcaagggcttcccaacaagcacctattcgtttgcgtgcagagccatgtcatggttcacggcaaaccccagtggcattaccatttccaatcatgcgaggcacttcaaatgttgtttccaaagagcataaaatcaatagtgaccttcaaggggggttggttttaacacttggaggacctgctagtgcacatcctcaggtaaagcattga

SEQ ID NO: 22568 - DNA, 1086 bp, Glycine max
  Peptide Sequence Number=SeqID_114253
atgggtgccggtctcgttgcgttcctcttaatggttcttgtacaattggtctatgcagtgatgaacattacttcaaagcttgcaatagaatctggcatgagccctcttgtccttgttgcttatcgacaactctttgcaactgtgtccattgctccctttgcttattggcttgaatgtttcatttatggcttgtctcgtacttcttcgaaaaataatctcggtggaaattgccaggaatacgcttcccaggatcacaaaacgtcttatgcttcagatattattttcgtccctgacaggagttacaggaaatcagatgctttattttgtggggctgaaatattcatccgctacaattgcatgtgcactgaccaatttgctcccagctttcacttttatccttgcagttctcttcagacaagagaatttgggaatcaagaagagggctgggctagcaaaggccaatcaagtattcactggagatatgctgagaaaatggaaggaactagctcttctggcaaaggaaacatgtttctaggccctttagtcgtaattcttagcacccttgtttgggcagcatggttcataattcaaaaagacataagcaagactttttcagctccttacacgagcactggcttaatgtgtttcatggcaagctttcaatgcatcatcattgccgtgtgtgtcgaccacactgcctcagcttggtcactccacaatgctatgagactttcctctgctctttatgcgggaatattttgcactggattagcgtattgcctcatgtcgtggaccattgagagaaaaggtcctctttatgtctctgtatttacccctttgcagcttgtcctcactgccattttaagctgggctttacttcgtgagaaattatacgttggaactgccgtagggtctctcttgatagttttgggtctctattctgttctttggggaaagagtgaagaggtgaacaaggaagacggtattgaagatgcatttaaagaagcagtcaaggatccgaaaaatgacatggaattgcaatcatatgtgtcatccaatgttaataatcgttgtgctattgcatga

SEQ ID NO: 22569 - DNA, 1266 bp, Glycine max
  Peptide Sequence Number=SeqID_114254
atgtctgtgtctttctcttcaacctcggtttcgttctcggaatcctcatttgcattccaaagacctgctccagcacatctttgctcaaattcactcaccgttgcatcgaacaactttcattcagcaacaggtggtggtcgtcttgtgctgaatgttggaggcacctgcttgtgtcgaaagtttcgtggtttgaaactgtggctacttgagagactcagcttccaattccagccaccaaagcaacctaagaatagaaaccatcacttcaggaataatttggaaaatgaaaagggatcggtttctgattcatcttcaaatcttcgtgttcctgatgataaggtcactccggtggagtctctatcgttgctgcagacaggtttgtctggtactcccgtggatgttggcagaaagccctcactttgtattgctgtcataggagccaccggtgagctggcaaagaggaagattttccctgctttgtttgccctctactacagtggctttcttcccgagttagaggatctctggcacaccttcctcatgccaaagactgaacatcttgaatgtgagaatgtaggcatttttggttattcaaggaaggatataactgatgaagacctgcgatctattatagcttcaacattaacatgccgagttgatcatcaagaaaattgtgacaacaaattagatgctttccttagtaaaacatattacattaatggaggctatgacaataaatatgggatgtccatgctgaattctcgaatggagcaaattgagggaggatccaaaaccaacaggatattctacctttctgtgccacaagaagcacttttggatgttgcttcatgccttgcaagcagtgctcagacccagaatggatggaatcgcataatatttgagaagccatttggctttgatgcacgttcttccgataggctgacacaatatattctttcaaactttcaggaaaagcaaatatttaggattgatcatctactaggaaggaatctcattgaaaatcttacagttttaaggttttcaaatctagtttttgagccactttggagtcgtacttacatagataatgtacaggtcattttatcagaggacttgggtgtgcatccaggaagatatttcagtggctacggaattatccgtgatattgttcactgtcatgtgctccaaacaattgcattgcttgccatggaaccaccaataagccttgatggagaagatattagaaatgaaaagctactcggataa

SEQ ID NO: 22570 - DNA, 540 bp, Glycine max
  Peptide Sequence Number=SeqID_114255
atggctgcctatgtgaagtccattgatagcaatcacttactccaaatagggcttgaaggattttatggtgaatcgatgccagaaaggaagcagttcaatcctggatatcaaataggaaccgatttcatttctaacaatcaagttccggaaatcgattttaccaccatccatctataccctcagtggatgtctaggtttaatgaaacagcccaagatgtctttattaacaattgggtccaagtccatattcaagacgcaaatgatgttttacggaaacccattcttcttagcgagtttgggttatcttcaaagatttcaggatatggcgtggagaaaaggaatagtttgtttgagaaactatacaatttgatatacaagagtgcaagtaacagggggtcatgtgcaggagggcttttttggcaactactggccaaaggaatggatgactttcgtgatggctatgaagtcgtttttgaagagactccttcaactaccaatatcattactaaacaatctaagaagatgtcaagtcttgcataa

SEQ ID NO: 22571 - DNA, 332 bp, Glycine max
  Peptide Sequence Number=SeqID_114256
atggcagttccagtagttacagagttagcagatatctatcggctggctgatacgggtgcaattgtatcactgttaagtaggctaggtagttccttcataattgcagcaattgagaaaacattgtcccaaaaactggaagatgcacggagtgctgttcaactaagagttgtgaaagccctcagggaatatcgaaatctttattctgtgcaacatcgcttggcaaacagaatgatatatcctgagtctttaaagttcttaatgttgtatggattagccctttgtagatcaacagctttacgtggagggtatggcgatgttccactggatgaacg

SEQ ID NO: 22572 - DNA, 108 bp, Glycine max
  Peptide Sequence Number=SeqID_114257
atggagaagaagaagaagaagagagttgaaggagttgccatgtggcatctaaaggaaggaggtgagcagagtgtgttaggtcttgtcctgttgcccatttctggatga

SEQ ID NO: 22573 - DNA, 1725 bp, Glycine max
  Peptide Sequence Number=SeqID_114258
atgggtgctattccagaggccaacggaaatgtcgccgacgaagaaaacgggagcagcgttggtggatccatcgatttcggcacggcggaggccgttcaatacgtccgttccctcaccgacgttggcgccatgacgcgcctccttcacgaatgcatcgctcaccagagagcggtggacgttgaactcgacgagcttctgtcgcagcgcaccgacctcgaccgccatctcctccagctccagcgctcctctgacgtcctcgacatcgtcaactccgacgcagactatatgctctccaacgtcgcctccacctccgacctcgccgaccaggtcagccgcaaggtccgcgagcttgacctcgcccagtcgcgcgtccgcaacacgctcctccgcatcgacgccatcgtggaacgcgccaactccctcgaaggcgtccaccgcgccctcgaggccgaggactacgaatccgccgcctgctacgtccagaccttcctccagatcgacgcccagtacaaggattccggctccgatcagcttcagagggatcgcttgttggccgccaagaagcagttggaaggaattgtaaggaagaagctctccgccgccgtcgatcagcgcgaccaccccgccattctcagagttaaaaaagcttgtgccacgatgctcaacctcgatccatcattcttcaggttcattcggctcttcacaccgctgggtgtggaggaggagggtttgcaggtgtatgttggctacttgaagaaggtgattgcgatgaggtcgaggatggagtttgagcagttggttgagatgatggatcagcagaatgtgaattttgttgggtgtttgaccaatttgtttaaggacattgtgttggcgattgaggagaatagtgagatcttgagtggtctttgtggggaggatggtattgtgtatgccatctgtgagcttcaggaggagtgtgattctcgcggttctgtgattttgaacaagtatatggagtataggcagttggctaagttgtcctctgagataaatgcacacaacaccaatttgcttgctgttggaggaggtcctgagggtcctgatccacgggaggttgagttgtatttggaagagattctcaaccttatgcagcttggtgaggattacactgagttcatgatttccaagatcaaagcacttacttctgttgaccccgaattgctccctcgcgccaccaaggctttccggagtggcagtttcagcaaggtggcgcaggatttaacaggcttttatgtcattttggagggatttttcatggtggagaatgttaggaaggcgataaagatcgatgaacaggtgcctgacagccttaccacttctatggtggatgatgtgttttatgtattgcaaagttgcctgcggagggctatatccacttccaatatcagttctgttgtcgcagttttgagtggtgctagtagtttgcttggtaatgaatatcatgaagccttgcagcacaaaactagagagccaaaccttggtgcaaagttgttctttggtggtgttggcgtgcaaaagacggggacagaaattgcaacagctttgaataatatggatgttagcagtgaatatgttctgaagctaaaacatgaaattgaagaacataagtatggttgccgtactgtttccctatgcatggtgtgcctggggtcccattataaggatgtatgtaattctgaactgtaa

SEQ ID NO: 22574 - DNA, 552 bp, Glycine max
  Peptide Sequence Number=SeqID_114259
atgctgtctgctccaagtggtaaaggatctgaagatattgaagctgctgttaagaaactttctctggtatcaacgtcatcttcaatggatgatgaccaaattaatccattttctgttttattatcgatttgtggacagtctgcaccttcagtgttacaagatattttctctaggtattggattgttccttattttcaagtaacatgctgtcttggtttgagtgacaaaggtgatagcatactgtatttagatctttcctctgatcctgacctatttaaaggaccgaaaggggacaaacagtcagaaacatatcggaggatgaaggaggtgactgaagattgctgggaaggaagctgtcctaaaacaaacgtgttatggttgatctacttggtagacatactcctcatgaagaaatcatttgaacgtactacaaagcacgagagagatctacgatccttgaagaaacgtcttgacaagtatgattcggccaaggaagcagttcttgaccccttcttcactgatttgttcattgagtcggacccaaaggcttaa

SEQ ID NO: 22575 - DNA, 2442 bp, Glycine max
  Peptide Sequence Number=SeqID_114260
atgccccatagaaacctcgtttcatggaactccatgattgtcgggtttgttaagaacaagttgtacggtcgtgccattggggttttcagggaggttctttcacttggccccgaccaagttagtatctcgagcgtattgagtgcttgtgctggattggttgagttagattttgggaaacaagtccatgggagcattgttaagcgtggtttggtggggttggtttatgtcaagaactcgctggtggacatgtattgcaaatgcgggctgtttgaggatgcaaccaagttgttctgtggtggtggagatagagatgttgtaacgtggaatgtaatgatcatgggatgctttcgttgccgaaattttgaacaagcttgcacctatttccaagctatgataagggaaggcgtagaacccgacgaggcttcatactcttctctttttcatgcttctgcaagtattgcagcattaacacaggggaccatgatccatagtcatgttttaaaaaccgggcatgtgaaaaactctcgtatttcaagttcgttggtgactatgtatgggaaatgtggaagcatgttagacgcttatcaagtttttcgagaaactaaggaacataatgtggtttgttggacggctatgataacagttttccatcaacatggttgcgcaaatgaggcgattaaattgtttgaggagatgctcaatgaaggggttgtgccggaatacattacttttgtttccgtgttgtcggcttgcagccatacggggaagattgatgatggttttaagtacttcaattccatggctaatgttcataacattaaacccgggcttgagcattatgcttgcatggttgacttgcttggtcgtgttggtcgattggaggaagcatgtaggttcattgaatccatgccattcgagcctgactcgttggtttggggggctttgcttggggcatgtggaaaacatgccaatgttgaaatgggaagagaggtcgcagagagacttttcaagttggaaccggataatccaggaaactatatgctgctttcgaatatctatataagacacgggatgttggaagaagctgatgaggtgagaagattgatggggatcaatggggtgaggaaagagagtgggtgtagctggattgatgttaagaacaggacctttgttttcaatgcgaatgataggtcacattcaaggacacaagagatttatggaatgctgcaaaagttgaaggagttgataaagagaagagggtatgtggctgagacccagtttgcaactaacagtgtggaaggctctgaagagcagagtttgtggtgtcacagtgagaaattggctcttgcatttggtcttctggtcctcccacctgggtctccgaactcgctggtggacgtgtattgcaaatgcgggctgtttgaggatgcaaccaagttgttctgtggtggtggagatagaaatgttgtaacgtggaatgtaatgatcatgggatgctttcattgccgaaattttgaacaagcttgcacctatttccaagctatgataagggaaggcgtagaacccgacggggcttcatacacttctctttttcatgcttctgcaagtattgcagcattaacacaggggaccatgatccatagtcatgttttaaaaaccgggcatgtgaaagactctcatatttcaagttcgttggtgactatgtatgggaaatgtggaagcatgttagacgcttatcaagtttttcgagaaactaaggaacattatgtggtttgttggacggctatgataacagttttccatctacatggttgcgcaaatgaggcgattgaattgtttgaggagatgctcaatgaaggggttgtgcctgaatacattacttttatttccatcttgtcggtttgcagccatacggggaagattgatgatggttttaagtacttcaattccatggctaatgttcataacattaaacccgggcttgatcattatgcttgcatggttgacttgcttggtcgtgttggtcgattggaggaagcatgtaggttcattgaatccatgccattcgagcctgactcgttggtttggggggctttgcttggggcatgtggaaaacatgccaatgttgaaatgggaagagaggccgcagagagacttttcaagttggaaccggataatccaagaaactatatgctgcttttgaatatctatttaagacacgggatgttggaagaagctgatgaggtgagaagattgatggggatcaatggggtgaggaaagagagtgggtgtagctggattgatgttaataacaggacctttgttttctttgcgaatgataggtcactttcaaggacacaagagatttatggaatgctgcaaaagttgcacggttttcccttgatctcaaccttgaatcagtctcactgtggtgtggtgtga

SEQ ID NO: 22576 - DNA, 219 bp, Glycine max
  Peptide Sequence Number=SeqID_114261
atggcagaagaagatgcactttctcttgacaacattgaatgtggtgtatgtgctgagtacaccgatgccgatgtatatggaaggcgaaactctggatcaaacaaggaagcgttcgaaatgggagaacgacgattacatttgtcgtggacacattctgaacgacttcaagcataccttgaaacatatgaaggaagagttgactctggttcaactcggtag

SEQ ID NO: 22577 - DNA, 2157 bp, Glycine max
  Peptide Sequence Number=SeqID_114262
atggcgtggcgcgagcttggaaagaagagaatatatatgaattttactagagctttgtcgacaacaccatttagacatgtggcaggatcaaattttgcatccatctttactgtgcaatctgtttgtgcatcagcaagatgtgtgccggatttcatcaacctatcatctctgggagtggctggttttggcagggagactaaagaatgtggaatacggtgcttccatgctagttcacaagtctgggcgagaagtgatggaccattaggtttgcagaccgcaaagaggatatatgtgaaaagaggtggtagaaaccagctacctgctggagctccttatgcccgtcgtaatgtcccagctaccaaatgtaatcctgataaaacaatagaaatatttgaaggcatgacccttgttgaactggcaaagcgcactggaagatcagtatcttctttgcaggatatcctcactaatgttggcgaaaaggttcaatcagagtttgagcttctcagcatggatatcgctgaacttgtgacaatggaggctggcatcaatgttaagaggctacattcagctgaaggtgcagaaattttaccacgtcctgcagttgtaacagtgatgggccatgttgatcatggcaaaacttctcttcttgatgccttgcgtcaaacttcagtggcagccaaggaggctggtggcataactcaacatataggtgcttttgtggtggtcatgccgtcaggagcatcaatcacatttcttgatactcctggtcatgctgcatttagtgcaatgcgggcaagaggtgcagcagttacagatatagtggtgctggttgttgctgcagatgatggtgtgatgcctcaaacacttgaagccatgtcccatgcaaaagcagctaatgtaccaattgtagttgcaattaacaaatgtgataaaccaggtgcaaattctgaaaaagttaaaatgcagcttgcttcagagggcttgcttctggaggagatgggtggggatgttcaggttgtcgaggtttcagcaactgaaaaaattggactggataacctagaagaagctttactacttcaggctgatatgatggatcttaaagcacgaattgatgggcctgctcaagcatatgtggtggaagcaagactcgacaaaggacggggtccattggtaactactatagtgaaggcagggactctagtttgtggtcagcatgtggttgtaggctcacaatggggaagaataagggctattaaagatatggcagggaagttaactcgacgagcaacacctgctatgcctgttgagattgaagggcttcgagggctgccaatggctggtgatgatgttattgttgttcattctgaggagcgagctagaatgcttagttctggtaggcaaaggaaatatgaggagaacaggcttaggaataagatgatacaggacaagccaactacttcagatgattccaaggaggttccgcagtgggttgaaatgccagtaatagtaaaagcagatgttcagggaactgttcaagccgtcactgatgcattgaaaactttaaatagtgctcaggttttcgtaaatgttgtccatgttggcgctgggcctatttctcaatctgatctagacttagcacaagcttgtggtgcttgcatagttggattcaatgtaaaaagtccacctactgctcttagtcaggaagcagctcgtgccggtatcaagatagttctgcaccgtgtaatttaccacctcttggaagacataggcaatttgataatagagagggcccctgggacttctgaaacccatgttgctgggcaagcagaagtgctgaatatctttgaaatcaaagggagcaagtccaaggggcctgatgttaagatagcgggttgtcgtgttatcgatggttctgtgacaagatcagcaaccctgaggcttcttaggagtggggaagttgtgtttgaaggactttgtacatcgcttaagcgggagaaacaggatgtggattctgtgaaaaagggaactgagtgtggagtagtaatcaataattggtgtgatttccagattggagacgttattcagtgcttggaacaggtcataaggaagcccaagttcattaagtcagagagtggtgctgttcgaatcgagtgctga

SEQ ID NO: 22578 - DNA, 3663 bp, Glycine max
  Peptide Sequence Number=SeqID_114263
atgtcgcagataccgaaggagccggagcaggtgatgaagatgagaggaggatgtgtgttgggaaagaaaacgattctcaagagcgaccatttccctggttgccagaacaagcgtttgtcgcctcagatcgatggggctcccaattatcgccaggcatctgactcgttgcatgttcacggtgttgccattccaaccgttcatggaattcggaatgttctcaatcacattggcgctcgattgaaagttctctggataagccttcgtgaggaaccgcttgcctacattaatggccgtccctttgttttgcgtgacgtggagaggccattctccaatcttgagtatacgggaattaatagggaaagggttgagcaaatggaagctcgtttgaaagaagacatcctcgcggaagctgcaagatatggaaataagattcttgtgactgatgaactgccagatgggcagatggtggaccaatgggagccggtgtcatgtgattctgtgaagacaccactagaggtgtatgaggaattgcaagtggagggatatcttgttgattatgagcgtgttcctataactgatgaaaaatcaccaaaggaattggattttgatattctggttaataaaatttctcaagctgatgtaaatacggagatagtttttaattgtcaaatggggcgtgggcgaactacaactggaatggtcattgcaactttggtatacctcaatcgaattggggcctctggatttccaagaagcaattcaatcggtagaatttttcaaagtatgaccaatgttgctgatcatttgcctaactcagaagaggcaattcgcagaggagagtatgcagtcataagaagcttgattcgggtgttagagggtggtgttgaggggaaaagacaagttgacaaagtcattgacaaatgtgcttcaatgcagaatctgcgtgaagcaattgccacctatcgcaatagcattttgcgacagcctgatgagatgaaaagggaggcatcactatctttttttgtggagtacctggagagatactactttttaatatgttttgctgtgtacattcattcagaaagggctgcactccgttctaatactgctgatcactgtagttttgctgactggatgagagcaaggccggaactctacagcattattcgcaggagagatccaatgggtgcacttggatattcaagtttgaaaccatctttaaagaagatagctgaatctactgatggccgcccttctgagatgggtgtggttgctgccttgagaaagggtgaggttcttggtagtcaaactgttctcaaaagtgatcactgtcccggatgtcaaaacccaagtttacctgagagagtggatggtgctcctaatttccgagaagttcctggatttccagtttatggagtggcaaatccaaccattgatggtattcgatctgtcattcgaaggattggtagctccaaaggtggacgcccaatactttggcataatatgagagaagagcctgttatttacatcaatgggaaaccatttgttcttcgtgaagttgaaaggccatacaaaaacatgctggaatacacaggcattggccgtgacagagtggagaaaatggaagctcgattaaaagaggatatcctgcgggaagctaaacagtatggtggtgccataatggttattcatgaaacggatgataagcatatatttgatgcttgggaggatgttacctctgatgtgattcaaaccccacttgaagttttcaaaagtctggaagctgaggggttccccattaagtatgcacgtatgcccatcactgatggaaaagctcctaaaagctctgattttgacactttggcaaataatattgcttctgctgcaaaggacactgcttttgttttcaattgtcagatgggtaggggcaggacaagcactggtactgtcatagcttgccttgtgaaacttcgaattgattatggtaggcccattaaaatactgggtggtgatgtgacccatgaagaatcagactgtggttcttcaagtggagatgaaactgggggttatgtcaatacattatcctccaatacattgcaaagaaagacagacgatgaacaaaatcgtgcttttggtataaatgacatccttctgttatggaagataacaacattatttgataatggtgttgaatgccgagaagccttagatgctattattgatagatgttctgcacttcaaaacattcgtcaagcagtcttacagtatagaaaagtattcaatcaacagcatgtcgagccaagggtaaggagggtggcgttaaatcgtggtgctgagtacttggagcggtactttcgtctaattgcttttgcagcatatcttggaagtgaagcatttgatggattttgtggacaaggagaatccagaatgacgtttaaggtttggttgcatcagaggccagaggtgcaggctatgaaatggagtatcagattaagaccagggcgatttttcactgtccctgaagacttgagagaaccacaagagtctcagcatggtgatgcagtgatggagaccattgtcaaggccagaaacggttctgttttggggaaaggctccatactgaaaatgtatttctttcctggtcagagaacttccagtcacatacaaatacatggtgcacctcatgtttacaaggttgatgaataccctgtgtattgcatggcaactccaaccatctctggtgccaaggagatgctagactatttgggtgctaagcctaaaccttccctcactgctcaaaaagctatattgaccgatctgagagaagaagcagttgtttatatcaattatactccctttgtcctgagggagttaaataaaccagttaatacactcaagtatgtaggaattactggtcctgtggtggaacacatggaagcacggctaaaagaagatatactagctgagattaggcagtctggtgggcgaatgctattacaccgtgaagaatataacccctcaacaaatgagtcaggtgtggttggatactgggaaaatattcgagcagatgacgtgaagacacctgcagaagtttattctgctcttaaagatgatggatatgatattgtctaccagaggatacctttaacaagagagagacatgctttggcctctgacattgatgcaatacagtattgtcaagatgatccgtatccttattgtctagaaactgtaatcccacaatgctttggtggagtcgcgtatgcaatggccataatctgtatcagacttgatgctggatccaaagtctcacagccattattcggtcctcatatagatgccgtgactgaagaggacttgccttctcaaacttctaatgaaatggcacttagtatgggtgactatcgtgacattttgaaccttacaagggtcctcatacatggtccccagagcaaagcagatgttgacattgtcattgaaagagaatttgagaagttcatagatgatgatgacgaggaacgtgggtatcttatggacatgggtatcaaggctttgagatcgtatctctactgcacctctcctgccaatacggaatttgcagcatggatggatgcaagaccagaacttggtcatctatgtaacaatctaagaattgataaataa

SEQ ID NO: 22579 - DNA, 1881 bp, Glycine max
  Peptide Sequence Number=SeqID_114264
atggctgaccatgatgcaaaagaagaacaaaggcccctcaaccaatggagaagaagcaaagggggattcatggcttccatgttcatttttgtcttgtcagcattggacaacatgggctttgtggcaaacatggtaagcatagtcctatacttttatggagtgatgcactttgatctagccagttcagccaacacactcacaaacttcatgggctcaacctacttgctttcccttgttggtggcttcatctcagatacttacttgaacagattcaccacatgcttgcttttcggatcactcgaggttctggctttggcaatgctcacagtccaagctgcttcaaaacatttacaccctgaagcatgtggcaagtcaagctgtgtgaaaggtggcatagcagtgatgttctacacatcactgtgcttgttggcattgggaatgggaggggtgagaggatccatgactgcatttggagctgaccaatttgatgagaaggatccaactgaggcaaaagcccttgcaagttttttcaattggcttttgctcagttcaactgtgggagcaatcacaggagtcactggtgttgtgtgggttagcacacaaaaggcatggcattggggttttttcatcataaccatagcttcctccgttggctttgtgacccttgctcttggtaaacaattctaccgcatcaaaactccaggagatagccccactttgagaattgctcaggttattgttgtgtcttttaagaaccgaaagttgtcattgccggagtcacatggagaactatatgaaatcagtgataaagatgctacagctgagaagattgctcacaccaaccagatgaggtcccagcaaattggcatgttaggattctttttcatgtacctcgtagtaggtaacgccaagcactatggccccactacaacctctgcacgtttaggaacggcagagatatggggaatgaatgattatggaaggggaaaaaaatctatgcagttcctagacaaagctgccatcatacaagaaagctcaaaaccccaggcatggaaaatttgcactgtgacacaagttgaagaagtgaagatcctaacaagaatgttacccatagtagctagcaccatcatactgaacacatgtatggcacaactccaaacattctcagttcaacaagggaatgtgatggacctaaaacttggctctctaacagtgccagcaccatccattcctgttatcccacttgtttttataagtgtcctagttcccttgtatgaactattttttgtgccatttgcaagaaaaatcactaaccacccttcaggcataacacaactacaaagggtgggtgtagggttagtactctcggcaatatcaatggcagtggcagggattgtggaagtgaaaagaagggaccaagggagaaaagacccttctaagcctataagcctattttggctttcattccaatatggcatatttggaattgcagatatgttcacccttgtgggactattggagtttttctatagggaatcacctgctagcatgaaatcactttcaacctctctcacgtggttgtcaacatctcttggttacttcttgagcacagtctttgtcaatgttatcaatgctgttaccaaaaggatcacacgaagcaaacaagggtggttgcatgggttcgacttgaaccaaaataaccttaacttgttctattggttcctagccacccttagttgccttaacttctttaactacctttattgggcctcaaggtaccaatacaaacgtgaagactcaggcccaggttttaagcctttaggtgaaatgcctctcaaaagggttgagagaaaacaagattgtgaagttagccgagagtga

SEQ ID NO: 22580 - DNA, 2709 bp, Glycine max
  Peptide Sequence Number=SeqID_114265
atgtctccagctggtacaggaggaggcactgtcagtggagagcatgaaccaaagtctgatagagcagcaacaactgcttacctccatcagatgcagaaaggcaagcttattcagccatttgggtgcttgttggtcttagatgagaaaacatataaggtcatcgcttacagtgagaatgcacctgaaatgctcaccatggctagtcatgctgtccccagtgttgatgaccaccctgctcttgacattggcacttacataaggactattttcactgccccaagtattgcttctattcacaaggtacttggatttggggatctttcacttcataacaccattctagtccattgcaagacctttgggaatcccttttacgcaattatccatcttgttaccggtagcacaatcatcgattttgagtcggtccagcctcctgaagttcccatgactgcatccggttccctgcaatcctactacaagcttgcagcaaaagcaacaactagattgcaatccttggctactgtgaacatggaaacactatgtaacacaatggttcaagaggtttttgagctcacaggttatgacagagtgatggcttataaattccatgacgatgatcatggggaagtgattgctgaggtgaaaaggccaggcctagagccatatctggggttgcactacccagccactgatattccccatgcgacgcgcttttctttatggagaacaagggctgctcatagttgccacttgcaattcatggtgaacatgaattctagtgcttccttggtattggcagttgtgatcaatgacaatgatgaagatgggaatagttctgatgatgctgctgttcagcagccacacaagagtagtacgagtctatggggtttagtagtttgccatcacactactcccaagtttgttcctcaggggcggttcaaggacttgagaggcctaaagcaaatttattttttgagtatttgtcatccacgtgtgggcaaagagctagagattgagtatcagattgttgagaagaacatcctgcgaactcaaacacacttgtttgatgtgctgacgcgagatgagcccctagccattgtttcacagagtcctaatatgatggatcttgtcaagtgtgatggagcgaccctgttatataaaaacaaggtgtggagattaggggtaacgccaagtgaatctcagataagagagatagctttgtggctctctcagtgccatagggattccacaggcttccctggggctgctgctcttggtgatattgcatgtggaatgacatctgccagaataacttccaaagatatagttttctggttttggtctcacacggctgcagaaatccgatgcgacggtgcaaagcatgaacctggtgaaagggatgatgttgtcaagaacaggagcttactctggaaggtctatgaaacggatgccattcattcattgcatttaatactgagagatgcgttcaaagagacagagagcatgaagatagccacatatgctcccaattcaaggcttggttgtttgaacattgaagaaacgcaaggactggaggcagtgacaaatgagatggtaaggttaattgaaacagcaacagtgccagttttggcagttgatgttaatgggatggtcaatggatggaacaccaaaattgctgagttgacaggtcttccaagtgatgaagctatgggaaagcattttctcacacttgtagaggatttttcagtagatagagtcaagaagatgttgcacatggcattgcagggtgaggaagaggaagagagaaatgtccaatttgagatcaacacatatgatttcaagattgattctggtcctgccagcttggtagttaatgcttgtgcaagcagggatcttcaagataatattgtgggagtttgttttgtggcacaaggtataactgctcagaaaacaatgatggaaaaattcccccgaattgaaggtgactacaaggcaattgtacagaacccaaacccatcgatccctccattatttagcacagatgaatttggttggtgttgtgaatggaattcagctatggcaaaattaaccggatggaagcgagaggaggtgatggataaaatgcttttaggagagattttcgggacccagatagctggttgtcgcctaaggaatcatgaagctgttgttaattttagcattgtacttaatacagccatggctggtttggaaacagagaaggttcctattggtttctttactcgcgatggaaagcatgtagaatctagtccagagctgcaacaggcattacacattcagctcctatctgagcaaactgcaatgaaaagactgaaagatttaaattatttgaaaaggcaaatccggaatcctttatatgggattatgttctcccggaaattgttagagggtactgagttgggagctgaacaaaaacaatttctgcaaatgagcacgcagtgtcaacaccagcttagcaaaattctggatgactcagatcttgacagcatcattgatggcattacgcatgatggttttggggttccagaaacattgctgaaccagatgtttggacgtgatggacatgaatctgaggagggtattagcatgctgattagcagaaagctcatgaagggagacgtacgttacataagggaagcagggaaaatcatctttcatcttatctgttga

SEQ ID NO: 22581 - DNA, 888 bp, Glycine max
  Peptide Sequence Number=SeqID_114266
atggtgatgcaaggattgaagttgggtggtgatgtgccttttacaaagatttatttgcatcccatggttcgtgatgcacatggacgcaagatgtccaagtccttagggaatgttgttgatcccattgaagtgataaatgggatatcacttgaaggtctacataagaggttagaggctggtaacctggaccccaaagaactagccattgctatagagggtcagaagaaggactttccaaatggtattgatgaatgtggtgttgatgctctccgttttgcactggtttcatacacagctcaggtgtcaatctcttttcaatgttttatatggctgattttttcaccaatttgcttccgaaagacgctttgcacaagatactttgtggaagaattatggcagcgccttccttcaaccagggaatgcgagagagcagaatctatcatgatatgtgattatccatcaactgtagagggctggaataatgaaaaggtggagaatgatatggacattattgagtctactgttaagtctctcaggtcactagcaaaagaaagttgtgacagccaccaactagatattgcaacattagctaatctatcctctttgacagtaatcactgaaaaagatgctgtttcatctggatatgctgatgctgttgtaaatgaaaacctttctgtttatttagagtttcaaggagctaattctgcagaagcagaggggaagatcaagaagatagatgagctgcaaaagcaaatagaaaggctagagaagatgatgaacgctaaaggttatgaagagaaggttttgccaaatattcgagaaaagaaccaggagaagctagattcccttaagctattgctcaaggaaatggctggtctgactctctag

SEQ ID NO: 22582 - DNA, 726 bp, Glycine max
  Peptide Sequence Number=SeqID_114267
atggctgtgcagctgtgggaaaccctgaaggaagccatcgtagcctacactggcttctctccttccaccttcttcacggtgctggcgcttctttttgccgtttactacgtcgtcacgggtctctttggctcctccgacgatcaccatcaccgccaccgccacgtcgaggaggaggaggagatgccgcctctgcgccccccggttcagctcggcgagatcacagcggaggagctcaaggcctacgacggcaccgatcccgagaagcccttgctcatggccatcaaggcccagatctatgatgtctcccagagcagggtgctaacaccccttatttttatcatgtggaattgtgtccttcccaggatgttttatggacctggtggaccttatgccctatttgctggcaaggatgctagcagagccttagcaaagatgtcttttgaagagaaagatctgactggggatatttctggtcttggcccgtttgagcttgatgccttacaagactgggaatataagtttatgagcaagtatgtgaaggttggaactgttaaaagtgaagaagttccagtaactgaaccagagtccattggtgaaccattagaatctacttcccgtgatattgatgctgctgccaagcctactgatactgaagatggcaaattagaaactccagctgttaaaagtgatgaaaccccttcaaatgttgatgccgataaagagtaa

SEQ ID NO: 22583 - DNA, 954 bp, Glycine max
  Peptide Sequence Number=SeqID_114268
atggctccgccgctcgaacacaacggcgtttccacgagcggtgactctcagagatccattcccacgccgtttctcaccaaaacctaccagctcgtcgacgatcacaccatcgacgatgtcatttcgtggaacgattctggatcgtccttcatcgtctggaacaccaccgctttcgccaaggatttgcttcctaaatatttcaagcacaacaacttctccagcttcgttcgccaactcaacacttatggatttagaaaagttgtacctgaccgctgggagttctcgaacgagtattttcgaagaggcgaaaagcgtcttctctgcgaaatccagcgacggaagatcctctccgcatctcctccgccggcgggagcaactgccaccgtggcggttccgtcgccgctgccgctatctgcgatcccgacggcgaagccgatcgtgtcgccgtcgaactccgcggaggagcaggtgctttcgtcgaactcgtcgccggcgagagcaccggtggagctgttggacgagaacgagcggctgagaaaggagaacattctgttgacgaaggaattggtgaagatgagatcgctctgcaacaatatattcaatctcatgtcgaattacgctaacgctcaagcggacggtagttccgcggcggcggcgaagcggtgctccggcgaggatgcggtggaggagatgaatccgaagctgtttggggtggcgattggtaagaagcgagcgagagaggaggaaggacatggagcgaagtatgatacggctttgagtctgcatcagccgtttcatgcggacgtgaaatctgaagcgttggatttaccaggacgtggcgaaaataaaaaaacgccgtggctaaatcaatgtcatagagcaaatcagaggaagaaacggttagtttctgtccaaacctttgatgtttctctttattcttctgggcaacaataa

SEQ ID NO: 22584 - DNA, 720 bp, Glycine max
  Peptide Sequence Number=SeqID_114269
atggttaaggtaactatagttggaagggtaagcgatggattgcctctagcacaaggactgagatacatgaatgaagagtatggatatctttcatgttacaggcaacaagcagagttcatactccgagaattttcaaggggagcattaacagctcccaagatgactattcatattgataatttctgcttcaactacttggtcgagaacggagttgttttcattgtgttgtgtgagtccacgtacccaagaaaactggccttccattacctacaagatatacaaaaggagtttgagaagtttgataaaaccctcataggcaaaatcacaaggccatacagctttgtcaaatttgatggtataatcgcaaacattagcagacaatacattgatacaagaactcaggccaacctatcaaaacttaacgctaaccggaaacaagatttagatattgccactgaagacatttacaaaattttagaaaggaagagaaattcagaaacaatgagaagattaccggttactcctcaacctgaatccacaatatggtgctccccacaacttgagatggtatccatctccggtgtgaggggaaaaaataaaggtatggagtggcccattgccatcccttccccagcacataatccagggaaaacagagaaagagagatacagattgaagaaaaactctgatttgtcacggaatttctactctctaccttga

SEQ ID NO: 22585 - DNA, 594 bp, Glycine max
  Peptide Sequence Number=SeqID_114270
atgacagaggagcaattaaaaaaggtggctcagactgagagtatttcccctaatcctgcacctgaacctgaacctgaacctgctgttccaaaagaggaagtggctgaggagaaatctgtaattccacaaccctcttcctctccttctgatgagtccaaagctcttgtcatagttgagaagactagtgaagttgctcaagagaaaccaattgaggggtctgtgaaccgagatgctgtccttgcgagagttgcaactgagaagaggctgtcactaatcaaagcatgggaagaaagtgaaaagtcaaaatcagagaacaagtctcacaaaaagctttcagtcatttcagcatgggagaacagtatgaaagctgcagcggaggcagaattgagaaagattgaagaacaactggagaagaaaaaagcagaatatggagagaaattgaaaaacaaaatagctacaatccaccgagaagctgaagaaaagagggcatttattgaggcccaaaaaggggaagatttcttgaaggcagaggagacagctgcaaagtacagggcaactggaacagccccaacgaaactctttggttgtttctaa

SEQ ID NO: 22586 - DNA, 114 bp, Glycine max
  Peptide Sequence Number=SeqID_114271
atgggtggaggaaaagggagtggttcatggatgaggggaaggggtcgcggtggaggggagagaggccacgacaaaggaagtagaaggaaaaagaagaagaaggtcgtgacatag

SEQ ID NO: 22587 - DNA, 642 bp, Glycine max
  Peptide Sequence Number=SeqID_114272
atggctggcagatttttatcttctaagctgaaagagattattagtagactgtacaaagcatatctctaccaattattaaagcttaaaagtaaagaaaagacagtgcaatgcattcaacagtctaacatgacaatatcttgtgcacaggggatagagaagaacctgaatggaaattgtaccagagcactgtactttcctgacttgtgcttctttccacaatatgcgttgagatacatatcaacgccatattttattttgaactctgcctacgatgtattccagttcagtcatattttggtgccaccctctgctgatatgcacggacactggaaacaatgcaaggcgaacctggcggagtgtacagcagaccaaattgatacactgcaaggttttaggcttgacatgcttggagctttgagaccgttctatatgaattcaagaagaggggggatgttcataaattcatgttttgctcattgccagagtgaactacaagaaacatggtttggggatgattctccaagaataaacaataagactattgcagaagcgattggtgattggtattttagtagaaacataagcaaggaaatagattgtgcatatccttgtgatgcaacttgtcataatcttataccgtaa

SEQ ID NO: 22588 - DNA, 252 bp, Glycine max
  Peptide Sequence Number=SeqID_114273
atgatcaagatgaatctcgcgttcgcattcttgtgtctattcacggtggagccatggcgcgtttgctcgcaacaacaacaacagaggcttctcgtgaacatgacgctcgttccaagcgctcgtgctagtggcgctctttgtttggacggaagtttaccggcgtatcacttgcacagaggatttggagctggtaaagacaactggcttctacaatttgaggtacgccgaacttcctctacctcttcaaaataa

SEQ ID NO: 22589 - DNA, 1485 bp, Glycine max
  Peptide Sequence Number=SeqID_114274
atggacgctcccctgctgctggtgaacggcgagggggcggcgctggtggcggagaatggtgactacgtggcggtgagggagctgaaggaggtgaagaaggtgttttggattgagaccaagagagtgtgggagattgcgatgcccatcgttttcaacatatggtgtcagttcggtgtcaactccgtcaccagcatgttcgttggacacctcggcgacattcagctctctgctatctctctcattaactccgtcattggcacttttgcctttggtttcatgcttgggatggggagtgcaactgagacactctgtggacaagctttcggagctgggcaggttaatatgcttggtgtttatatgcaacgctcatgggtgatattatcggtgaccagtatcttgctcttgcctatatacatttttgccgctccaattttgaagcttcttggtcaacaggaagatatagctgatcttgcagggagtttctccattttagtaattccacaatttctttcacttcccttcaattttccaacgcaaaagttccttcaagctcagagcaaggttaaggttattgcatggattgggttggtggctttaattctgcacattggaatgctctggttcttaatttatgtgttagattttggcttagctggtgcagctttggcatttgatatcacgagttgggggatcacagtggctcaacttgtttatgttgtgatctggtgtaaggatggatggaatggattgtcatggctggcttttaaggatatttgggcctttgttaggctctctcttgcatcagctgtaatgctttgccttgaagtttggtatatgatgagcgttatagttcttgctggccaccttgataatgcagtgattgctgttgattccctctctatatgcatgaatatcaatgggtgggaagccatgctcttcattggagtaaatgcagctgtcagtgtcagagtttccaatgaacttgggcttggacatccaagagctgccaagtactctgtctatgtgatagtctttcagtcacttttcttgggaatctttttcatggctattattttggcgactagagattattatgccattatttttacaaacagtgaggttttgcataaggccgttgcgaaactaggatacctcctttctgtgacaatggttctaaacagtgttcaaccagtggtttcaggtgttgctattggaggtgggtggcaagccctggtggcctacatcaacataggttgttattacttatttgggcttccactggggttcgttcttggttatacagcaaatttgggggttgagggactttggggtggtatgatatgtggaattgttctccagaccttgctgctcttgttgatactttacaaaaccaattggaagaaagaggtggaacaaacagctgaacgcatgcggatatggagtggacaagacattggagttgataagatagtggcttctgcataa

SEQ ID NO: 22590 - DNA, 1200 bp, Glycine max
  Peptide Sequence Number=SeqID_114275
atggcaacacgaactggtcgcttgtttcaaaatcaaaacctgaatgtccacgttaatggaggaggaactgtttctgagaaggctgatttaacaggacagaggaaagttagggctgggggaagaaaaccacttggagatctatccaatgcagggaacctcatcaaccattttgatggaaagaaaggccttgatggttcattgtacacgggcaaaccctctgttagtcaggcacaggcaccgaaattgcacaagtcaaagaatcttgaaagtgacaaaagaattccagcttctgagaaatcactcactcgtagcaggaaagcactttctgacatttcaaactcagggaagccacaggttcctgagataaaaaataagaagaccctgaaaccattagaggaatctcttcctcccagtgcaatttctgaagaacaaatcttgcacgatcataagaaatgtatcaaatcacagtttgaaactgcagatgtgcatcagttttttaagactgttggacttgaggatgatgatcacatggcaatttcctttgagctgtctgcaattagtaaacagaagtctgagagtgcatatttggagttggaggaggtacctgagtggttgcctgaagtgcactctctatctgttctgcatggtggttccccagcagtacactgcaagactccaggcttgtcaaataatgatcgttttttcggtagacatgttttgttcatcttagacatattttgtgccactgatggtgttggctcctatgtttctattgctgatttcgtcatgacaattaaaagctttgtctattacatggaacagcacattatagaccttaattctcactctgaaccccctgctatgttgcacatttgtagaatctctgatgtcctcattcttcaattacaaaggctattcaagcatttagtgcataatgaggtggtggagtattgtatttgtatggggagggtccaaagagctagcttgctagtgggaatctcaggcatcgcccatatcttgcactattgcatgggcctggtgcaccctacaaggctaaagaagagaaggtgtgaaatactgctgatgaactcgcttagcgagacagattggctaagcgagtctcatccgcttagcgaggcagccagctcgcttagcggatgcaaaaccctagaagaggataagtcagagatcagcgcgtag

SEQ ID NO: 22591 - DNA, 513 bp, Glycine max
  Peptide Sequence Number=SeqID_114276
atggaaagcagggaaggcaaatcaatttctgatttggaggaagaattttttcacaaattcagagatttcatgacaggtaagacaaatgatcacgagggtttgattttaagacatcctatataccatctaccctatgacaggattacaaagattgatgagttgggaattgctggaagcaagctgctgtctggctttcaacaagcacttgagtttattaggaggcctcctatagacatgaattctaaattagttcacaagataattgtagctaatgaaactgagagagttaaggcctatattaattctggatgtaggaagctaaatgaaagatctaattgtaaggtatgggacttaagtcccccattggaagtatgggattctagcctagggtttacaaggttttcaactctccaactacagcagctagcttgtggtgtggttctcccaagattcttatcaattgatattagagcctttcaccgtgtctcttggttgcattgtatttttgcctag

SEQ ID NO: 22592 - DNA, 571 bp, Glycine max
  Peptide Sequence Number=SeqID_114277
ggaccgttcgagcttaacgacgtttttgcgataattaacgctgtccctgcgatcgttcttctctcatacggttttttccacaagggtctggtccctggcctctgttttggtgcaggccttggaatcacggtgtttgggatggcctacatgtttgtccacgatggattggttcataagagattccctgtgggtcccattgccaacgtgccctactttagaagagttgctgctgctcaccaagatctgaattatgatctcatgaccttgaatttttgtggtctgtattcagctccaccattcggacaaattcaacggggtgccatatggcttgtttttgggaccaaagcatttcaactcaagatatttgtcaccggtaaggatctgtggggtcatattgatggaagcaaccccactcctaacgaagccacccacaaggaagagcatgtcaagtggggtcatattgttcttgctcttgctacctctcaatcttggccactataccaattagatgtcaaaaatgcattcctccatggtgacctcaaggaggaattttacattaaacttcccattg

SEQ ID NO: 22593 - DNA, 180 bp, Glycine max
  Peptide Sequence Number=SeqID_114278
atggcgttgttagaacttgtgaatgtaattgattcactgggttacgatctccgcaatcccgcgagggtccctctccctctcattctgcaatcctacttcattgtaacatcatgtcaagaataccaagccaaggaatcctcaagaagtcctaataagtcattttggcatcaactaggttga

SEQ ID NO: 22594 - DNA, 1425 bp, Glycine max
  Peptide Sequence Number=SeqID_114279
atgttggatgaagtgtgtcaccgtgtgaagtgtagcgtgagagccgccgagaagtcgataatcatgaatgttacaaataatatcataatagacctttcgttcagtacgatgtggttcaaggatgaaccaggtggacgtaacaatggtctaattgatgggcaaggagcttattggtggaacaagttccatcagggtcaattgactctcactaggccatacttgattgagaccatgtactctgatcaaatccagatatcatttctcactttggtcaactccccaacctggtttgcccatgttatggaatccctaaagaaaagcatgccaccaagcttcttaagcaaagagaattgtggaaatcacaagaagaatcattgtgaagtggcacatgaacaaggtttcatggagttgcaattaagcaatacacctgttagtgtctatgattctccaggaagaatttcaacaagtgatccctcagaggcatatatctctcctactagtgtggaaaaggcaaaacagtttgtttcaatgattgatgactgtgaatcatctactgtatattgtaaaggcatttcagttaggatgaagcaaaatccaccctgccctgctgatttccaaattcaccgggagttggaatcaaaatctttcagctgcagctttgatggagaatcaaattcgagctttgaactttgtttgcctgacgaggacagtttaattacacttgacgaactattcttgatgcctgatgcggaaaatttggtcatgtttgatagttccgtgtctagcagcgctgaaagcaatctaattgaagctgatgtgtttagcccaagctcacctcgtgaaatggttgagaagctagtggaatttatactcaatgatgaaatttctacaccacatgtggataatctaatagtgcaccacggagctggattggggcgcttttcccactctatgcatgcacagcaaactcccctaaagttctgctccaatcagttgaatccagagagggatccacaagaccataataaatttcaaagaaactccatcgattcagccatatattcttttttttcccaccctttcccatccaacacattttctcaacctttccctctttatcatgacgagctgaaaaggtttgatcatgaagttagtcaatcaatgctccagcagattataaatccaggcaaacttaatctctgctcattacaaagtggagtaacaccgcatctgcctgcactccagatggcttcttgcacacaagctaaatccaatgcagactcgtctctttgcatatcaggaaccaaggaactatggggattttgtaaaaccaagtcccgcatcaatccagctctagttgataatttcattgaagagaaattgcgagtaagtcactggcacccttatgtgcaaggtttctggtag

SEQ ID NO: 22595 - DNA, 1602 bp, Glycine max
  Peptide Sequence Number=SeqID_114280
atggttgcctttgggaaaaagttgaaagaaagacaaattcaagaatggcaaagatattacataaactacaaactaatgaagaaacgagtaaagcagtatgctcaacaaattcaacttggaacactggatcgccgccatgtacttaaggatttctcaagaatgctggataatcagattgagaagactgtgcttttcctgttggaacaacaagggcttttggcaagtaggatagcgaagctcggagaggagcatgaagttattcagcaggagcctcatataagcagaatagctgaactacgagaagcttatagagcagtgggacaagagctattgaagcttctcttctttgtagaagtcaatgctgttggtttgcgtaagatattgaagaagtttgacaaacgctttggctataaatttactgattactatgtcaaaactcgggcaaatcatccttactcccagctccaacaagtgttcaagcatgtgggatttggagctgttgtgggagctttatctcgcaaccttcacgaacttcaggagaatcaggagagccaaggaagcttcttatcaatttatgatcagcccacacttccccttcaggatcctgttattgattcaataagagcagctattgataggttaagtaactcaaccaacttcctaaactttttggggcaacatgcacttattatgcatgaggagttgcctgcacctgttgatgagcatgttgatgatcaaagataccattttatgtctctttttttgaacttggcaaacacatttttgtacatggtcaacacatatattatagtccctacagcagatgattactctatgagccttggggctgcaccaacggtttgcggtattgtgatcggggcaatggcagttgcacaggtagatgaagatgatgatcaagattatgatgatagtgaagaagctccagaggattctcgtcagccagccaattcaattggagcagcatatagactccttacaccttctgtaaaggttcagttattgatatacttcatgcttaaatatgcaatggagattttactgtcagaatccagtgtcatcacaacatactacttcaattggacaacaagcactgtttccatttttcttgcttgccttggcttgacagttcttccagttaacattattgttggaagttatataagcaatatgtttgaggacaggcaaattttgttggcatcagaagttatggttttcgtaggcatacttttcagcttccatgtaatttttccatacactgaaccacagtacatctgttcggggctccttatgtttgtttctgctgaagtacttgaaggtgtcaacttgtcacttctatcacgagtaatgtcatcaaggctttctcgtggaacctacaatggagggctcttgtctacagaggcagggacacttgcacgagtgattgcagatgcaaccattactcttgctggctacggggtccacgagatgtcacaagcctttgcagccaaggaaagaggagaggaactagaatcaatgttgtgggacttggacatgacgatctccttcatggagatacccaagggtctaccgcctttgatgtaa

SEQ ID NO: 22596 - DNA, 2037 bp, Glycine max
  Peptide Sequence Number=SeqID_114281
atgcagaggaaatatggatgtcccagaaaagaaccaagttttcaaaggtccatatctgaggtgacattggagcgagtgtctggtctgtttggttccttgtcagtccttccttcaacaggcagaactagaggtacactacatcgtcagagtagtggaattgaaaattccagcaatcctccaaagctccgtaggaatgcctctactgcatgtgatacaattagcactccccaatatggtccttcagatccagctcctttgaagtgcacaagcggcttctgttttgatgaaaagctcttcgtgcagtcactttataaggtcttggtttctctctcagaaaccagttctgttattttatatatcaaggatgttgagaagctctttgttcgatcaacaaggctacacaatttgttccaaaagttaattaagaaactttcaggatcagtgttaatactcggttcccagatctttgattctgaagatgattgtgcagaaattgatgaaaagcttactatgttattcccttacaacattgacatcaaaccacctcaagatgagacccatcttgcaagctggagaaccaaactgaaaaaagacatggaaactagtctgtttcaagatagcaggaaccatattgctgaagtacttgcagcaaatgacgttgattgtgatgacttggaaaaagtaagcaatgctgacactatgctactcagtaattgcattgaagagattgtggcgtctgcaatttctcaccacctgatggagactaaacatccagaataccgaaatagaaaactagttatatcacacaagagtttgtcccatgtattgaatcttttccaggaaagtgaaagtaatccggagaataaagattcaaacaaggaggatgctcttgcaacaaagaaagatggtgacaatgagtttgagaagcatatgagagaagaggttgtgcctgcaaatgagataggggttacatttgaagatattggtgcattggatgatattaaagaattacttcaagatgtggtcatgcttcccctcagaagaccagacttattcaaaggtggacttctgaagccttataaaggaatattgcttttcgggcctcctggtacaggaaaaacaatgcttgcaaaggcaattgcaaatgaagctggagcaagcttcatcaatgtctcaatctctaaaatcacttcaaaatggtttggagaagatgaaaagaatgtccgagctctgttttcattagcagcaaaagttgctccaactattatttttattgatgaagttgatagcatgcttgggaagcggactaaatatggggaacatgaggcaatgagaaagattaaaaatgaattcatggcccactgggatgggctattgacagaacccaatgaacgaattctggttcttgccgcaaccaacaggccatttgaccttgatgaagcaatcataagacggtttgagcgcaggatcatggttggtcttccatctgctgagaacagggaaatgatcttgaaaactatcctagctaaggaaaaatatgaaaatatagactttaaagagctttcaaccatgacagaaggatatactggaagtgatcttaagaatttgtgcacagctgctgcttatagacctgttagagaggtacttcaacaggacaggttgaaggaaaaggaaaagaagaaagcggaggtagaagttcaaagatcagaagatgcttctgatgctaaaggagataaagatgaagtgactactttaaggtgtttaaacgtagaagacattagacactgtagtcaggaaaagaagaaaacggaggcagaagttcaaagctcacaaaatgcttctgatgcaaaaggtgataaagatgaccaagtgatgactttgaggcctttaaacatggaagacatgagactggcaaagagtcaggtggctgcaagttttgctgcagaaggatcaataatgagtgagctgaaggagtggaatgaattgtttggagaaggaggttcaaggaagaagcagcagcttacttatttcctttaa

SEQ ID NO: 22597 - DNA, 1356 bp, Glycine max
  Peptide Sequence Number=SeqID_114282
atggctccaaaattcgaaccgggatcccaaattaaaatgggtgaaggaatgagtgaaaggtggaaggagtggtcgagctccgtgcccccgaccttggcggcgattgtgacgagggaaaatgagcagagggggatgacagcaatggtaggaggggccggcaccggtgtgggatgctgctaccttagtgcggggagtggaggtggagctggcgtgggcggtggagtcggcatgaacggcgacggtggcgtgggcggcggagtcagcatgagcggtggagtcggcataagcagtggaggtggcgtggtcggcagagtcggaatgagcaacgaagtcaacatgagcggtggagtcggcatgggtgtgtgtgcgaggagtgccttcgcagaggaagaagatggggtggtagtggaagaggaaggtggcggaaagagggaagtggctgggtggtgcgggttgcagcagatgatgaatgagcgcatcgattttgtgcgtgagttgttgaatagtgtgagtgagataaagttggaagaagaagtaaggagagcaccaatgctagcactccctaaactactggcttcgaggcaccagcaacctcctaaggagaagaagaagacacagggaagaagaggtgtggatagtggtgggaaggaggcgagtagtatttttaagttggagtggggaggtcataactgtcattcgtggtgtggaaccctggacagttccttggacagcaaagaccattgttcagcatacacagcagggtttagaaaggaatctcttacatacagagggcaagcattgtgcagcctcttgactgatgttgctgaaggcgtggttggaatagcaattcttcgccattgtcttgcaaagtttcaacctctttcatctgattggttcaaatttgaagtcaaggggaagtggcagtttgatgttggtttaggctgcctcatgttcccccttatcaatcagctatcacaaatgaacctaaatttgctgcctgttcttcaatatactccagttaccatctcaagtgtagagcaatccattgttgcgcgagaccctgtggcaatggccctctatgcagtggtagtctcggtttgtgccccaatatgggaggagattgttttccgtggtttccttcttccatctttaaccaagtacatgcctgtatggagtgcaatattagttagctcaatagcttttgccttggcacattttaacattcagagaatgctaccacttgtatttcttggcatggtgatgggtactgtctttgtacggtctaggaacctctttccatcaatgttgttgcatagtttgtggaatgcttttgtatttctggatctcatgaaataa

SEQ ID NO: 22598 - DNA, 1449 bp, Glycine max
  Peptide Sequence Number=SeqID_114283
atggagaagatgcagcacgcggaggagcttgtgagggagtttctggtgttccgcggcttcaccaacaccctcgaatcctacgaggccgaattgcgcaccgacatcggaaaaggattcgaggtcgacaagatcctcgacctaatcttctccctctacgtccccaagttccacgccgatagcctcctcgcgctcctcgctttcttcaagcactacctctcttcctcctccgacgcgccgcttgcctccacgctctctaagttggagacttctcttctacgcttctacgtcgtccacgccgtccagtgcaaccgcaacgacaaagtcgtcgacttcttcacgctctacggcgccgaattgctgcagaggtcccaagattggactaactggttcgctattccttataagaagaatccacacttggatcccgagtttcgggtttttttctccaaggagtggtatcaggctttgcatctttcttctagaaacttcttcagcgaggttagttcagagatgaatgctactaacctactcaaacgagatattgtacatttaaatcttaagttgtcgcagcttcaggcttcgcttgatgagaaagaggtgcagttacgccaatttagaagtatggaaggggggagtactggttcatcgagcactttgcgtgaaaaaactgctcgtatgtcaaaagattctccggaggtttttccagctggtgttgcacgagtaggtctaacagagagtagtcaagattcagttgcgggtggattggggaatattcattccgagttgattggctccacgtctggcgatgattcagcttttctatcaaatgaccatctgaggaatggtggagctgacaatgcagaaaatggtggggaagtttatggggaagaatatttttctgaggtccaagtagagcaccaggagacatttttggggcacaccagtccaatcagtcgatgtcgcttctctgcatctggaaacaatattgccagtgcttctctggatggaactgtcaggatatggacatatgatacatcaactccagtgtctagaaatgcaaccatatattgtggcactgaaattttgtcacttgactgggaatttgttcctcttgataaaaagcttctcataggtacgtctgatgggtgcattaaggcatggaatgtggatgcaaagagagttgtctgtgacctcaacacaaccgaagcatttccaagtgtattggacataaagtgcagtccagtggaacctatttttgtgtctgctgcagcatctggaggggctggttctaactatattgaccacctgggttttgcttcactaactgtgtggaacatgaagacgtggaaagccatgtccttcctcttggagaagatccgccagcaattacttctctatgctttaatcacaatggaaagattttggcagcttctgctgttgatggaatga

SEQ ID NO: 22599 - DNA, 966 bp, Glycine max
  Peptide Sequence Number=SeqID_114284
atggcttccgaaaggcaagcgttaatgcttattctcttaacaacattcttcttcaccataaagccttcacaggccagtactactggtggcataacaatctactggggccaaaacattgacgacggcaccttgacttccacatgcgacactggaaacttcgagattgtcaacctagctttcctcaatgcgtttggttgcggcataactccatcatggaacttcgctggccactgtggggactggaacccttgttccatactagaaccccaaatacaatactgccagcagaaaggtgtcaaagtcttcctttccctcggtggtgctaaaggaacctactccctctgctcacccgaggacgcaaaagaagttgccaattacctttatcaaaacttcctcagtggcaaacccggtccacttggaagtgtaacattggaaggcatcgatttcgacattgaacttggttccaacctctattggggcgaccttgccaaggaactagatgctctcaggcaccaaaacgaccactacttctacttgtccgcagccccacaatgttttatgcctgattaccacctcgacaatgccatcaaaactggtcttttcgatcatgtaaacgttcagttctacaataaccctccatgccaatactcacctggcaatactcaattgctttttaattcatgggatgattggacttcaaatgttcttcccaataactctgttttctttggactaccagcatctcccgacgctgctccaagtggtggttatataccaccacaggtgctcatttctgaggtgcttccctatgtaaagcaagcttccaactatggaggagttatgctcgatcagataaaggattatgttccaaaatatgcaatgcggtttgtgaccgcagtttccgacgctatttatgagagtgtctctgcagctacgcaccgcatcttacagaagaaaccatattag

SEQ ID NO: 22600 - DNA, 469 bp, Glycine max
  Peptide Sequence Number=SeqID_114285
atggcgggtttttggagcgtgttttgtggggaatctggttgctcagaggctggaaaaatgcctggcagctatgattttaggcttctcattgatccttccacttgtgtcaaccatttgctaatctcttgctttgatgtgttgctgcttatcatgcttgtattcattatgatccagaagtcaacattaaaaccatctcggggtctaatacaggtgcaaagatatccatatttccagctagtttctgccatagtcaatggtgctcttgggttggcacatttgtgctttggaatttgggttttagaagagacgttgaggaaaaaccaaactgtgttgcctcttaattggtggttgctagaaatctttcatggattaacatggttgttagtgagtttaacaataagtctcaagttgaaacaacttccaagagcatggtcagggtttttttctgttctaatcttcttggtttctg

SEQ ID NO: 22601 - DNA, 1713 bp, Glycine max
  Peptide Sequence Number=SeqID_114286
atgtgtcatataacttcccacctcccctgcaaatgcaactcaaacccggagtatgtagtttcaatgaaacccccagaggcagacatgatgatcaccaaccccttgatccaaaaggacataacagtaacactaacaacactccatgaagaaaaaaacgacccaagaacaatgcaaacccatcatcatgtcttgaaagaactcatttcaatatgcaagatagccttccccatgatcctcaccggtctcttgctctactgccgttccatgatctccatgctcttcctgggccgcctcggcgagctggccttagccggcggctcactcgccgtgggcttcgccaacatcagcggctactctatcctctccggcctcgccgtcggaatggaatccatttgcggacaagcctacggtgccaaaaagttctccctcctcggcctctgcttacaaagaaccattctcttgctcctcttcacttgtatcccaatctctctcctttggctctacatgaagcatatccttctattatgtggccaagacgaggctatcgccacacaagcccaatcatatcttctttattccatccctgacctcttagcacaatcttttttacaccctttaagaatttaccttcgaagccaatccattactctgcctctcactctttgtgccactttctcaattctcctccatattcctatcaactaccttctcgtttcccacctcaattggggaatcaaaggcgtggctctcagcggggtttggactaacctcaacctcgtagcttctttgattctctacatagtcttctctggcacccataagaaaacatggggaggcttttctttcgagtgttttacacaatggaaatcgctcctcaatttggctatcccaagctgcatttccgtgtgcctagaatggtggtggtatgagatcatgattttgttatgcgggttgttggtgaatcctagagcaaccgtggcctccatggggattttgattcaaacaacttccttgctctacattttcccatcgtcaataagcttcagcgtgtccacaagagttggcaacaaattaggcgcgcaaaagccctcgaaggcaaaattttcttccatagttggcctctcttgcagcttcatgttaggtgttttcgctttggttttcaccattctggttaggaacatttgggccaacatgttcacacaagacaaggagataataactttgacctcatttgtgctaccggttataggactctgcgaactcggaaactgtcctcaaacaacggggtgtggagtgctgagaggcacagcaaggcctaaagttggtgccaacattaacttaggttgtttctatcttgtgggaatgcctgtggcggtttggcttggttttttcgcagggtttgattttcaagggttgtggcttgggttacttgcggctcaggggtcttgtgcagtgaccatgttggtggttctgagtcgaacggattgggatgctgaggctctaagggcaaagaaactaaccagtgttgttgttgatgacagcaaggaggttggtgcagagaagccaccgaaagctgaaatcaaggaagattctttattatcattagctgattcagatgaagataaacaatcgaacaaaaaccaaaagggaaaaatcaaacaagacaaagggagagagagaaatctatcaggaattttgtctttagctgtatag

SEQ ID NO: 22602 - DNA, 984 bp, Glycine max
  Peptide Sequence Number=SeqID_114287
atggatcacagtgcggatgctcaacgcacggacctgatgaccatcacccgtttcgtgctgaacgaacagtcgaagcacccagagtctcgtggcgatttctcaatcctgctcagtcacattgttctcggctgcaagttcgtctgctctgctgttaacaagggtgaagagcaaaagaaattggatgtcctatccaatgatgtcttcatcaaggcattgatcagcagtggacgaacaatattttcccagtgcatcttggtgtctgaagaagatgaggaagcaacatttgtggaaccttctaagcgtggaaaatactgtgttgtttttgacccgctggatggttcctctaacattgattgtggtgtttcaattggcacaatctttgggatttatttgataaaagaagaccatgaaccaaccgtagaagatgttttgcaacctgggaagaacatgttggcagctggttattgcatgtatggaagctcttgcacgcttgtgttaagcactggaagtggtgttaatggtttcacccttgatccatctcttggggagttcattctaactcaccctgacatcaagatcccaaagaaaggcaagatctattcagtgaatgaaggaaatgctaaaaactgggatggccctactaccatgtatgtggaaaactgcaagtatccaaaagatggttcatcaccaaagtccctaagatatattggaagcatggttgctgatgttcaccgcacattgctttatggaggtatctttctgtacccggctgataaaaagagtccaaatgggaaacttcgtgtactctatgaagtcttcccaatgtcattcttgatggaacaagcaggaggacaggctttcaccggcaaccaaagggcacttgatttggttccaaagaagttgcacgagcgatctcccatattccttggtagctatgaagatgtagaggaaatcaaggctctttactctgctgatgaaaaatag

SEQ ID NO: 22603 - DNA, 813 bp, Glycine max
  Peptide Sequence Number=SeqID_114288
atggctttcatttcagcagttcatgccacggaactgttgccaaatgttgtcaggggtgctaaggttactactagaagagaaaaatatgagaataacaacagtcatatgaaccttgctatcacccagtgcagtggcgacacacaagccaatttagcttctgctactgcttactgcgtggaaactctaaatcagtacagcttgtgcaacttgggtaccatcgacgttgacacagacattggacacggacacgtggacacctcacattttgaaaaagttaatgagatgctgatttacttgtcagtgtccgtgtcggatacggacacatgtcggacacccggacacggcaaggggatggagtgtccatatttcatagggacgactatgaaaggagctattgatgaccttgatcttgtaatacaaacgcttgagggatgtggtttcactcgtgatcgattctacattcattgtgatggagctctatttggaatgatgttgccttttgtcaaacaaacactgaggattaccttcaagaaacctattggaagtgtgactatttctggtcataagttcttgggatgcccaattccttgtggtttaataggactccaagacgaagtgcaaaaatgcataatgaaagcacggtatttacaaaatcggctaggtgatgctggaattggtacaatactaaacaagtttagcaacattgtcatctttgagaggcctctagatcatgactttactcgtacaatgctggaatttggcatgcaatgggaatattgcacatgtgatggtgatgcaacacattaccgttaa

SEQ ID NO: 22604 - DNA, 279 bp, Glycine max
  Peptide Sequence Number=SeqID_114289
atgacgtgtggtgatgaggttggtggtgcctatcgtgcacacactgacctagcgacggggccagggatgggttgtgggctagattgtgaaggaggaggaggaaaggagggaggtggtggtggaaacactgttggcggtgatggccacggtggagagtggaggcacctgaaggagaattcggtcacaactatggcgatgcagatgaacatgtctgatgatggtggaggcacacaaaccaagacaaaggagttatggcagcatggtggtatttggacatga

SEQ ID NO: 22605 - DNA, 1893 bp, Glycine max
  Peptide Sequence Number=SeqID_114290
atggagctaattggagacactaccacagtcatggaaacgtcgtccggtgaggctgtggcggcgcatgacggtggcgaggtgattatgatggatgcaaattccggtgaagaagagaataataataagggagaagaaggagaagaagaagaagaaggtgacaataagatcaacagtaacaacaactcattatgcggtggaaacagatggccccgccaagaaactttggctctcttgaagataaggtccgatatggatgctgtgtttcgagattcaagtcttaagggtccactctgggaagaagttgcaaggaaactatcagaactgggttaccaccgaagcgcaaagaagtgcaaggagaaattcgagaatgtatacaagtaccacaaaagaaccaaagagagcagaagtgggaaacacgagggaaaaacctacaagttttttgatcaattacaagccctcgagaaccaattcacagtctcttactctccaaaaccacaacccactttggcaacaacaacaaacataataacattaccacccccaacaaggcctagtgacacaacagcaatctcttatgtcaccaccactgttccatccacaaaccctacaatcatatcaccttcaccacaaccaccaacccatgccaccaccacaactaccatcacttctccaacagtagcaaccaaccctaaaaaccctccacaatccaacaacaacagcaacatccccaattactctttgctcaacatgaacaacctcttctccaccacttcaacctcttcgtccacggcctcggatgaggacttggaagagaagtaccgtaagaagagaaagtggaaggactacttcaggaggctcacgaggcaagtcttggccaagcaagaggaaatgcagaagaggttcctcgaagccattgacaatagggagagagaacaagtggcgcaacaagaggcttggaggatccaagaaatggcaaggatcaatagagaacacgaacttcttgtccaagaaagatcaaccgcagcagcaaaaaatgcagcagttattgcttttttgcaacagttatctggtcaacaccaaaattccaccacaacaaaagctggtgccaatttccttcaacaaccacttccacaacaagtacaaccaccaccacaacaagctccacaaccactgatgatgtcaaataataacaacattgaaattcagaaaatgaataatggtcacagtgttgttgctgctgctactcctactactgtcgttgctgctactgctattgctactacagctgttactactactccttcttcattgagctctttatcttcttctaggtggccaaagacagaagttcatgctttgataagattgaggacgagtcttgaagcaaagtaccaagaaaatgggccaaaggctccattctgggaggatatatcagcaggaatgctgagactagggtacaacagaagtgccaagaggtgcaaagagaaatgggagaacatcaacaagtacttcaagaaggtcaaagagagcaacaagcaaaggcgcgaggatagtaagacatgtccttattttcatgaacttgaagctctatacaaagaaaagagcaagactactcagaacccctttggcgcttcgttccacaacatgaagccacatgagatgatggagccattgatggtgcaaccggagcagcaatggagacctcccactcaatatgaacaaggtgcagccaaggagaacaataatagtgaaagaaaagaaagagaggaggaggaagaagaagaagatgatgatgaaaatgaagagggagatctagagagtgtggaagatgaaggaggtaaccgttatgagattgcgacaaataaactttcttcagtggacaccgttgaatga

SEQ ID NO: 22606 - DNA, 894 bp, Glycine max
  Peptide Sequence Number=SeqID_114291
atgaataagtgctttacttgtcacagttttgttcttggagccacaaaactatactcggatactctaaaaattgctcgccgtcatgtctactcaaataaaaacaaaaaattgaaacctttggcaaggttccattgttttcaggaaaaattaaggatcatggaggttgagttggggctaaagatcacaagaaccagatatgatagcacttccgtttctgattttcagtttgccaaagacagatcaggacctgtcttcttgtctaaagaaaccgatgcaaagctcatcctcactgcacatcttaaaggatataagaaggaggatattggcatcaatatcaataaagatggtagtgagatttcggtgagtggggagaaggaggtgcaggaaatgcaaatgataccgttcaagaaagagctgaaaaccatagggtttgagaagaagtttggtattcctgatggggtggttttggattggatcaaagctaagtataacgaaggggatgaagttttgacaattgtgatgccaaaaacagaagtggggaaaggaaatagagaaattgaggaggtgaatgaagaagtagcagagccaagtgtactagaaaatgttgttgatagtgtgacaccagagccagaggaaagtgtgccagataagagtgaagaggaaacacctccagtgaagaagccagaaaaaccatggacaccttgtcctcctttggtttttggaggatcaactttgcttaaggctacaccggacagtcccttaataggagtatctgaagaaaaggggaagagaaggctaaagcctccaagattgggtttggctgagcagtctttgtggaggtggtcaatgatatatgaagcagaagcaccaccagagcatatgcttatgtcttga

SEQ ID NO: 22607 - DNA, 486 bp, Glycine max
  Peptide Sequence Number=SeqID_114292
atggtggtgatgaagccggcgtcaatgccggcggggcagtcgatgaggatgaagtcggggcagtcctgtgaacgtgctttcagcgcatccacgagccaggagttcgaagttggatcagcacttgtcgcggatgaaggcttggtcgaggcagcagttgccattcaggacctcgatcacggtgtaattgacgcgattctcgagaccgaggaggaggtcgaggttgcggaggccgacgtcggcatcgatggtgaccacgaagaagccgagacgggcgagggagaggtcgatttgacgatggtggtggtcttgcccacgccacccttgccagaggtgatgacggcgacgcagggggtggagccaaagagctcgggcttgcgattccactggaaagcttgtggagtcgtggcttccgcaagagagaagagagaatttgaaattttattctttcaactaactaaaattccttttaaaattctaaaattttga

SEQ ID NO: 22608 - DNA, 882 bp, Glycine max
  Peptide Sequence Number=SeqID_114293
atgggggctggtgtttcttcaactaataaagctgaaaaggacggaggagggtctatttcttcgtcatcaagagattcaagacccggtcttggtgacttcccagagagttgcatctcctccttgttcatgaatcttgatccacccgatatatgcaaattggcaagagtgaatagggcctttcatcgagcttcctcagctgattttgtatgggaatcaaagttgccaccgagttacaagtttcttgctaataaagttcttggtgaagaaaatattgctactatgactaagaaagagatttatgcaaaactttgcctacccaatcgttttgatggtggtaccaaagaagtttggttggacaaatgtagtgggcaagtttgtttgttcatgtcatccaaatccttgaagattacaggaatagatgatagaagatactggaattatattccaactgaagaatccaggttccagagtgttgcgtatcttcaacaaatgtggtgggttgaagtggtcggggagctagagttcgaattccctgtgggtagttacagcttagttttcagactccaattgggcaaggcctccaagagattgggccggcgcgtgtgcaacgttgatcaagtgcatggctgggacatcaagcccgtccgattccaactctccacatccgacggccagagttcactctcagagtgttacttgcgtgggcctggggagtgggtctactacaatgttggagatttcgtggtggaaaagcccaaggagccaataaatatcaagttttcattggcccaaatagattgcactcacaccaaaggtggcctctgcgtagatagtgccatcatttgcccaacggagtttaaagaaagactcaaacaaagttag

SEQ ID NO: 22609 - DNA, 171 bp, Glycine max
  Peptide Sequence Number=SeqID_114294
atgcatggggagagaaaaaggaagagagagaagaaacgccacataaaggagactatgactctagaagaagctcaccaccataggagggcatggataagagcttggaggaagaaggagatgaagggagagggagagaagagcacgaaattttgtgctctaaatgagctttga

SEQ ID NO: 22610 - DNA, 1455 bp, Glycine max
  Peptide Sequence Number=SeqID_114295
atgggttttctccggcgaattttcggcgccaaaaaaccatccgattccaaatccgccaagaaaagatggaccttcctcaaacacaccgtcaggaacaagtcactcccgccgccaccgccaccctccgccgtcacttactttgattcctcaactcccttggacgccaacaagcatgccatcgccgtcgccgccgccaccgccgccgtagcagaggctgctctcgccgccgcccacgctgctgcggaggttgtcagactcacaagcggaggcgtctccgccacaagcaccaggcccgccgctatggcggcgcgtgttggcaaccttgaaaccgccgccgttaggatacaatcggcgttccgtggttacttggaattgcaggactttgtggggattgaaaagaggaaaataggacgaggcaaagtagaatggccctgcgcgcaaaaaccatcaaaggcaaggagggcattgagagcgctaaaagcattggtgaagttgcaagcattggttaggggccacattgtgagaaagcaaagtgctgatatgctgaggcgcatgcaaacattggtgcgacttcaggcccaggcacgtgcaagccgtgcgcacttgtcggatccttctttcaacttcaactcttccctttctcactatcctgtccctgaagaatatgaacacccacctcgtggcttcagtacaaaatttgatggatcttctatccttaagagatgtagttccaatgccaattctaggaacgttgactcagaacgagccaggtttgattccaactggttaaaccgttggatggaattagataacaagagcagccaaactggagatgcttcattgaaaaatggacgccctgatgatgataaaagtgacaagattctcgaagtggatacttggaggccacacttcaagtctcaccacagtagcagctccttccaagcagcacattattatttgagttctgattacaataatgagaactttggagcggcacatgagtctccatcaaaacgttcagcaaaggctctaaaccaaagcttctcatcaagggaggtgttgcagctaagctcattgaagtttcacaaaggaaaagaagaagcaagttcaagaactgctgacaatagtccacaaacattttctgccaattctagaaatggaagtggtgcaagaagaggaggaggaccctttacacctaccaggagtgagtgttcgtggggtttcctcagtggctacccaggtcaccccaattacatggcaaacactgaatcttttagggctaaggttagatcacaaagtgcaccaagacaaaggctggagtttgacagatacggttccactaggaggcctgttcatttggtggggtctaattcagaccatgattcagatttaaggaacaaagtcttacctgcctttaaccaaatgaacagaattgggagtagcaacttaaggtga

SEQ ID NO: 22611 - DNA, 483 bp, Glycine max
  Peptide Sequence Number=SeqID_114296
atggctgacgaggactatgaagatattgacatggggtacgaagatgaaccgccagagcccgagattgaggtgcagaactctttgtcttgtgtcctttttttgtatctacacaaatgcatgttattgaactctgcgttgaatgaagtaattgaattattgactgctggattgattgatgaacaggaaggtgcagaggaagatgtggagaacaaaaacgatgaaataactggagagcctattgacaccgaggataaggaagaggaacaaccagtgaagcggcctcgaaagacatcgaaatatatgactaagtatgagcgtgctagaattttgggcacccgtgctcttcaaatcagtatgaatgcacctgtcatggtcgagttggagggggaaactgacccactcgagggacatgtggtaagacaggctgatgggacagaggattccttccctcctgactccttaattgagcatgcacactactga

SEQ ID NO: 22612 - DNA, 1689 bp, Glycine max
  Peptide Sequence Number=SeqID_114297
atggcgaatgctgattcttcttcttcttcccgctaccgcagcgttttgaacttaagaagaaaagcacacatatacgcactcgttgtccttctctgcatcacctcctacctcctcgccgtctttcaccgaggatcgcgcctcaccaccgccctctccctctccgcaccgtgcaaccacttcagcgccgagtcttctaaaaccttccctcggtgcagcgccaacttcagcgagtacacgccgtgccatgacccgcaaaggtccctgagagaccgcgcgtggttcgctaacgtcccccaccgtgagctcaccgtggagaaggccgtgcagaactggatacgctccgacggcgaccgcttcgtcttccccggcggcggaaccaccttccccaacggcgctgacgcctacattgaggatatcggaatgttgattaatcttaaagatggctctattcggactgctctcgatactggctgtggggttgctagttggggagcctatcttctatcacgcaatatcctaacattgtcaattgctccaagggatacccacgaagcacaagttcaatttgctcttgagcgaggtgttcctgcattcattggaatcctagccaccaagaggcttcctttcccttccagggcttttgacatctcccattgctctcgctgcctcatcccatgggctgaatatgatgggatttttcttaacgaagtggatcgatttctacgccctggtgggtattggattctatctgggccaccaatcaattggaagaaatactggaaagggtggcagagaaaaaaggaggaactgaacgaagagcagaccaaaattgagaaggtagccaaaagcctttgttggaacaagctagtcgagaaggacgatattgccatctggcagaaaccaaaaaaccatttagattgcaaggccaatcataaactcacccaaaacagatcattctgcaatgcacaaaatgaccctgacaaggcctggtacaccaatatgcaaacatgtctgagtcctgttcctgtagtgtctagcaaagaagaaactgctggtggggtagtggacaattggccaaagagattaaaatccatcccaccaaggatttataagggtaccatagaaggggttacagccgaaacttattcaaaaaattatgagctgtggaagaaaagggtatcacattataagacagtgaacaatctactaggaactgagagataccgcaatcttttggatatgaatgcctacttgggtggatttgccgctgcactaattgaggaccctgtttgggtcatgaacgtggttcctgttcaggctaaggttaacacacttggagccatatatgaacgaggcttgattggaatatatcatgactggtgtgaagcaatgtctacttatcctagaacttatgatctaattcatgctgattcagtgttcagcctttacagtaacagatgtgaattggaagacattctgctagaaatggataggattcttagacctgaaggatgtgttatcatccgagatgatgctgacatattggtaaaagtaaagagcatcgtcaatggattggaatgggatagtataattgtagaccatgaagatgggcctcttcaaagggagaaacttctatttgctatgaagaagtattggacggctccagcagcttctgagaagactaattaa

SEQ ID NO: 22613 - DNA, 108 bp, Glycine max
  Peptide Sequence Number=SeqID_114298
atggcacatcaatacaaccctaaagtgacacgtgcttatcatgggggagttccgaggcattccattgagcattgctggctgagattcacggaggaaaatcactcatga

SEQ ID NO: 22614 - DNA, 387 bp, Glycine max
  Peptide Sequence Number=SeqID_114299
atgggggagatgcttgccacccagctcgcccaggcgagcaagcaaaagaaagtttatacggataaccactcgggtatctccgcctttcagcgtgactcaaatgccagtatgacagatcttatgagcgcggaagatgacaaaaagaatgtttatacggataaccactcgggtatttccgcccgtcagcgtgactcaaatgtcagtatgacagatcttgtgagcacggaagatgaccaaaagaatgtttatacggataaccactcgggtatctctgcctgtcagcgtgactcaaatgtcagtatgacagatcttgtgagcgcggaagatgacggtgcagaagacgacgttagtctctgcatgctatcaggctttctgtcttacagatag

SEQ ID NO: 22615 - DNA, 806 bp, Glycine max
  Peptide Sequence Number=SeqID_114300
cgctacaccacgcagcgtcgcgagccggaccaggtcaaaattctctccggcgtttttgaaggccgcaccaccggcaccagcattggtctgctgatcgaaaataccgatcagcgctcccaggactacggcgccatcaaagacgtcttccgtccgggccacgctgattacacctacgaacaaaaatacggctttcgcgactatcgcggcggcggacgctcatcggcgcgcgaaaccgcgatgcgcgtggcggcaggggccattgccaagaaatacctgcagcagaaattcggcatcgttattcgcggctgtctgacccagatgggcgacattccgctggcgatcaaagactgggatcaggtcgagcaaaacccgttcttctgtgcggacgccgacaagcttgaagcgctggatgaactgatgcgcggcctgaagaaagagggcgactccattggcgcgaaagtgaccgtggtggccgatggcgtcccggcgggctggggcgagccggtatttgaccgcctcgacgccgacatcgctcacgcgctgatgagcatcaacgcggtgaagggcgttgagattggcgacggttttgacgtggtatccctgcgcggcagccagaaccgcgatgaaattactgcacagggcttccagagcaaccacgcgggcggcattctgggcgggatcagcagcgggcagcagattattgccaatatcgcgctgaagccaacctccagcattaccgtgccgggccacacgattaaccgcgatggcgaagaagttgagatgatcaccaaaggacgtcacgatcc

SEQ ID NO: 22616 - DNA, 372 bp, Glycine max
  Peptide Sequence Number=SeqID_114301
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcttcgctccaagctgggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccggttaa

SEQ ID NO: 22617 - DNA, 309 bp, Glycine max
  Peptide Sequence Number=SeqID_114302
atgacttcatccattccgaatcccggcgaagccctgccgcactatgtctcgaccgcgcccttcgacccgtcgctgatcgaacccaacacgtctggcatggcggccttcagcaaagcttcgcagttgaagctcatgtggtggcagttccgccagcacaagatcgcggtgtggtccggcgcctttctggtggtgctttacctttctattctgatctgcgagttcctcgccccctataatctccacacacgcaatatcgaacacatatacgccccgccccaggccatccacctcttcaatgacgggaaattt

SEQ ID NO: 22618 - DNA, 231 bp, Glycine max
  Peptide Sequence Number=SeqID_114303
atggcagcagaatggagaaggaagagagagaggagaagccacttcaaggagaagatgagtctagaagaagctcaccaccataggaggccatggataagagcttggaggaagaaggagatgaatgaagggagagagagagaagagcacgaaattttaggcactaaaagagctttgaaatatgaacccactaatccaagatcaattccaagattctccactaagtgtgcttag

SEQ ID NO: 22619 - DNA, 225 bp, Glycine max
  Peptide Sequence Number=SeqID_114304
atggtagaagaagatgcactttctcttgacaacattgaatgtggtgtatgtgctgagtacaccgatgccggtgtttatggaagacaaaactctggatcaaacaaggaagcattcgaaatgggagaacgacgattacatttgtcgtggacacattctgaacggaattatgggactctcttgaatccaagtatatggaagaagatgcctcaagtaacaaattcttag

SEQ ID NO: 22620 - DNA, 364 bp, Glycine max
  Peptide Sequence Number=SeqID_114305
atgggtgaccaagaggagacacaagaacagatgaaagccgacatgtcggctttgaaagagcaaattgcttccatgatggaagccatgttagggatgagaaaactcatggagaataacgtggccaccgctgccgccgttagtttggctgccgaagcaaacccaactctcccagctatagcacaccatcctctcccaaacgcggtaggacgagaaaggagcacactagggcacattagcaacccccatttgggatacaaccgggtggcttacccttatggactaccacctaattacacgccaacagtcatgcgtgatgacgtgggtcatgtcccttcccccgtccttgaaggggacctcctcgaca

SEQ ID NO: 22621 - DNA, 106 bp, Glycine max
  Peptide Sequence Number=SeqID_114306
atgacgggagatgcatcgaaattcacccatatttctcccaagaaaagtggacatgtgacttatgacgacaacaataaaggtagaattcttggagttggaaaaatag

SEQ ID NO: 22622 - DNA, 485 bp, Glycine max
  Peptide Sequence Number=SeqID_114307
atgaggggagcaccggcggaagagagcctctctcctttccttgtgagagatttcggagggttagattggctctccaagttgaaaataatcaacgaggagaacttcgaagttccggaagaggatgaagaagtccgagctttaaaaacagaactaggaaaagcaagacttgccaaagaaaaattcaagttagtcgctacacacatccggaaggagtgtgccgagttacgagaagaaaatgcagctaccgcaagagcccttgaacgagaaaccaagagggcttgcaaggaagagcatggccgagataaattccgtggagctttgtggggaagcaataatgagctcaagcttcgaaggggagagagagaccaatcacgagcacatagcatggtcttaaaagaggagttagctgcttgctcaaggtccaagagaagcttgtctcagcgtttatgcgagacagagaccaacatgttacccatcgtcagcaa

SEQ ID NO: 22623 - DNA, 387 bp, Glycine max
  Peptide Sequence Number=SeqID_114308
atgtcgtaccggatgtcacgacatcacgcttcagaacatgcagattatatgtgtccgtatgaacagattaaacaacccctgtttacaaccttctcacctaaccactacccgtgcgatctctacctaagagccactcttagatatgagaacctccgctcactccctctcactcacactcctgtgtttacaattaagtcaaagacacatcagagatcaactctgaacaaacgagatcaactctacacactagagatcaactctagacacataggtccaacacttgatgttagggtaccatcaagcctccatgattatatagccgtgtacgattctggactgcaactccttgatgctggaggagatctatcttcttctgaaaaatctgca

SEQ ID NO: 22624 - DNA, 1258 bp, Glycine max
  Peptide Sequence Number=SeqID_114309
ctttgcttccacaaagaggcttggggagagatacactgatattgtggtacctaggaagattctacctgaaaggaatgtcattctctatcacactgagttcgatgaatttactgaggaactcgagtgtagaaactggaacaaggagttgatgaactttatggatggcagtattgatgtggccatcgtaaaggagttttacgcaaacctctatgaccctgaggataaaccacctaagcaggtgaaggtgagaggtcatttggtgaaattcgatggagacaccttgaactcattcctgaagaccccagtgatacttaaggagggggagaactttccagcatactctaggttctgtcgtttgaagccagaaccacaggaactggtccctacctctcacacctctgatatcacattagacagggctgggttgatttatggaatcattcagaagatggatatgaacgtgggatatattatttcagctcaaatttctctgatcgcccaacatgactcttctaggcttaggtttccagccttaatcactgctctatgcaaggccaggggagtcatttctgattcattgacattggagagcctcgatccagctattaatgtggctcatgtaaagaaaaactgctggaacctagatgacctctcagttaccttcagagggtcacacaaggccaaggggaagaggtctgaggctcccccatcttttgagattcccccttccttagctccagcaccaattccatttgccccatctgcatttacatctgttcttccagctcctttatctgcaggaccatcagaatttttatttacacctcaggtgcttcgttccatgctccagagcttacacagggggcagtccagcatcatgcagagcttgcagggcttaggcttgccatccattatgagcatggatgagtttgatgcgcaggtggcctggccaagagcccatccttctccttctagagggggtggggcctccgcaacccaggagcctgctcctgaggagccagtagcagagggggaggatgagctcacccctcccgagcccttttattttgatgtagatgcacacatggctcaggaggaggagacttccataaatcagatacctgagtcatctcttgcacctgttcctgaggagacccagccatctacaccagtcatggagccagagcagcctatccaggattcatcagcagctgtagcactggatcttaatgaagatcaaccacaggatgagcaggat

SEQ ID NO: 22625 - DNA, 838 bp, Glycine max
  Peptide Sequence Number=SeqID_114310
ttggaacctcttacgtgccgatcaacgtctcattttcgcaaaagttggccagggcttcccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgattaaaggcgacgactttgagtcctatgaaacataaaggactcaaagtcctcgcttttatctttcaccagactcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 22626 - DNA, 453 bp, Glycine max
  Peptide Sequence Number=SeqID_114311
atgtcctcgccatcagaggacttcatgtcctgcaccatcagagggttgcacgccctcacctctagaggactacctgtcctcgccttgagagggctacacgccctcaccttgggactacacgtcctcgccttgagaggactacacgtcctcaccatcagagggctgcacgccctcacctccagaggactacatgtcctcgccttgagagggctacacgccctcaccttgggactacacgtcctcaccatcagagggctgcacgccctcacctccagaggactgcatgtcctcaccttcgtagggctacacgccctaaccttcggagggctacacgccctcgccatcagaggactgcatgtcctcgccttcagagggctacaagccctcacattgagaggactacacgtcctcgccaacagagggctgcacgccctcacattgagaggattacac

SEQ ID NO: 22627 - DNA, 198 bp, Glycine max
  Peptide Sequence Number=SeqID_114312
atggatacctcagagccctacactgtggcaatgaaaggcaccatgcaaaaaggtgtgcggaatgaccataatttgtctctacgtgccatcggacacgattgtcttcgaatggcgaaaagctcgccgcctctggatgacaaaaggggacaaaatgaccataatttgtctctgtgtgccatcggacacgattgtgtctga

SEQ ID NO: 22628 - DNA, 921 bp, Glycine max
  Peptide Sequence Number=SeqID_114313
atggtgttgatggaccaaacgggttcaaaaattggagttactctctggcaagaactcttcactgaattgcgggacaagttacagtgtggttcttcttatttgattcagaacctgaggattgttgacaaccaatctgaatatagagtcagcccagctccatatttggtttatttcctaaaaactacatctgtcaaggaaattcaccgtccagaaattccttctaatgtttatctcataactccttttactgatataatctctggcctcgcaccacgccatactttagtggatattgttggtgtcattgctgatctgatcgatgttaagacagttaatccccctcacaggatgatagtcagactcagggataacagtaactgcgacattctaataactgtttgggaggactatgctattcagctacatgatgctattgacagaaaccttctgcttcaggaaccattggttgttatgttgaccttaggtaaaatcaaagatgctacagatggttctcagtcccaatctagccagagtaatgtggtggaaaaatttctgcagaatgctcaagtggtcagtataggtgaaatcaacaatctcagacaggattgttactgcttaactgttggaacagttgacgaaatcattattgatgctccatggagttatgacagttgtcctaactgtacaacgacatttgatccatcaaaaggtggttcagctttccgttcttgccataccagtgtggtcgacatagttccatggatggagcataatggggacaaaggaaacttccttctctgggatgcaacatgtatcaagctgtttggtaaaactgttggagaatgtcgagatgagttgatagcggtatcttctacacaattgaaccataggttaaataatgattctgtgatttttcattga

SEQ ID NO: 22629 - DNA, 1134 bp, Glycine max
  Peptide Sequence Number=SeqID_114314
atggccccgaggaagcttgcctcaaagaggtccaggaaggacaaggcggccgaaggaactagttccgccccggagtacgacagtcaccgctttaggagcgttgtacaccagcagcgcttcgaagccatcaagggatggtcgtttctccgggagcgacgtgtccagctcagggacgacgagtatactgatttccaggaggaaatagggcgccggcggtgggaaccactggttactcccatggccaagtttgatccagaaatagtccttgagttttatgccaatgcttggccaacagaggagggcccagctcctgggatatccgatggtattggaagagggccaggaatgcgagtatggccagaggaggaatcggattttgcccggactgttgccggaagacgggtgcggatcatgcgcaccaacatgaccaccctgactcagatatggatgactctgctgctcagcaacatcctgcccaccgatcataattccgacctccccatgccgaagtgccagctggtgtacgccatcctgacacggatgagcatccatgtggctcagttgatcgctgatgccatctatatttttgcaggtatggcgcccactaggcaccctttggacccagataagtccaacagggccctgggattccccgcactgatcacaggactctgccagtcgttcggagtccccgttgcacctaccaaggtgattcggccgcccatcacccgggcttttatcgagaagtactgtacccagagacaggctcagggtgatgctccacaggccgcaggcgcgcccccaccacctcatcaggctggccaggctggggcatttgacatggagcagtatttacggcatttggttcgccagcaggcggccaaccaccgagcacatgtacggacccatgattgtctgtaccagatgagccttagcatgcagagccagggcttcgctcctttttcatgccctactccagaccagttcagggcagaggttgcatggcccggagattggcccgaggcccaagcaggagaggcacccccagaagctcccggcgatggagaagaagcccacgaggatgaggagatggccgatttgcttgacttcttgggagggagtggagatacgtga

SEQ ID NO: 22630 - DNA, 468 bp, Glycine max
  Peptide Sequence Number=SeqID_114315
atggccaagtttgatccagaaatagtccttgagttttatgccaatgcttggccaacagaggagggcgtgcgtgacatgagatcctgggtaaggggtcagtggatcccgtttgatgccgacgctatcggccaactcctaggatatccattggtgttggaagagggccaggaatgtgagtatggccagaggaggaaccggtctgacgggttcgatgaggaggccatcgcccagctactatgtataccgggacaggattttgcccggactgctgcagggaggcgagtgcgaatcatgcgcaccaacatgaccaccctgacccagatatggatgacgttgctcctcagcaacatcctgcccaccgatcataattccgacctccccatgccgaagtgccagctggtatggcgcccactaggcaccctttggacccagataagtccaacagggccctgggattccccgcactga

SEQ ID NO: 22631 - DNA, 707 bp, Glycine max
  Peptide Sequence Number=SeqID_114316
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcgctgcttccttggctagggagtttgtctcgttcatggtggttctcccctctttttcttctgggggaccaaggagaagtgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 22632 - DNA, 450 bp, Glycine max
  Peptide Sequence Number=SeqID_114317
atggcttccatgatggaggccatgttaggaatgaggcaactcatggagaaaaacatggccaccactgctgctgttagttcggctgccgaagcagacccaactctcctagccaccgcgcacaatcctcccccaaatgcggtaggacgaggaaggagcacactggggcacaacaacaacccctatttgggatacaaccaggtggcttacccttatggattgccgcctagggatgttgagttctaccccccgatccctgtcgaggggctggcacccaacactttgcctcagcccaacctcacaccacaaccaatattcttgtccacagaaggaccacccccggcggctgaagaaagaaggaaactcgatctcctcgaggagagattgagggctgttgaaggctttggtgactattcgttcacggacatgacagatctttgcttggtgccagat

SEQ ID NO: 22633 - DNA, 588 bp, Glycine max
  Peptide Sequence Number=SeqID_114318
atttatcatactgagtttgacgagtttaaagtggaattggagaggcataatccacacaaacgcctcttcaatctccaagatggaagcatagatgtagctgtgataaaggagttttatgctaatttatacaccatagaggagcaagcacccaagcaagagattgaacctaggctctgtattccccacaaggggtttattttgaatgctgagggccaatcatggaagcttctcagaaaagatctgacgacacttggccaaagtgtcttctcttactccaacctagctcccacatcccacacctcagatctgaatatggatagagctaggttggtctatggcttggtgactaacatggacatgaacatcggagcccttatctcaggtcagatttcttctattgctcagagtaactcctttaggctcaaatttccagccttgatcactgccctatggaaagcaagaggagttgcctctgacagtctgacttatgagagcctgagcctggccattaacttggcctacattaagaaaaactattggaatatggatgatctaacagttaacttcagaggggcgaggaaggcaagg

SEQ ID NO: 22634 - DNA, 708 bp, Glycine max
  Peptide Sequence Number=SeqID_114319
atggagaaatcaagtgaacaacaagaagcaaagggtagttacagacgagacaagaagaagcaactaagcgttagaggagaagaagaagaagcgactcagcatggttgggaatcctcagggatgcgtgctggagagataggaactggagaagctcctctattggcacaacctcttaggctgcggaggcctcaccctctccagaaggagaagactggactcttgctctatagcatggcaagtaatgtctctaaagtaaaagaagatggtcctataagagaagctagagctgatggagctggtaagggagtgggagataaagttggtataggaggaataacagaagatgaaggagctgcagaagagggaatctcagaagattggagagcctctgacctctgccccttggccttcctgggccctctaaaagtcattgttggatcatcaagattcgagcagttcttcttcacatatgccacattaatggcagggctgagactctccaaggttatagaatcaaaagtgactcctctagctttgcataaagcagtgattaaggctggaaacccaagcctagaggagtcgtgctgggcaatcatgggatcaagttggagaaagaaagaacgctccatgtctaagcaaggtcgtcaggttcttcctgaggatcttcagtggcaagccgtcagcattaagctcaaatcccctccctag

SEQ ID NO: 22635 - DNA, 464 bp, Glycine max
  Peptide Sequence Number=SeqID_114320
atgaagcaactcgactactactccatatactactataaaacgagatggtactaccttgcctctactccaatagcaactcggagcggggaacatgagctacctgcctatgccatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 22636 - DNA, 204 bp, Glycine max
  Peptide Sequence Number=SeqID_114321
ggctttcccggtatcaacagggacaccaggatttattttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 22637 - DNA, 180 bp, Glycine max
  Peptide Sequence Number=SeqID_114322
atggcacacctttggtttgtcatactttttggtaggaataatcaacatgaaagtacagaaaaaggtgttgagaaaaaaagcccggagtttcaagaacctcgggatttcaggtcaaatccttttcaaggggagggaatgatgcaatcctacctcgcaagggcattggatagaagactctaa

SEQ ID NO: 22638 - DNA, 1209 bp, Glycine max
  Peptide Sequence Number=SeqID_114323
atggggacaaatcaaaacggcaagaggttttatcaagtcaaggttaaaagtctagatgtcactagcctcaaggaattaggacgattgatgggacctctccaaaggcaagccttccgcaaagtgtacgggaagattctagatttggccgcagcggaggtatttacggaagctgtcgtatccctcgcccaatactatgaccagccgttgaggtgtttcacgtttggggacttccaaatggtaccaactattgaagagtttgaggagatattaggatgccctcttggggggagaaaaccgtatcttttctctggatttcttccttccttgagcaggattgcagttgtgattgcagattcagcaaaagagttggatcgtatgaaacaaactcgcaatggaatagtgggcctgccacggaaatacttggaaggcaaggcaagggatatggcgagccaagagaagtggggtccgtttgcagatattttagctttgctgatttttggggttgtcctcttcccgaacatcgacgatttggtagacttagccgccattgatgctttcctcgcgtatcaccatagcaaggaaagtccagtggtggctatcttggcagatttgtttgacacctttgaccggaggtgtgagaaaaacagtgcgcggattgtctgttgtttacccgctctctgtgtgtggttgatttcacacctattccaacaagaaacgagacacccgtgtccgcttcaaacctatcgctcatgcgccgaaaaaggaagagtcgattgggaccaacatttggctgggatagggggcagcgcgatcaattggtttcctcgttggaaggaaggagttatcttctcgtgtggggactaccctaatgttccattgatagggactaggggttgtattaattataatcccgcactcgccataagacagctagggtatcccatgaggggagcgccaaccgaagaaagtctctcgcctttccttgtgaggaatctaggcgcgcaaagtctcaaggcgatacaaagagtccacaaggcgtggagaagtccattgaggaaagacaaggagcttaggggcatccgtaatggcgtcatcggaggttatcatggatggctaagaattcacacgcgagggttagattggctctccaagttgaaagttatcgatgaggagaacttcgaagctccggaggaagatgaagaaatctga

SEQ ID NO: 22639 - DNA, 126 bp, Glycine max
  Peptide Sequence Number=SeqID_114324
atggcaattttgatcgccaatacttcaacaacatttcatagggatgaaagactcgggcatactttaagctatgcatggaaaataaatgggtttatgatcccaacatggttggctcatggtgcctaa

SEQ ID NO: 22640 - DNA, 279 bp, Glycine max
  Peptide Sequence Number=SeqID_114325
atggctaaatcaactcctagtcaagttctcgtcacacaccggaaatcaataggaaaaggaaacaccttgtcaccaaaaaacgagaaggggggaaatagtaaaaaggggtataataggatataccaggccactatgggaacctcaaaaaactcaaagtcatgtttgcacattctgggattaaacggctgtcgtccctgggacggacgtgggggcaaccattcccctattttgcgtataaataggggaggaagtgaagtggaaaagggttcagccccttag

SEQ ID NO: 22641 - DNA, 318 bp, Glycine max
  Peptide Sequence Number=SeqID_114326
atggtgaaagttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcgtaaccaccacaccccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 22642 - DNA, 132 bp, Glycine max
  Peptide Sequence Number=SeqID_114327
atggccgaccagcaggcgaccaaatccaaagccaaaggtaagcaaagtactagtaggatgcacctagttgctcatgatcctggggatttaaataaaacaagcgcaagctcggaaggtagagagataccttag

SEQ ID NO: 22643 - DNA, 111 bp, Glycine max
  Peptide Sequence Number=SeqID_114328
atggaggttgaggaaccttggttggggttatggctaccattgaattatcgagtgatatgggatcaagtggtcttcgtcattggaagtgcggtagacaggctttgtggttga

SEQ ID NO: 22644 - DNA, 192 bp, Glycine max
  Peptide Sequence Number=SeqID_114329
atggcagtggaatggagaaggaagagagagaggagatgccacttcaaggagaagatgagtctagaagaagctcaccaccataggaggccatggataacagcttggaggaagaaggagatgaatgaagggagagttatggttcatcccactaatccaagatcaattccaaaattctccactaagtgtgcttag

SEQ ID NO: 22645 - DNA, 723 bp, Glycine max
  Peptide Sequence Number=SeqID_114330
gatgtgcgcatcaaggcacaggccatccagaggcagaatactgccccccccccccacattttgtctcgtgggggttatgattatttggagcagaagctcctggctgagaagaccaagaagaagctgcaggaagctacagagtcaggaagcgttgatggcgtcatcgaccctccatccccggtcagacgctacgtgaagtggaagatggcccgcacgaagaagacaggggagatgacgactgaggccgcaaaggaaatcgctgagaagattgattcgtttgaggagcaggccacacagggatcgttcatcccccatggatgtcaggatgttctggtcgctgctattggacgtccagagcaccctggacgtgtccgtgctgctggagccggtgtcaccatcaagcaatactttggatcggctccatggatgtctcgcagtgcttcctccctgcctcctgacgaattacagcagctgactcaacagatcagggaccagctagaggagtccatcacagagaaagtgatgaggcaggtcccatcatcctttagccagcttcagtcacagatgcaatctcagggacttgcagtgcctcctaagcctctggttggtcctggtccctccggtcctcgggtgagcacaaaggagagttgtgttgatccctcaggaaatgatcctgagacgggtgactctgacaagtgcggcttgtacatagaagcagatcct

SEQ ID NO: 22646 - DNA, 191 bp, Glycine max
  Peptide Sequence Number=SeqID_114331
aaaactgacttgactccttcatgcatgctccactcggctcggggggatatagctcagttggtagagctccgctcttgcaattgggtcgttgcgattacggaggaccgaaacatgccactgaaagactctactgagacaaagacgggctgtcaagaacgtagaggaggaggatgggcagttggtcagatcta

SEQ ID NO: 22647 - DNA, 239 bp, Glycine max
  Peptide Sequence Number=SeqID_114332
caagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggattggtgcggagacaaggtggaaaggaaaagcactacaggctatcttttcaagtttctag

SEQ ID NO: 22648 - DNA, 333 bp, Glycine max
  Peptide Sequence Number=SeqID_114333
atgaatgaaaaagtgaaggttattctatggatgaatgctctcctagaacctaagcttttgaatcctagaaaaaccatgaattgttggcagcctaaccccattacaagcctagaaagtccttcggattcattttctcagctcatcagttcggctaagcgcgcatccaccgctaagcatagcttcagcttgcttagtgcgatagaagaatctggcagagcatcaatatcaaggtcgcgccctaagcgcgagatcagtgtgctaagcgcaaagggtgtcttcaaccaggctcagcacatgactggtgcaaagctcaaatccacttactcgcgctaa

SEQ ID NO: 22649 - DNA, 564 bp, Glycine max
  Peptide Sequence Number=SeqID_114334
atgactagaggcaatccatctgacttacaaccctttgatcctgagatagataggacatttcacagattagttaggcatcattttataccttttgatcattctgagcattccataactggtgaatctgtgcattctgttattggtgattttgaacatcctgatcttgagcattataattttgagcattctgattctgagcattctgattttgcacattctgagaacatggcacaacctccaccccgtgagaggactctaagggaaatggctgcacctgatttcacctacgaaagcttatgcatccaataccctgatgaggatgtcccatatgttcttaaaactggactgattcatttgcttccaaagtttcatggccttgcaggtgaagacccgcacaaacatttgaaagaatttcacattgtctgctccaccatgaaacccccagatgtccaagaggatcacatatttctgaaggcttttcctcattcattagagggagtgccaaaggactggctgtattaccttgctccaaggtccatcacgagcggggatgaccttaagaga

SEQ ID NO: 22650 - DNA, 669 bp, Glycine max
  Peptide Sequence Number=SeqID_114335
atggaggataccaatgagttgttgcacctcttggtggatgctatgaataggggattgcgtgatgccaatgggtcacttagcaaacaaaatgtagaacgaataatacttcctcaactcaatgcaaaaactaaatttcctaaaacttatagtcattatttgagtcggatgaagtggtttcgaaaccagtataacatgatgtcaacccttatgcgcaacaactctggctttggatgggacccaattggaaaaactttcactgctcatgaggatgtatggaaagattacttaaagtcccacccaagtcacagcaaacttcgaggaaaaagtatggttgattatgagtatttgaagatcgttgttgggggtggagtttctagcgggaataattctatatcagtcgatccagatgatactgatgcaacaacttttgagccagaaaatagaattgttgggatagaagaattttcatatgatcctaatagtgatacattcataacaccaaataactatgaaccagcatatcagcctccatcaccaaaccaaccaagtccaccatcccacccccctttagattcagaggttcccatagaaaaacaaaactgtcacaagcgaaggagatccgagtatggagggagttcaagcgctgttgggatcaacaatcaaggcaac

SEQ ID NO: 22651 - DNA, 270 bp, Glycine max
  Peptide Sequence Number=SeqID_114336
atggcggacacgtactccgcccccgaggagatccacggacttctcggctattctgccgaagcagaccaactctctagctactgcgcaccatcctccccaaatgtgataggacgagaaaggagcacactggggcacaacagcaacccccatttgggatacaaccgggtggcttacccttatggattaccgcctaattacacgccgccagtcatgcatgatgatgcgggtcatgtctcttcccccatccttgaaagggagcctcctcgatag

SEQ ID NO: 22652 - DNA, 601 bp, Glycine max
  Peptide Sequence Number=SeqID_114337
gcattcgagggcgtggttatcgctattcgtaacccgcggtctgcactctgcattcactgttcgtaaaatttccaacggcgaaggcgttgagcgtgtcttccagactcactctccggtagttgacagcattgctgttaaacgtcgtggtgctgtacgtaaagctaaactgtactacctgcgtgagcgtactggggaagtggataacgtactgcatcagcaaaaccggaaacgcgcagcggccttgatcgcgctgtttgcgatcctgctgatcgtggtggcgccgctgatctccgtctcgttgcaaaaagatcccatgagcgccatgccgggtatgcatcatgacatgagtatgatgtcgatggatgagcaccacggcgatgtgtcccacacggtgcctgttgaccatgctgaagcgtgcggctactgcgtgctgttagcgcatgtccctggcgtgatgctggcgctgatcgtcctgctcagcgtggtgctgcagaggcttcgcgttaagccgccgcgtcaggcggtcagccactggcactttttcccctggctttaccccgatacccgcgcgccgccgcggcagtctgctttttccctttaa

SEQ ID NO: 22653 - DNA, 303 bp, Glycine max
  Peptide Sequence Number=SeqID_114338
atgacagtgaccaatgtaagagtaacactgacttgtaggtggtggcagagtcaacagcacgacggtgaggttagggcacaagctacaataagggcacggtgcatgcgagctatagtgactccacagcgcgagcaaaaggattacaaaacaacagtgagcacgacaatgagggatgattcaacaacagtgatgagggtgagaggacacaagttaattattgtatctttaaagttaaagatgatgctcaaaaactgtctttgtctccctgcattcgaagacggttgtagcttaaaattgtcttaa

SEQ ID NO: 22654 - DNA, 381 bp, Glycine max
  Peptide Sequence Number=SeqID_114339
atgctaccccgacctgtgagaagtcaggtagcatgcggagatacccaaggattatccgcgcacacacacatacacaaatctattacctcgacctgtgagaatcgggtgacatgcagagacacccaagggttatccgtacacacatttatgctatcccgacttgtgagaagtcaagtagcatgcggagacaccctatacggtaatccgcacacatttcgaagacaaaaatgtcttcggtcattgcatgcattcaaaggtgcaatgtcctcacatttcgaagacaaaaatttcttcagtcattgcatgccttcaaaaggcgacaatgaccctcatttacatttcgaagacgacaatgtcttcagtcattgcatgccttcaaag

SEQ ID NO: 22655 - DNA, 993 bp, Glycine max
  Peptide Sequence Number=SeqID_114340
atgggaacaaatcaaactggaaaaaggttctatcaagtcaagattaagggcctagatgtcaccagccttaaggagttggggcgattgatgggacctctccaaatgcaagccttccgcagggcgtacagaaagattttagatttgaccatagcagagatattcacggaagccgttgtatcactcacccaatactatgaccagccattgagatgcttcacgtttggagacttccaattagtaccgactgttgaagaatttgaggaaatactaggatgccctcttgggggaagaaaaccgtatcttttctccgggtttcttccctccttgagcaagattgtagttgtggtcagggattcggcaagagagttggatcgtgtaaagcaaactcgaaacgacgtagtgggcctaccacgaaagtacttagaaggcaaggcaagggatatggcgaatcaagaggagtgggtctcgtttatggacgtattagcattgctaatctttggagttgtcctctttccaagcatggacggtttggtggacctagccgcaatcgacgttttccttgcatatcaccatagcaaagaaagcccagtggtagctgtcttggcgaacttatttgatacatttgaccgaaggtgcgagaagagtagcgcacggatcatttgctgcttgcccgctctttgtgtatggttggtttcgcacctattccaacaagacataaggcatccatgtccgctccgaagccatcgctcatgtgtcaaaaagagaagagtagattgggaccaacacttgactgggataggaggcagaataatcaactggtttcctcgatggaaggaaggaaaggagggatttctcttctcatgtggggactacccaaacatcccgttgatagggacgaggggttgtattaactacaatcccacacttgctataagacagttagggtaccccatgaggggagcaccggcggaagagagcctctctcctttcctt

SEQ ID NO: 22656 - DNA, 848 bp, Glycine max
  Peptide Sequence Number=SeqID_114341
atggtgaaagttggaacctcttacgtgccgatcaacgtctcatttcgccaaaagttggcccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatttctttcttcctaccaaatctggtcaaattcaattttgccgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 22657 - DNA, 384 bp, Glycine max
  Peptide Sequence Number=SeqID_114342
atgaccactttgacccagacatggatgacactgctgctcagcaatgtcttggctagcgatcacaactccgacctccctctgcctaagagccagttggtgtatgccatcctgacacatatgagcgtctacgtggcccagtcctacggagttcctgtcacccccaataaagtaatccgaccaccgatcacccgggccttcatcgagaagtattgcacgcctaggcaggcgcagagtgatgcacatcaggccgcagacgtaccgccaccacctcggcaggctgatccagctgggtcactgggcgtggagcgttatctacaacatttggttcgccaacaggcggccaaccaccgtgggcaggtgcaaatacatgagtgtctctgctag

SEQ ID NO: 22658 - DNA, 408 bp, Glycine max
  Peptide Sequence Number=SeqID_114343
tcgttcggagtccccgttgcacctaccaaggtgattcgaccgcccatcacccgggcttttattgagaagtactgcacccagagacaggctcaggggaattctccacaggccgcaagcgccaccaccacctcatcaggctggcccggctgggcagccaaccaccgggcacatgtgcagacccatgattgtctataccagatgagcctcagcatgcagagccagggcttcgcttctttttcatgccctactccagaccagttcagggcagaggtcacatggcccggggattggcccgaggcccaagcaggagaggcgcccccggaagttcccggcgatggagaggaggcccacgaggacgaggagatgggcgatttgcttgacttcttgggagggaatggagctacataa

SEQ ID NO: 22659 - DNA, 329 bp, Glycine max
  Peptide Sequence Number=SeqID_114344
atggcgcagaagatgacgttagtctctgcgtgctataaggcttttcgttttacagatatcaaaaaaagaatgtttgtacggataaccactcgggtatttccgcccggtcagcgtgactcaaatgtgagtatgacagatcttgtgagcgcggaagatgacacagcaaaaaagaatgtttatacggataaccactcgggtatttccgcccgtcagcgtgactcaaatgttagtatgacagatcttgtgagcgcggaagatggtgcttttcgtcttacagacatcaaaaaaagaatgtttgtacgggataaccactcgggtatttccgcccg

SEQ ID NO: 22660 - DNA, 819 bp, Glycine max
  Peptide Sequence Number=SeqID_114345
gcttcccggtatcaacaggacacccaggatttatttattctgcgaagtgatcttccgtcacagtggcttctgtttctatcagctgtcccctccctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgaattcgatgcaaaatggtagggtcgaaagaaagcatcggcatatcctcaatgtggcgcgagctttgcgatttcaaggaagtctacccattgaattttgtcttgctaagttttatcaagcttatcgataccgtcgacctcgagggggggcccggtaccagcttttgttccctttagtgagggttaatttcgagcttggcgtaatcatggtcaaagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 22661 - DNA, 288 bp, Glycine max
  Peptide Sequence Number=SeqID_114346
atggggtgtacccatgggcccgaaatctaccctaaggctcataagaaccctagggccttctcttgcatctctggcccaatctacttggagttttctatccaatgcccttgcggggtaggattgcatcataaccataaggtgtgttcacgtgctaccggacccttgggtcacgatcgcagaattgagacttgtttgcggtctcgaccggaagacgctgacatctttgggaagggtgcagatgaccacattggtctttgcgtgccaatcgggcttcgggtctgcgaatga

SEQ ID NO: 22662 - DNA, 390 bp, Glycine max
  Peptide Sequence Number=SeqID_114347
atgaagaacgatgaagaacgatggaaaaccttcactgatttgctcacggcagcgttacggaacaacctcagcttggattttcttcatggaaacaatttttttcacccaaaacagctgaaatgcatagccaagggggttaggaatatttggaacagcctcccttcgcctatttataggaaaaggggggaggaggttgctgcccagctcgcccaggactttatggattatgcaacaatgctctttttgacttccagaaggttgcggatctttacggattgcgcaacaatgcttgttttgatttctggaatggtgcgagactttacgaattacacaacgatgggtgttaaatatttcgaggtggtcaagcgaaggtcgcatgccaacaaataa

SEQ ID NO: 22663 - DNA, 552 bp, Glycine max
  Peptide Sequence Number=SeqID_114348
ggcgtagtcgatggacaacaggtgaatatcctgtactacctttgttggtcccgagggacggaggaggctagggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggactcggtgaaatagacatgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagtgagataccactctggaagagctag

SEQ ID NO: 22664 - DNA, 411 bp, Glycine max
  Peptide Sequence Number=SeqID_114349
atgggggttcttttcacccttccctcacggtactacttcactatcggtcacccaggagtatttagccttgcaaggtggtccttgctgattcacacgggattccacgtgccccatgctactcgggtcagagcggtgcagcattctctgctgcttcgcctagcaggatcacctgttgttcctcgacaacgcccttcggcctgcttaggccctgctcaccctttccgctggacgaacctctgcggaggaacccttgggttttcgaggttggttcctcactcaacgtttgcgttactcaagccgacattctccttgccgcttccgatccagcactgctcgcgcgagcttcgagtcgcttactacgccccgttcatctctctggcgcaagagcctagtgagctattaccaccataa

SEQ ID NO: 22665 - DNA, 162 bp, Glycine max
  Peptide Sequence Number=SeqID_114350
atgctcaacaagaggttggcacaaatactacatggtttcccttatgttaatttggagtctgcaataggttgtgaattatcccctgaggcatgtgcccaggcggatcttaagttgacttatggtaagcagaaagaaggagtgaataggcaattttgtccctga

SEQ ID NO: 22666 - DNA, 417 bp, Glycine max
  Peptide Sequence Number=SeqID_114351
atggaagggttagtggacctagcagtgattgacgctttcttcgcctttcatcatggcaagaaaagcccggtcgtcgccattttggccatgtatgacacgttcgaccggggatgtgaaaagagtggcacaagaattgtttgttgtgcactggctctctatgtgtggctggtttcacacctttttctccaagaaggtaggcccgtctatctgctacaaggtcaccgctcgtgcatcgaaaaaggaaaggcaaattgggaccaactcttagcaagcaaagaaggagcatctgtcaactggttccctcgatggaaggaaggaggaaccagagttcttatttcatgcagaggatttccaaatgttcccttgatggggacgaggggttgcatcagctacaatcccgttcttgcaataagataa

SEQ ID NO: 22667 - DNA, 201 bp, Glycine max
  Peptide Sequence Number=SeqID_114352
atggtttggcagtctccaaatcaaaaatcaatcttttccaaactcgaattcgattccttggtcacaatatatatcaaggcatttaaaattgtcgaaactgatgcttcagacataggttatggtggcatcctcaaacaaagagtccatggccaagatcatgtcattgcatatacatcaaacattggaatcctgcacaattaa

SEQ ID NO: 22668 - DNA, 471 bp, Glycine max
  Peptide Sequence Number=SeqID_114353
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgttcctgcctttcggtttaccggtgtcattccgctgtatggccgcgtttgtctcattccacgcctgacactcagttccgggtagcagtcgctccaagctggactg

SEQ ID NO: 22669 - DNA, 516 bp, Glycine max
  Peptide Sequence Number=SeqID_114354
atggcctcgtggaagcttgcctcaaagagatctaggaaggataaagcggctgaaggaaccagtttcgctcccgaatatgacagccaccgtcttaggagcgctgagcaccagcagcgcttcgaggccatcaagggatggtcatttctccgggagcgacgcgtccagctcagggacgacgagtataccgacttccaggaggaggtagttcgccggcggtgggcatcactggttacccccatggccaagttcgacccatacatagtcctcgaattttatgctaatgcttggcctacagaggagggctggatcccgtttgatgcggatgctcttagccagttcctgggataccctttagtgctggaggagggccaggaatgcgagtatggtcagaggaggaaacggtccgatgggttcggtgaggaggccatcgcccagctgctatgtataccggggcaggattttgcctggactgctgctggaagacgggtgcggattgtagacaaaggctcaagctga

SEQ ID NO: 22670 - DNA, 261 bp, Glycine max
  Peptide Sequence Number=SeqID_114355
atgaagcacttcactgacactctcatcagtcccaacatagtaagccagtatctctccgctagcgcgcaatacgcaaaccgcctctccccgcgcgttggtcgattcattaatgcagctggcacgacaggtttcccgactggaaagcgggcagtgagcgcaacgcaattaataactaggatgactatcgaattcctgcagcccgggggatccactagttctagagcggccgccaccgcggtggagctccaattcgccctatag

SEQ ID NO: 22671 - DNA, 414 bp, Glycine max
  Peptide Sequence Number=SeqID_114356
atggattgcaacaccaacacagttgacattacgcttcgcacaaacagaaaagagaaaagtagacaagtagaaaacctaaacaacaacaagccaacaaaagttacaaaacctaaatccctaatagtgcgaattgcgaaaattgatctggctgcacctccaccacacgagccaccgatggcgacagtgacctccgaatgctcaattgcccatcaccacagcaccgaccttcctcttccacctcgtttcaatcgtttgtgtcgtcgttgtggtcgacctccaaaacgattgatggaaatggcgtctgaaactgtaaatcgagttgactctgttgatgatattgaatttatggaagatgacgaagaagccagggttgacaatgatgagaaagagagtaaaaaaggagaacagaagtga

SEQ ID NO: 22672 - DNA, 156 bp, Glycine max
  Peptide Sequence Number=SeqID_114357
atgtcggttggtaaacagggagctaagggaccagcgaaacctgcagataggcctgatcctgatgttgatcctctatacctgatgacattgaccatcccacatcttttccttaagcctttgcaggccataggatgctaccgtgtttggggtgtataa

SEQ ID NO: 22673 - DNA, 729 bp, Glycine max
  Peptide Sequence Number=SeqID_114358
atgggatcaagtcaaaagccttcgcttaaaaagaggttatatcaagtcaaaatcaagagcttagaggtcactagtttacgagagttggggcaattaatgggtcaacttcaacggcaagccttccgcaaagcctattgtaagatttgcgacctagctagggtagaagtctccatggaaccgattgcatccctttcccagtattatgaccagcccctaaggtgcttcacatttgaggacttccagctagtgccgactgtgaaagagtttgaagaaatcctgggatgcccactgggaggaaggaagccatatcttttctctgggttctatcccctccacgacaagagttgccaagggcaaaggccttggcaaatcaaggcgaatgggctttcttttattgacatcttggcgcttttgatctttggagttgtcctctttccgaatatggaagggttagtggacctagcagcgattgacgctttcctcgcctttcatcatggcaaggaaagcctggtcgtcgccattttggccatgtatgacacgttcgaccggggatgtgaaaagagcggcgcaagaattgaaggaagaatcaggattctatcttcatgcgaaggatgtcccatgagaggagtgccatcagacgaaagcatcacgcctttcatcgcacgaggtttcagcgaccacaacgcgagggtactccaaggagttcgcaaggcatgggatgcggcgtga

SEQ ID NO: 22674 - DNA, 594 bp, Glycine max
  Peptide Sequence Number=SeqID_114359
atgacaccttcgactgaagatgtgaagaaagcaatgcaaggattgtttgctgtactccagctctctatgtggggctggtttcacacctttttctccaagaaggtaggcccgtctatccgctacaaggaaggaagaatcaagattctatcttcatgcgaaggatgtccaaatgttcccgtgatgggaacaaggggttgtattaattataatcccgttctcgccataagacagcttggctaccccatgagaggagcgccattagacgaaagcatcacgcctttcatcgcacggggttttagtgaccacaacacgagggacagagagcttaggggaagcagtaatgggatcatcggcggctatcataagtggctgagagtccgaacacaaggattggattggctcccaaatctaaagactgtgagggaggatgaggttaaagcttcggaagaaagtgatgaggtacaagccctaaaggcagagcttgaaagagcccgagtagtcgaagagaagttcaagtccatagccatcaaaggcagcaatagtaagctcaagctccgaagaggtgaaaggaatcatcacgggtcaaaggcatga

SEQ ID NO: 22675 - DNA, 510 bp, Glycine max
  Peptide Sequence Number=SeqID_114360
atggttcatatgtgtctggacaaggtcataagggtaaataggtggcaatgttggtggctggccctgacatggtctatttggcagcataggaacagcatactgttttccaatgcagtgttcaatggcaacaaagtgtttgaagatgcagtttttcttctctggaccgggcttagaagtttagagaggaattttacaatacattataaccagtgtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 22676 - DNA, 414 bp, Glycine max
  Peptide Sequence Number=SeqID_114361
atgcaaagccctgttatgtcctctcccctcggtaggaatttcctcttcagcgaaggtgaggtagttgttggccgtgatgttattgaagagtcccccaaagccttctacggagatgtcttgggctacataagcttcattcaagacttttaccagcaaagctcgatgaggctcagagctcatgagcagttccaaaagagagactctagctggggttttgttgagttactcaataactttgaactcactttgttgaataatgcggaggaactcgctggcctcctagagcgatacctctttcttgtcacaaccctctcttccctcagaaagacctttcatcggaacatcctcacccgaagtggggatcactttgacatttggtccttccgtcatccttgccttccccttagcatttga

SEQ ID NO: 22677 - DNA, 171 bp, Glycine max
  Peptide Sequence Number=SeqID_114362
atggatagtgaagcgcagaataccttccgcattgacaataatgaccgttcaagattgaagtctcctctacttcaaaccttgtgtccagagtggatgtcatacaccgtggggagtgcgaaccaagtgcttcgttcgatttttctaagggattctttatactcaagcgtttga

SEQ ID NO: 22678 - DNA, 372 bp, Glycine max
  Peptide Sequence Number=SeqID_114363
atggtcattccaagggagaggcgtgtccagctcagggaagatgagtactcagacttccaggaggagatagctcgcaggcgttgggcacctttagtgactcctatggccaagttcgaccttgagatagtcctagagttctacgctaatgcttggcccacggaggagggagttcgggaaatgcgctcgtgggtaaggggtcagtggattcccttcgacgcagatgccctcagctaccatcgcccagctgctgtgcataccggggcaggattttgcccggaccgctgcagggaggcgggtgcggatcatgcgcaccagcatgactactttgacccagatatggatgacactgctactcagcaatgtcttgcctag

SEQ ID NO: 22679 - DNA, 508 bp, Glycine max
  Peptide Sequence Number=SeqID_114364
atgggtgaagtagaggaggtgcaagagcagatgaaggccgacatggaggccatgaaagggcaaatggccacaatgatggaggccatgatgagcatgaataagataatggaagccaatgcggttgcagttgccgctaccagcactattgctaaggtgaacccgatgcccccatctgatctcaaccgtatgaatcatccaacctcagatatgacacatgaaattccccaccacaatctagccgacttcgagccttgcctcggatataccactgaagggcaagcagttggtggtatacccctgcgaagcactttggagggccctcagtatcacccacaactacacctcttgcattccacaacaagtgaaaaccctcatgctatggcaggaataggaaagttggatcatctagaggaaaggctcagggccattgaaggaggtgaagattatgcctttgttaacctagatgagttgttccttgtacccaaacatggtcattcccaagttcaag

SEQ ID NO: 22680 - DNA, 1291 bp, Glycine max
  Peptide Sequence Number=SeqID_114365
atggctacctcaccaaaagaaaccttggctcctggttcacccgctgtaccatcatctccgcaccaggaacaacctgatttcaacatccaacccatacaaataattcctggtcaagcttctgtccctgagaaactggtccccagaagacaacagggagtgaagattgctgtaaaccctagccttgcaacaagttctagggaagtagacacggagatggacaagaaaatccgcagtattgtgagtagcattttgaaagaagcctctgtgcctgaagctgatgaagatgttccaacatcttccaccccgaatgtttctgtgcctgatgttgagaaagatgttccaacatcttccgctccaaatgctgaagccgtcccttcacccagtgaagaggaatcaacggaagaagatgatcaagccgcagaggagacccctgcaccaagggcaccagaacctgctccaggtgacctcattgacctggaagaagtcgaatctgatgaagaacccattgccaacaggttggcacctggcattgcggaaagacttcaaaacagaaagggaaaaaccccccttaagaggtctggacgaatcaagactatggcacagaagaagagcacaccaatcactcctgccacatccagaagaagcaaggttgctatcccctccaagaaaaggaaagaaatttcctcatccgattctgatgatgatgtcgaactagatgtctcgacatctaagagggccaagaaatctggaagaaaggtgcctggaaatgtgcctgatgcaccattggacaacatctctttccactccattggcaatgttgaaaagtggaaatatgtgtatcaacgcagacttgcggttgaaagagaactgggaagagatgccttggattgcaaggagaccatggacctcatcaaggctgctggactactgaagacagtcaccaagttgggagactgttatgaaggcctagtcagggaattcattgtcaacattccctctgacataacaaacagaaaaagtgatgattatcagaaagtgtttgtcagaggaaagtgtgttagattctcccctactgtgatcaacaaatacctggacagaccaacagatggagtggtggatattgctgtttctgagcatcaaattgccaaggaaatcactgccaaacaagtccagcattggccaaagaaagggaagctgtctgcagggaagctaagtgtgaaatatgcaatcctgcataggattggcgctgcaaactgggtacccaccaaccatacctccactgttgccacag

SEQ ID NO: 22681 - DNA, 912 bp, Glycine max
  Peptide Sequence Number=SeqID_114366
atgaaaagagaaaaacatgcctcctatagtagtcataactcttgcaagagcctaagtgaagaacttcgtgactattacgaaggaaggcataggtcacatcttagacctcactcccatagaagagaaaggaaagaaagcctcaagaggctaacattaacctctcatacttccatggaggacatagcaacacttaaaaagaagtctacttcaaaatcttatggctttcactcttatccaaagaaagaccaaggtcaaggcatcttaggggtgacaccttctaagcccaaagatgataaggggaagacaatagaaaagcaagcccctaaggctagtatgcaagagaaaactagctctataaagtgctttaaatatcttataagaggacacattacttctcaaagccccaccacaaaaaccatgattatgaggggccaagacatttatagtagccaagatgaggctactacttcaccttcatctagtgaaagtgaagaagcaaaaggggaagaatgtagtgaagaaatctacccccaagaagatggacaaccattagtggttaaagagaagtgtaaggaggtaagtgtctcctccaagaggttagctaagaaggaaactcattttacaataaagacaaacattaaagaaactttccctcttagacaacctccacattttctcttttgtaaaaagacacttgctagcattgccacacctcttgggcttgagtttattcctcaagtaaagaagttgttggatgagggtttggttcgcaagagcttaaatccatgtgctttgttggtgcccaaaataggtattattaggcaccaagtccctaaaatgggtggcatgatgaatgttttgagtggtgcaaccctcttttgtaaaatcactcgtacacgtaacatgttcatg

SEQ ID NO: 22682 - DNA, 156 bp, Glycine max
  Peptide Sequence Number=SeqID_114367
atggagaaatttgagaataaaaacattggagaaaagaaggcaaagaaggcctacatcacatgggatgataatgacttagaatcgtctgatgattctgaaaaagaagtgattaatctatgtctaatgggcaaaaattatgaaagcgagaaagagtaa

SEQ ID NO: 22683 - DNA, 881 bp, Glycine max
  Peptide Sequence Number=SeqID_114368
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggaattcgatcctccactatgaaatcgcgtagaggctttactattcagcgtttgatgaatgcaatgcgacaggctcatgctgatggttggtttatcgtttttgacactctcacgttggctgacgaccgattagaggcgttttatgataatcccaatgctttgcgtgactattttcgtgatattggtcgtatggttcttgctgccgagggtcgcaaggctaatgattcacacgccgactgctatcagtatttttgtgtgcctgagtatggtacagctaatggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccacccc

SEQ ID NO: 22684 - DNA, 279 bp, Glycine max
  Peptide Sequence Number=SeqID_114369
atgtcttacgaacggggcggagatttcctggaagatgccaggaagatacttaacagggaagtgagagggccgcggcaaagccgtttttccataggctccgcccccctgacaagcatcacgaaatctgacgctcaaatccgtgggggcgaaacccgacaggactataaagataccagggtttccccctggcggctccctctggcgctctcctgttcctgcctttcggtttaccgacttctttccgctgttatggccgcgtttgtctcattccacgcctga

SEQ ID NO: 22685 - DNA, 354 bp, Glycine max
  Peptide Sequence Number=SeqID_114370
atgggtcactggctgtgtaattcgagtttagcctctggtaatcgattaccaaggctgtgtaatcgattaccagagatgaaaagcctaaagatacccctattacttgcatattctcgtgaaagagtctaccccgtccaagtgatcgaggtaacgtcatccgaggaagaccctgaggaggatcttgaggagctaccttctgagcctgctgtggatgctcttgactttctagagggtgatgaggatccacttcttgaggtggattctcccgaggaagtcatgtcggcatctaaggcagattctacagaggatagtggcccgggggagatggcgatcagcggaggctcttcatcatag

SEQ ID NO: 22686 - DNA, 504 bp, Glycine max
  Peptide Sequence Number=SeqID_114371
atgagttcaaggaggaacttgagagacgccattgaggagttgactaactttgtggacggcaacattgatattgccattgtaaaagaattctatgcaaacctctatgaccccgaggataaatcacctaaacaggtgagggtgagaggtcatctgattaagtttgatgaagacacacataacactttcttgaagacccctgttattgtggaagagggagaatcactctgtgcttattctagatttgcacttctgaggcctgatcctcaggagttggctactaagctctgtatcccagggtgggaatttgaacttaatgctgacgggcagcccttgaagattctgaggaagaacatgactacactagctcaaacatggagcggtctttccttctcgaacttgattcccacctcccacacttttgatgtcactcttgacagggccagactcatctatggcattattatgaagatggacatgaacgtggggtacctcatctcccactag

SEQ ID NO: 22687 - DNA, 533 bp, Glycine max
  Peptide Sequence Number=SeqID_114372
atgactagaggcaatccatctgacttacaaccctttgaccctgagatagataggacatttcatagattagttaggcatcattttttaccttttgatcatcctgagcattccattactggtgaatctgtgcattctgttattggtgattttgaacatcctgatttggagcattataattttgagcattctgattctgagcattctgattttgcacattctgaaaacatggcacaacctccaccccgtgagaggaccctaagggaaatggctgcacctgatttcacctacgaaagcttgtgcatccaataccctgatgaggatgtcccatatgttcttaaaactggactgattcatttgcttccaaagtttcatggcctttcaggtgaagacccgcacaaaaatttgaaggaatttcacattgtctgctccaccatgaaacccccagatgtccaagaggatcacatattgctgaaggcttttcctcattcattagagggagtggcaaaggactggctgtattaccttgctccaag

SEQ ID NO: 22688 - DNA, 354 bp, Glycine max
  Peptide Sequence Number=SeqID_114373
atggttacctcgaaagaaaacgaaagggttcctctcgatgtggagaacaacgatggtttgtggtggctaatggtagctatgggtgatggagaaactacacgaaagcaaaggctgaaatgcttaaataagagatgctctcgggaaaggaagattctagaatactccagacatcttctcaaagatcccaacggtcagatcatggaaaagtgtcttgtgaagttgcagaccaaatttcgagaagatccaacggttaacgaacgctgggcatcgtttttaccgaggcagcttcatgtagctttctctagaagcttcattaagaggcttcctctagaagcttcctcgtggcttctttga

SEQ ID NO: 22689 - DNA, 324 bp, Glycine max
  Peptide Sequence Number=SeqID_114374
atggcttcgaaaaagctttccacgaagaggtttagaagagacgccgcaacggaagggtccagtgccacccccgagtttgatagtcaccatttccggagcgccgagcaccagcaatgcttcgaggccatcaaaggatggtcgttccacagagagaggcgcgtccagctcaggaaggatgagtatacggactttcaggaggagatagctcacagacattggacgtcgctggtgactcccatggctaagtttaacccagagatagtcctggagttctatgctaatgcttggcccacagaggagggagtgcaagacatgcgttcatgg

SEQ ID NO: 22690 - DNA, 300 bp, Glycine max
  Peptide Sequence Number=SeqID_114375
agacaggcccaaagggatgctccgcaggtcgcagactcgccgccacctcatcaggctggcccagctggatcctttgatacagagcagtatttgcggcatttggttcgccagcaggcgaccaaccaccgggcgcatgtacagacccatgattgtctttaccagttgagcctcagcctgcagagccagggttttacttctttttcgtgccctactccggaccagttcagggcagaggtcgcatggcctggagattggcctgaggcccgggcaggagagccgccagcagaggcaccagcatag

SEQ ID NO: 22691 - DNA, 531 bp, Glycine max
  Peptide Sequence Number=SeqID_114376
atggaagctcctaaaaaagatcttaccaccctgactcagacatggagcgttttctcgtactcaaacctagttcctacctcccacacttcaaatttgaacacagacagagctaggttggtctatggcttaatcacaaggatggacatgatgaacattggcagtttgatctctggacaaatgaccatgatcgcccagtctaacccttctcgattaggcttcccagctttaatcacagccttgtgtagatcaaggggagttggatctgatgcccttacctcctatgaaaacctaagactggccattgacttagcttatatcataaagaactattggaatgcgaatgaccaaacagttaattttccagagacaaggaagaccaagctcagagcagctgatgttccctattcctttacaccaatagctggcatccctgcatcttctacttcggccccacctccaactttagcagacttatctgcccagagctctcagacttcagatgccaaatttcaaagcttgtttgaaggatag

SEQ ID NO: 22692 - DNA, 633 bp, Glycine max
  Peptide Sequence Number=SeqID_114377
gacgcgccgccgcatgagatcgcggtgaacgtgccgcaggccatggccaaggtgcgattgcagacctataccgagtacgcgtttccagcggcgctgggcaaactgtaccggcgcaacgggctggcgctgtcgctggccacggcggcggggctggcattgttcctggcattgacggtgatgctgacgggcgggttgttgcacgcgccgatggccggcaatttctacgcggtgttcccccacaacacgctggcgctgatgttcggcgcggcgttcggtttcgccatggtggcgctggccatcggcgcggcgcgcttctggcgcgacgtcagcccgggcacggccagcggcgcggccgtggccgaggccgcgcacgacgcgctgcgcctgcgctacctggatggcggccatggcaagggctgcaacaacgccgatgacgcctttacgctgtggcgcaggcgctttcaccacttcacgtttctacggcttcatgctggcgacgcggcgcaaaagccgatggaccgcggcttcatcgccttgctgttgctgaccagcgccaccggcctggcgctgctggccggcacgcgataccggcgccatggtcctgctgctggcagtgcaacctgggcgtggtga

SEQ ID NO: 22693 - DNA, 630 bp, Glycine max
  Peptide Sequence Number=SeqID_114378
atgacagtcaccgcgttaggagtgctgtacaccagcagcggggtcgaggccatcaagggatggtcgtttctccgggagcgacgtgtccagctcagggacgatgagtatactgatttccaggaggaaatagggcgccggcggtgggcaccactggttactcctatggccaagtttgatccagaaatagtccttgagttttatgccaatgcttggccaacagaggagggcgtgcgtgacatgagatcctgggtaaggggtcagtggatcccgtttgatgccgacgctatcggccaactcctaggatatccgttggtgttggaagagggccaggaatgtgagtatggccagaggaggaaccggtctgatgggttcgatgaggaggccatcgcccagctgctatgtataccggggcaggatttcgcccggactgttgcagggaggcgagtgcgaatcatgcgcaccaacatgaccaccctgacccagatatggatgacgttgctccttagcaacatcctgcccaccgatcataattccgaccttcccatgccgaagtgtcagctggtatggcgcccactaggcaccctttggacccagataagtccaacagggccctgggattccccgcactga

SEQ ID NO: 22694 - DNA, 231 bp, Glycine max
  Peptide Sequence Number=SeqID_114379
atggcagcggaatggagaaggaagggagagaggagatgccacttcaaggagaagatgagtctagaagaagctcaccaccataggagaccatggataagagcttggaggaagaaggagatgaatgaagggagaggaagagaagagcacgaaattttgtgctctaaaagagctctgaaatctgaacccactaatccaagatcaattccaagattctccactaagtgtgcttag

SEQ ID NO: 22695 - DNA, 252 bp, Glycine max
  Peptide Sequence Number=SeqID_114380
atgatgaacaaggggcaaattgaagtctgcagtgcgaagaaaggggaaggagatgtatgcatgcagttagacatactgccacgcttatctggtgccgctttgatggtggctcgggttatgttaaggggcggatatgagcccggaataggtttaggccgaaacggggatgaaatggcaaacatggtggagttcgcagagaatcgtggaaggctcgggttgggttacgagcctacacatgccgacaagaggagg

SEQ ID NO: 22696 - DNA, 438 bp, Glycine max
  Peptide Sequence Number=SeqID_114381
atgtgtcgttgcaggcaatggctacaaagaagcgtctcaccaaaagggcaaggaaggacaccgcaggggagggatccagcgcagccccacaagaagaaattgagtttgatggacaccgtttttgaagtgaggagcatcagcgctgcttcgaagcaatcaagggtgtggggccaatggatcccctatgatgaggatgccatcaaccagttcttggggcatccgttggtcctagaggaggggcaacgttgtgagttcaatgagagaagaagtcgggtctcaggatttgataaggaggccataggccacctactgtgctccccaggacaggactttgcgcgaagcgtgacaggaaggcgggtgcggatcatgcgcactagcatgaccatgttgacacagacagatctggatgacgcttctcctcagcaacatccttcctag

SEQ ID NO: 22697 - DNA, 213 bp, Glycine max
  Peptide Sequence Number=SeqID_114382
atgggtgccaagcacctcacgaggaccaaagaatggtcgcacgttatcaagcaaaggtccccggacgaaattagggcagacacagttgtgtccgatggcaagcagagaccaagtttggtcattctgcacccaagatacgcggagataccttacggttatctgcacccctttgctaggcagacacagttgtgtccgatggcaagcagagaccaa

SEQ ID NO: 22698 - DNA, 432 bp, Glycine max
  Peptide Sequence Number=SeqID_114383
actaacgtcgtcatctgcaccctttttcaactaggggcaagcgagcccgttgacacgcagagactaacgtcgtcttctgcacctttgtcatccaaagatggcgagtccgatgacatgcagagatacccaagtggttatctgtacaaaacgatttctgttaatcctgactcgagaagtcaggtggtaggcggagatacccaagtgacggcgagtccgatgacatgcggagatacccaagtggttatccgtacaaaccaacttctgttaatctcgacccgtgaagtcaggtggcaggcggaaataccccaagtggttatccgtacaaacgcacttctgttaatcctgacccgtgaagtcaagtggcaggaggaaataccccaagtggttattcgtacacacacagttttgctaccccgacctgtgagaagtcag

SEQ ID NO: 22699 - DNA, 161 bp, Glycine max
  Peptide Sequence Number=SeqID_114384
atggtcctcaccaactcaatgagtggtgctacaaggcgacgcgtgactcgcgggatgcgtgttccacgaaaggaatacgcgcggagtcgccaccaacgtttatttgaggaaaacgtcggaaaaaccggaaaagacgcgatctacgaactttttagtgaaag

SEQ ID NO: 22700 - DNA, 443 bp, Glycine max
  Peptide Sequence Number=SeqID_114385
atggcatacatacctccgaagatgagcagtatgacagtatttgttgcagtaacagtgaaggagcaacttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 22701 - DNA, 771 bp, Glycine max
  Peptide Sequence Number=SeqID_114386
atgaaaaggggtagtgtgttggcaacaacgcacacagcaacaaagagtcataaagcctcagtagttaagaaagtaaagaagcccagtagtatcaaggttagcagtaaacaagagtattctcgcaatagtgtaaagagcagttcacttcctgatttgcgaaaatacccttccgggacaccaaggaaaaaagcgtttctccggacggttatgccttacattacaaagcaaaatcaagcgatcacggcagatcgtaactggcttgtctctaagcaatacgacggccgttggtcgccgagcgagcaggcgcgtctgaaagatatcgcctcacgttataaagtgaagtggtctggcaatactcgccgtataccatggaactcgctgcttgagcgcgtcgacattattccaaacagcatggtggcgaccatggcggcggcggaaagcggttggggcacctcgaagctggcgcgcgtgaacaacaacctgtttggtatgaagtgcggcggcggcaattgtcgcggtgcgatgaaaggctactcccagtttgaatcggtcgagcagtcggttcaggcttacgtgagaaaccttaacacgcatccggcttattcatccttccgtaagtctcgcgcacagctgcgtaagacggaccaggaagtgactgccagcgcgatgatccacaagttgaaggggtactcgacgaaagggtcgagctataacaactatctcttcgctatgtatcaggacaatcagcgcttaattgccgctcatatgtaa

SEQ ID NO: 22702 - DNA, 675 bp, Glycine max
  Peptide Sequence Number=SeqID_114387
atggagttctctatgcagacctatttcgatcaactcgatcgcgttcgttatgaaggccctaaatcgactaacccactggctttccgtcactacaatccggatgaattagtactgggtaaacgcatggaagaccacctgcgtttcgctgcctgctactggcacactttctgctggaatggcgcggatatgtttggcgtggggtcctttgatcgtccatggcagcagccgggcgaagcgctggaaatggcgaaacgtaaagccgaagtggcatttgagtttttctataagttgaatgtgccgtattactgcttccatgatgtcgacgtttctccggaaggcgcttcgctgaaagagtacagcaacaacttcgcgcagatggtggacgtactggcggaaaaacagcagcagagcggcgttaaactgctgtgggggacggcaaactgctttaccaacccgcgttatggcgcaggggcggcgacgaaccccgatccggaagtctttagttgggcggcgactcaggtggtcaccgcaatgaatgcgacccacaagttgggcggtgaaaactattctgtggggcggtcgcgaaggttacgagtcgctgttgaataccgatctgcgccaggagcgcgagcagattggccgcttcctgcagatggtggtggagcacaagcataa

SEQ ID NO: 22703 - DNA, 522 bp, Glycine max
  Peptide Sequence Number=SeqID_114388
atggatgtcgaagaacggttgaaaaccttcgtcaaaatagggaaggagcttgccacccagctcgcccaggcgagcatggttgcttcctccagaagtaatagccttttggaggaagaatctggaaggcccaattttcgaagaagttacggaaactcacggattgcacaacaacacctccttttggtttccgccgcattacggaatttcacggatcgcataaccctgcttccttttaaaatgacttccggcgcgtctcgagacttacatattgtgcaacaaaggggtgccaagtatcttgaaacgaccaatcatgaggttgcatgtcatcaaaaatccccaacaagggtgtgtggaagcaaagcttacaagcttattttgatgatgccaaagactcaagtcaagaatcaagattcaagcaagtttcaagaaccaaaaagtcattcaatcaagaatcaagattcaagtgaagattcaagagaagactcaagatatgcaagaacctcaagaatagcatcaagataa

SEQ ID NO: 22704 - DNA, 264 bp, Glycine max
  Peptide Sequence Number=SeqID_114389
gatatcgatgtctggcagaggaaaattgtccttgggactggcccgattcaggtcccaataatctacgcacattcgtacgttcccatccttcttagggacaggatgtctcgggcttcatcctcctcagcttttgttttaccaaggaacactcaggatttagagggccatcaattcttcacggatgggtgtggtcatacctgtgcctatcttcacttccttttcccactgctggttcctaagtttactagttccgtctcttcttga

SEQ ID NO: 22705 - DNA, 222 bp, Glycine max
  Peptide Sequence Number=SeqID_114390
atggataatgaagagggcgtgcaagaacagatgaaggccgacctatcggccttaaaagatcaaatggcttctatcacggatgccatgctaaaactccagaaaactatagaggataatgccacggcgaccgcctccaatgcatccacaagcttactgtcataccctaatttcgtccggggacctttgcttgatgacatgcgaccattctttggtccttgtgag

SEQ ID NO: 22706 - DNA, 462 bp, Glycine max
  Peptide Sequence Number=SeqID_114391
atgactaccttgacccagacatggatgacgttgctgctcaacaacatcctgcccagcgatcataattccgacctacctctaccgaagtgtatgccgcctaccaggcaccctctagacccagataagtctaacagggccctgggttttccggcattgatcacgggtctctgccagtcgttcggggttcctatcacacctagtaaggcggccaaccacagggcgcacgtgcagacccatgactgtctctaccagctcagcctcagcctacagagccagggtttcgcttcttttccatgccctactccggatctgttcagggcagaggtcgcatggcccggagattggcctgaggcccaggcaggggaggcgcccatagaggctcctggcgatgcagatgaggcccgcatggacgaggagatgacagatttactcgatttcttgggagggagcggagccacatga

SEQ ID NO: 22707 - DNA, 357 bp, Glycine max
  Peptide Sequence Number=SeqID_114392
atggtaaccgccatgacaatcagaggactgctgctaggggatttgcaggtggtagcggtagcaaacccaatactttctccactcatatcatttgtaataggtgtgggacacactcaaagagattgttcacgactcaagaaagagcaaaatggtggaggcccgaatggtcaaactggacatccaaaggccacgggaagagtctttacccttaatggtgttgaagctttgaaatccaaagatctaatccaaggaaaacttaagctttctgtgtcttccttaaataaagatctagtggtagagacccctactagtggttctgtgttaacttattatgaattaatgaaacattgggcttaa

SEQ ID NO: 22708 - DNA, 746 bp, Glycine max
  Peptide Sequence Number=SeqID_114393
atggtgaaagttggaacctcttacgtgccgatcaacgtctcatattcgccaaaagttggcccagggcttcccggtatcaacagggacaccaggatttatttattctgcgaatggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 22709 - DNA, 353 bp, Glycine max
  Peptide Sequence Number=SeqID_114394
gcaggcacaggccgatgcaccacaggccgtagacgcaccgccaccacctcatcaggctgatcctgttgggtcatttggcatggagcggtatctacagcacttggttcaccagcaggtggccaaccaccgggggcaggtgcagatacatgagtgtctctaccagctcagccttagtcagcagagccagggttttgttccttttgcgtgccctactccatatcagtttagggctaaggtcgcatggcccgaagattggctcgaggcccaggcaggggaggcgcctggagaggctcccgacgatgcagaggaagcccacatggatgaggagatgacgaatttgctcagtttcttgg

SEQ ID NO: 22710 - DNA, 579 bp, Glycine max
  Peptide Sequence Number=SeqID_114395
atggatgccgccagccctgccgatgcaggcatgcaggccgtgctggggctggagcgccataccctgcagccgctgtgtgatgcacacggcgcacatgtggccatcgccaacggccgcgatcacttcatcgtcggcggcacgcaggccgctctgcaggcgctggccgatgacgctcgcgcgcagggtgcggagatccgcccgctgccggtgcatgtgcccgcgcatacgccgctgctccgctctgctgtcgcagcgttcgccgccgcactcgatgcctcggcgctgcagggcccacgcctgccgctgctggccggcatcgatgcgcgtccggtgcgggatcgcgcaacggcggtccacacgctgtcgttgcaactggcgcagaccatcgagtgggcgcaggtgatgcgccaggcctacgagcgcggtgcgcgggtgttcctgcagctgggcccgggcaatgccttggcccgcatggtcgcgtccgattatccgtgctgcgaggtgcgcgcggtggaggaattccagagcctcgacggcgcggcgggctgggtccgcaacgcgctggagcggctgcagtaa

SEQ ID NO: 22711 - DNA, 523 bp, Glycine max
  Peptide Sequence Number=SeqID_114396
atgaaaattgctcttttgcgacaggcgccgttgctgatgctgcctgcactcctgccgctgccgctgctggcggcggacaatgccagcaataccctggtggtgagcgccgcgcccgcggccagtggactctctgagctggataccccggcggcggtcagcgtcgtcagcggcgacgatatgcgccacgccgcaccgcgcgttaacctgtctgaaaacctcaccagcgtaccgggtctgcaaatccagaaccgccagaattatgcgcaggacctgcagatttcagtgcgcggctttggttcgcgttccaccttcggcctgcgcggcattcgcctgtacgttgacggcattccggccagcatgccggatggtcaggggcaaacctcgaatatcgatatcggttcaatcgatcgcgtggaagtgctgcgcggcccgttctccgcgctgtacggcaacgcatcgggcggcgtgatcaatgtggaaacccagcgcggccagcagccgaccacgctggagccagtagctg

SEQ ID NO: 22712 - DNA, 821 bp, Glycine max
  misc_feature (44)..(44): n is a, c, g, or t
  Peptide Sequence Number=SeqID_114397
atggtgaaagttggaacctcttacgtgccgatcaacgtctcatnttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggccatgtttggctcacaaccagcaggcgtggtggcgggagagcgcgagtcgctggaagaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 22713 - DNA, 285 bp, Glycine max
  misc_feature (30)..(30): n is a, c, g, or t
  Peptide Sequence Number=SeqID_114398
atggggatcatcggcggctatcataagtgnctgagagtccggacacaaggattggattggctcccaaatctaaagactgtgagagacaatgaggttaaagcttcggaagaaagtgatgagccttggaatgagaaaccaagaaggcccgaaaggaagaacacgaccaaaacaagttttgaggggctttatagggcagcaatagtgagctcaaactccgaagaggtgaaaggaatcatcacgggtcaaaggcatgatctggaaggacgagctaaaggcttgccttag

SEQ ID NO: 22714 - DNA, 555 bp, Glycine max
  Peptide Sequence Number=SeqID_114399
atgaagcacttcactgacaccctcatcagtgccaacataagattacgcggaactcctggaatggcaatggactggcaagttgcacctgcaagtcctagttcatacacagttaagaggattttgcgcttggaaattccagttgatgcataccccaacacaaatcaattacttgatccgacatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 22715 - DNA, 323 bp, Glycine max
  Peptide Sequence Number=SeqID_114400
cttgtggttacgtgagcctgaactactaccaatatgtagatgttgtttatacaaatgagcacatcttaaaagcttactccacacaatggtggcctcttgggaatgaagcggttattcctccttctaatgacgcatggacatttatccctgacccaactacaattcgtgcgaaaggtcggccaaaatcaacaaggataaggaatgagatggattgggttgaaccatctgagcaccgacaaaaatgcagtagatgtggagccaaagggcataacaggtgtcgctgtccaatgcaatctgagcatggaagttgttcaaatcattga

SEQ ID NO: 22716 - DNA, 248 bp, Glycine max
  Peptide Sequence Number=SeqID_114401
ggctacacgtcctcacctttagaggactacacgtcttcgccttcatagagctgcatgccctcaccttcgtagggctacacgccctcaccttcagagggctacatgccctcgccttcagagggctacacatcctcgccttcagaggactacacgtcctcacctttagagggccacacgcccttgccttcagagggccacacgccttcgccttcagaggactacacgtccttgtggcgtccctaaattaa

SEQ ID NO: 22717 - DNA, 819 bp, Glycine max
  Peptide Sequence Number=SeqID_114402
atgagctttaaaggaagaaggaagaagaagggctatgggcacatgggagtgggaatttgggataatgtgggaatgggttgggaaggtggcaacttgagagagaaaagaacacctaggccggataaaagtagaaattctatactttccagatgtggaaaagtgatatcatgtggaattactaggttaaaggatcatcttgcacgcattccgggagaagttacgggatgtggggatgaacatgatgaagttcaagatttcatggatgaggatgcatatataatacaagctgcacaagagaggataatgtcacacaaacaatgggaggataagcaaagatttagacagcaaacaagaggcaattcatatgcaggagcaaaagcatggaacaacccaaaattaactagggaatcaagaaaaccaaaaaagtttgggaaagcagtgtctaagttgattatatatgaacgactttctatcaacttggcaaattctccaaggctatacaatttgataaatgcagatgcagaattaggtttaggtgttaaagcccctcctccttatgagtttttagaagtgtacttggaggaagaacataaagttatgcagagttggattgaaggacttaaacctacgtgtggtaggaaggggggtgactataatggaaccatgtttttaaaatctattgatgcctttgatgttgccaacagaaacattggttattacttaaatttgattgatcaaattgtagaagaggtgggagaagaatatgttgttgttcaagtggtgactgataatgagaaagtgttaaaagctgctatataa

SEQ ID NO: 22718 - DNA, 333 bp, Glycine max
  Peptide Sequence Number=SeqID_114403
gatctttcgtcatctgttcctacgtctctacccattctcatccatttgcatgtttacttctttatattcaacggcagatctaacgacaagtccctcgaaggtactaatacctgggacccgcctatcgacttcaagcaagaaacgagtcaaacggaggatgaagaaaacgaggatgtgggacttcccccagagttagaaaagatagtcgcccttgaggaacaagaaatggggcctcatcaagaagaaacaaaactagtagacttgggagctggcagtggaaaaagggaagtaaagatagacacgggtattaccgcacctatccgtgaagaatga

SEQ ID NO: 22719 - DNA, 516 bp, Glycine max
  Peptide Sequence Number=SeqID_114404
atggctccgagaaagctttccacgaaaagatctaggagggacgccgcggctgaagggaccagtgccacccccgagtttgatagccactgtttcaggagcgccgagcaccagcagcgttgcaaggccatcaaaggatggtcgttccaccgagagagacgcgtccaactcagggacaatgagtataccgactttcaggaagagatagctcgccggcgctggacgtcgctggtcactctcatggctaagtttgacccagatatagtcctagaattttatgctaatgctttgcccacagaagagggagtgcgggacatgcgatcatgggtaaggggtcagtggatttcctttgatgcagatgccctcagccaattcctgggtgacccgctggtgttagaagaaggccaggagtgtgagtttagtcagagaaggaacatggccgacgggtttgatgaagaggccattgcccatctattatatgtggatgacgttgctgctcagcaatgtcctacccagtga

SEQ ID NO: 22720 - DNA, 240 bp, Glycine max
  Peptide Sequence Number=SeqID_114405
atgactcatctgatggttcggagaaggagatcaaccttctatccaaggactatgaaagtgatgagaacatctctcaagaagtttaaggttgtcatcatcaaaaaggaggagattgtagaaccaagcttcatgatgatgaatcaagtttattcaagaagttttgatgatgacaaagatgatgacaaaaagccgaagagaatgatttcaagattgagtcaacaagttcaagatcaagtttaa

SEQ ID NO: 22721 - DNA, 508 bp, Glycine max
  Peptide Sequence Number=SeqID_114406
atggctgaaaaacgtcatgcaaagtgtcattgcggtgcggtggcattcaccgttgagctctctgatggcctgaacaccgcgcggcgctgcagctgttccttctgtcgaatgcggggcgcggtcgttgtctccgcgccgctgtcggggattacggtgacgaaaggtcaggataagctcaccgagtaccgctttaatacgggaacggcgcgacacttcttctgctcggtatgcgggatttacacgtttcatcagcggcgctccaatcccaatgaatacggcgtgaatgttgcctgtttagaaaacgtttctccctttgatttcccggaggtcacggtgatggacggtgttaaccatcccatggatggggaaagcggggtgtttggctatctctcttttcgtgagaaagggacggacgatccgcgtgaggccccggaatcaggggataaaaagccacaaccctgtgaaaaaataacgcaacagctgcgtttatccgccaccggcactgctg

SEQ ID NO: 22722 - DNA, 255 bp, Glycine max
  Peptide Sequence Number=SeqID_114407
atgcaacactggatgagcggggttgcactgggggagactcgacataagcgcttgatggaagcttgcttgtggggcttctatggaggctggatctttgagcttcaatggggtcctttagtggtgattttccaccatggagatgcagcggaagacaaaggaagaagaggaattaatgaaacattgggcttaatccggattttggttgtggacttgaagagggcaaataaagcagcgcttaccttagttaatttctaa

SEQ ID NO: 22723 - DNA, 291 bp, Glycine max
  Peptide Sequence Number=SeqID_114408
atggaaaggagaatgcagcagatcccttcaccaaggcgcttggcatatgtcgcaacctacccttcgacgggagggcgacgcgtgactcgcgggatgcgtgttccacgaaaggaatacgcgcggagtcgccaccaacgtttatttgaggaaaacgtcgaaaaaaccggaaaagacgcgatctacgaacttttaagtgaaaggttcgggagttgtatttacgcgcggggaagggtgtttccctttgctcctacgtattcctcaatttgggatgagaaaatcagacctacgtag

SEQ ID NO: 22724 - DNA, 219 bp, Glycine max
  Peptide Sequence Number=SeqID_114409
atgggcagttgggtcagatctagtatgggatccgtacatggaccggatcaagctggcccttgcgaacagcttgatgcactatctcccttcaaccctttgagcgaaatgtggcaaaaggaaaaagaatccatggaccgaccccatcgtctccaccccgtaggaactacgagatcaccccaaggacgccttcggcatccaggggtcgcggaccgaccatag

SEQ ID NO: 22725 - DNA, 61 bp, Glycine max
  Peptide Sequence Number=SeqID_114410
atgagtaacagtggtgatcattgtggcttagtcaagctaaattgtgatgaaaactgcagtg

SEQ ID NO: 22726 - DNA, 183 bp, Glycine max
  Peptide Sequence Number=SeqID_114411
atgaccctcaagtgtaaggattttcaagtgcaagccattggtcagtttgctcaagcaacctgcgctcctgagtttggacttccaagaccgttcaatcagagattactcgtcttgcacgttggtggggttgccataaaacaacgagcaaagttcaaaacaaataagtttcaaaataaaaaataa

SEQ ID NO: 22727 - DNA, 888 bp, Glycine max
  Peptide Sequence Number=SeqID_114412
atgaagggccctcttgatgagtcaatctcttgctttctcataagggtggagccttgggtactagtacctattgcctttagaggactacacgtcctcgactttaaaggactagacgtcctcaactttagaggactagatagggatacacgtcctcgcctcaaagggcttcacgtcctcacctttagagggcttcacgtcctcgccttcagaggactgcacgtcctcaccttaagagggcttcacgtccttacctttagaggactgaatgtcattgcctttagagggctacacaccctcgccgtaagagggctgcacgcccttgcctttagaggattgcacgtcctcgcctttagagggcttcacgtcctcacctttagagggctacatgccctcaccgtaagagggttacacgcccttgccttcagaggattgcacatccttgccttcagagggctacacatcctcaccttcagagggctgtacgtccttgccttcagagggctacacgtcctcgccttcagaaggctacacgtcctcacttccgagggctacacgtcctcacttcagagggctccacatccatgccttcagagaactcaagccagaggaggaggcaggtctccggctttgatgaggaggctatcgcacaactactatgcataccagggcaagattttgcccagacctctacagggagacgagtgcggatcatgtgcctctgtcttggggtttccagctctgattacgggcctctgtcagttctacggagtgcccattgcccctaacaaagtcatcaagccccctattaacagggatttcatcaagaagtactgtgcccccaggcaggggcagggcgaggtgttagacaaatggcctcagttatcttaa

SEQ ID NO: 22728 - DNA, 225 bp, Glycine max
  Peptide Sequence Number=SeqID_114413
atggtgaaagttggaacctcttacgtgccgatcaacgtctcattttcgccaaaagttggcccagggcttcccggtatcaacagggacaccaggatttatttattctgcgaagtgatcttccgtcacagctgtccctcctgttcagctactgacggggtggtgcgtaacggcaaaagcaccgccggaccgtatttacagcacaaactgttggatcccgacgagcgt

SEQ ID NO: 22729 - DNA, 279 bp, Glycine max
  Peptide Sequence Number=SeqID_114414
atgcagaggctcccattcctgtacccactgacgagggcagctgtgtctccagcaaaacctccggataggccgaatcgtgaggtcgatgatcccctatatctgatgacattgatcatcccacagcttttcttgaagcctctccaagttatgtgggatgctaccatgtttagggtgtttaatcaagacttctcgttgtacatcaagcacaaagatctctctgaaattgcacatggtggtcaatgtctcagcatatctcttatacagttgtggattttgtaa

SEQ ID NO: 22730 - DNA, 429 bp, Glycine max
  Peptide Sequence Number=SeqID_114415
acatctccggaagacgttgacatctccagaaaaggtacagatgatgatgacggtgacatctccaggataggtgacgacgttagtcactgcaagttatcgtgctttgagtctgacgggtcgcaaatgagacgttttcgaagtctcggctggaagacgcgtacatcacccggaatggtcgcaaatgagactttttcgcagtatcggctagaagacgctgacatctccgggaaaggtgcaaatgacgactctcggccggaagacgttgacatctctagaaaagatgctgacatctccgggaaaggtgcacgtgacgacattagtcactgcatgctatcaggctttcagtctgaccgaacgcaaatgagactttttgatatgaaccctcatggcacaagggctgacttaggatcgtctaggattaaaccttga

SEQ ID NO: 22731 - DNA, 177 bp, Glycine max
  Peptide Sequence Number=SeqID_114416
atgtggaaattcttcatcgttcttcaccgttctgtagaagcaaagcttcatgatgatgacaaaggtgatgacaaaaagctcaaagatcaatcaaagaacaactcaagtgaatcaaaaacaattcaagagttcaagataagaatcaagaagaattcaagactcaagaagaaagtttag

SEQ ID NO: 22732 - DNA, 174 bp, Glycine max
  Peptide Sequence Number=SeqID_114417
atgacagctgatttattagaagatatgaattttgaatctccacaagcatctgattctaattctttctttgacgatgaaaattgtgaatccaatactaatgaagctgcaatcgatactaaaggtaatagttatacctttgatataacgttaaggatatcaactgatatcctttaa

SEQ ID NO: 22733 - DNA, 489 bp, Glycine max
  Peptide Sequence Number=SeqID_114418
gctacgattactcttcaagatgtgtcagtcttgttaggtcttcatactgagggggcaccattaattggtcagactaatcttgattgggctaaattgtgtgaagaattattgggagtcagaccacaggaaggaggagttctatttgttgataaaagcagcagtaaagtttccctaagagagatgtgtagcgccaccgattacaaaataaaatcaatcggaggtatgtgcatcttaatccaaatgtgggcatgggaacgctgcacgactttggctccaaagagaactcctcctataatagaaaacaaaccactcggacacaggtggctgcgacgtggaaaccaacatattggcaatgatgatctaatagttttccgtcgcaaattggatatcatgaaacgacatgagtttctgtgggagccttacacaacaactgttatgtcgatgttgcctcccatttgtttggttggcagtatggcgtggtgcgcagtg

SEQ ID NO: 22734 - DNA, 207 bp, Glycine max
  Peptide Sequence Number=SeqID_114419
atgaaacaaaaagaaaaagaaaaaaagacctcgaagagaccccccaccttaaggtgctttgagccgtggttcacggaaggcgtcgttgctgtggctctaggagaaatcacgcttgtggaaggtgctgagtatgttgaggacaagattactgatgccgtggcagagagggttgaggatgatcttggttatgatgaagatgatttctag

SEQ ID NO: 22735 - DNA, 653 bp, Glycine max
  Peptide Sequence Number=SeqID_114420
gtttagattggctcgccaagttaaaagtcgtcagcaaagagagttttgaagcaccggaagaggacgaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagggctcgcaaggaagagtatggccggaacaaatttcgcggggctctatggggtagcaatagtgaactcaagttgcgaagggaagaaagagaccagtcgcgaacacatagcatgaccaacatgctagctatcatcgctaagtaccaagaagagttaggtctagccgcggcccacgagcataggattgcggacgaatatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaagcgatgacagacacctactccacccccgaagagattcacgggcttctcggctattgtcagcatatgatagacttaatggcccacataattagaaatcgttag

SEQ ID NO: 22736 - DNA, 156 bp, Glycine max
  Peptide Sequence Number=SeqID_114421
atgctctctcatcagcgttctccaacaacgacggtcgttccaagacccgtctttataccttccttcaacaatgacgggtgtgcatttctgaaacaacgtcgggcccaaatgacacccgacgttgaaatcgatccgaacaacaacggtgctccttaa

SEQ ID NO: 22737 - DNA, 282 bp, Glycine max
  Peptide Sequence Number=SeqID_114422
ggaaagggaagaatcaaaagaattctcagactgtgtcgttttgaattctttgacaagggagaagggagacacaaaagaattcaggcggttagtcctttgttcttttggaaaagggagaagagagacacaaaaagaattcagacggttagtccttggcgaattctttttggcagaggtgaagagaatgaaaagatgaataacacaagttttcaaggtttggaaaaccagaaagattttggtacaaagaagaagaagaagttcaaagagattcaaggcttgtaa

SEQ ID NO: 22738 - DNA, 825 bp, Glycine max
  Peptide Sequence Number=SeqID_114423
atgatcgatacgcagattctgcccgctttcgccgggcagccgctgtcgtggggctttgccgcgatggtcaatcatttcaaccagattgagctggataagagcgaagcgcgcaccgactggctggcgcgtccgcttaccgagcggcaatgccagtacgctgcggccgatgtggcttatctgctgccgatcgcccatcagctggtggcgcaaaccgaagcggcaggcaacatggcggcggcgctgagtgaatgcgctacgctgtgtcagcgccgtcttgacgtactgcagccggaagaggcgtggagcgatatcaccaatgcgtggcagctgcgtccgcgccagctggcggtgctgcagcgtctggccgcgtggcgtctcaacctcgcccggcagaaagacatggcggtgaattttgtggtgcgcgaagagaacctgtggaaagtcgcgcgctttatgcccggcagccttggcgagctggatcatctcggcctgaacggtcacgaaatccgcttccacggtaaggcgctggtggcgatggtggcagaagcgcaggcgctggatgaggccgcgttaccgccgccgttgcctaatctgattgaccacgcgcattacaagcaggcgtttaaagcgattaaagcgctggtacagcaggtgagtgagcagaccggttacagtcaggagctgttagcatcacggcgccagattaaccaggtgctgagcgtgcactggggactgaagagcgccacgcgtccgccggaactgctggcaggctggcggggtgaggtgttgaaagccggtatcgacgagattttacacacgctgtaa

SEQ ID NO: 22739 - DNA, 809 bp, Glycine max
  Peptide Sequence Number=SeqID_114424
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcggatcgatagataacgatctcgtccttcgccacatccacaccgacgaccacctgcgaatccaggattgtcatggcacaccctccgagctagggtttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 22740 - DNA, 345 bp, Glycine max
  Peptide Sequence Number=SeqID_114425
atgtcgctgcatgttctctatctttatgcgttttctagattttcccccagggatttcctgtctgttgtatctctcgttacaatctttcaaagaaatgaacgtggattcgaggcttttagtcctcacgggcaggatcgccttgggctaccttttggagtgaagacaaaacatgaacggcagaaaccagtcaaggtgcttaaggatgaacgcaagcggggatggggtcacgaccgaccgatcgttacccttctctgtgcgaaacaagcagggaatgtcgctgcaaggcagccccgtatcctttgtattttgcagctttcttttactatttgtttgggaaaagagtaa

SEQ ID NO: 22741 - DNA, 561 bp, Glycine max
  Peptide Sequence Number=SeqID_114426
atggctccgagaaagctttccgcaaagagatctaggaaggacgccgcggctaaagggaccagtgccgctcccgagtttgatagccaccttttcaggagcgccaagcaccagcagcgcttcgaggccatcaaaggatggtcgttccacagagagagatgcgtccagctccgggatgatgagtacacagacttccaggaagagttagctcgctggaagtggacgtcactggtcacccccatggctaagtttgacccagacatagtcctggaattttatgccaatgcttggcccacggaggagggcgtgcgggacatgcggtcatggggccagaagtgcgagtatagccagagaaggaaccgggctgatgggtttgatgagaaggccattgcccagttgttgtgcataccgggtcaggattttgcccgggccgctgccgggagacgggtgcggatcatgcgcaccagcatgactaccttgacccagacgtggatgacgttgctgctcagcaacatcctgcccagcgatcataattccgacctccctctgctgaagtgtcagctg

SEQ ID NO: 22742 - DNA, 429 bp, Glycine max
  Peptide Sequence Number=SeqID_114427
ttcctcgcgccgcatgaagctgaccaccagctggatgatgaagcaggcgatgcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 22743 - DNA, 667 bp, Glycine max
  Peptide Sequence Number=SeqID_114428
aggactacacctcctcgccttcagaggactacacctcctcgccttcagagggctacacgtcctcgcctttagaggactacatgtcctcgccttcagagggctatacgtcctccccgtcagaggactacacatcctcgcctttagaggactacacatcctcaccttcaaaggactatacatcctcgccttcaaaggactacacaccctcgccttcagagggctacacgtcctcgcctttagaggactacacatcctcgcctttagagggctacaagtccttgcctttagaggattgcacgtcctcaccttcaaagggctacatgccctgccttcagaggactacatgtcctcaccttcaaaggactcgacatcctcaccttcagagggctacacgctcctcccattcagaggactacacgtcctcgccttcagaggactacacgttctcaccttcagagggctacacaccctcgccttcagagaaatacatgcctcgccttcagaggactacacatcctcaccatcagagaaccacacgtcctcaccatcagagtgttgcatgcccttgccttcagaggactacacgtcctcaccttcagaggactacacgtcctcgaccttcagaggaccacacgtccctcaccaggggactatacgtcctccctag

SEQ ID NO: 22744 - DNA, 452 bp, Glycine max
  Peptide Sequence Number=SeqID_114429
atgccacccaccaggcaccctctagacccgaataagtctaacagggccctagggtttccggcattgatcacgggcctctgccagtcgttcgggggtgatgcacatcaggccgtagacacacctccgccacctcgacaggtcgaccctgctggatcactaggcatggagcgttatctacaacacttggttcgccagcaggcggccaaccaccatgggcaggtgcagatacatgagtgtctctaccagttcagcctcagtcagcaggggcagggttctgctccttttgcatgccctactccggagcagtttgaggctgaggtcacatggcccggagactggcccgaagcccaggcaggggaggagcctgcaggatcccccgatggggcagaggaggcccgtatggatgaagatatgactgacttgctcggtttcttaagaggaagcgaagccac

SEQ ID NO: 22745 - DNA, 282 bp, Glycine max
  Peptide Sequence Number=SeqID_114430
atgtcagtgaaaaacctcgtcgggcgcctagaagtacatgacaaaatggaccacacaccagaagtcaggtcactctcactaggtaaaatcatagggaaaccagtcaatgtcacgctgttttgcgagaatgtttctaccatgtacgatcgacacaagcttaaaagagcactcaaacatggtgtatttaccccaaggcctagactccgaagagtctgtcagggtctctccctcttgattcaggtccaacccagaaaatatttaacacgtagactctatctatga

SEQ ID NO: 22746 - DNA, 159 bp, Glycine max
  Peptide Sequence Number=SeqID_114431
atggctgcttcggtgcaaaacaacccaatagacgtgaaaaagaaatctcacgaagacagtaaaaatggaggtttcaatcccttctccgtctctctgacgtttgagaactctatcggaacagtcggaggaaaaactggaggaatctcaagaaaccgctag

SEQ ID NO: 22747 - DNA, 2394 bp, Glycine max
  Peptide Sequence Number=SeqID_114432
atggagctcaaactccacacatcaatgacttccattccacgtgcaatcttcacccattcctcttcctccattcctttttgtacctatgcggttctcgatgctagcagtgtgaagaatgcatgccgagtgtttgatcaaatgtcggacaaaaacattgcttcatggcatttgatgcttggtgggtacacgagtaatggtttaaggtgtgatggtttattggttttccagcagatgaagcaatcaggggcaagtggaggaggattggttggtgtcgaagggggagtggtggtgaatggaaccgcaatcacagaggaggtggtagaagttattgatgaggtggcagtgacacgtgtaatcctacttaggcaacgagtacacatggcacctcacatgacatacctacatggcccgttaatagtcacgaatgatgttgagctacttcaagaaatcatcaatcttgtgttgatgacgttgagaaagcatacagtagattcaaaagggctggttggcattgacaaacaagttgcacatttagaatctttgttaaaacaagagtcaaaagatgtctgtgttatcggaatttggggagtgggcggtaatgagcagcttgaagaattatttggaactccagattggtatgggtcaggtagtagaattattataacaactagagatataaaagttcttatagccaacaaagttcctgaaatataccatgttggtggattgagttcctgtgaagcatttcagcttttcaagttgaatgcctttaaccaaggtgatcttgaaatggagttttacgagctatcaaagagggtggttgattatgccaagggcattccattagttcttaaaatattggctcatcttctttgtggaaaagataaggaggtatggaaaagtcaactagaaaagcttaaaggaatcaagagtaacaatgttcatgattttgtgaaacttagttttgacgatctacaccatgaagaacaagagattcttttagatcttgcatgtttctgccgtagagcaaatatgatagagaattttaatatgaaagtggattctataaacatattattgggtgattgtggaagtcataatgcagtggttgttgggttagaaaggctgaaagaaaaatctcttataactatttctgaagataatgttgtatctatgcttgatactatacaagaaatggcatgggagattgtttgccaagaatctaatgaccttggaaatcgcagtcgattatgggatcctattgagatctatgatgttttgaaaaatgacaaggggactaaggcaattagaagcataacaacacctttgtcaacattgaagaatctgaagttacgtcctgatgcatttgttaggatgagcaatctacaatttttggattttggtaataattctccttctcttccacaagggcttcaatctttgccaaatgagttaagatatcttcattggatacattaccctttgacatgcttgccagagcaattttctgctgagaagcttgttatattagacttgtcatgtagcagagtggaaaaattatggcatgaagtgaaaaatctggtgaatttaaagaatgttaaactccgttggtgtgtattgctgaatgagcttccagacttctcaaaatccacaaatctcaaggtactggatgttagttgttccagtgggttgactagtgtgcatccatctattttctctctacacaagcttgagaaattggaccttagtggatgcagttccctcatcaaattttcaagtgatgatgatggtcatttaagctccctactttatctcaacctcagtgactgtgaagaactaagggaattctcagtgacagccgagaatgtggttgaactagatttaaccggcattctcatcagttcattgcccttgtcttttggaagtctacgaaagttagaaatgctacatctaatacgtagtgacattgaaagcttgccaacatgcatcaataatcttacaagactgcgatatcttgacttgagttgttgcagcaatctctgcattctaccgaagcttcccccatcccttgaaactctacatgctgatgagtgtgaatcactggagactgtattgttcccttccacggcagttgaacaatttgaggaaaacaggaaacgagttgagttttggaattgcttaaagttggatgaattttctctgatggctattgagttaaatgcgcaaatcaatgtaatgaaatttgcataccaacatttatcagcaccaatacttgatcatgtggaaaattacaatgattacaaggatctcatgattcttatcaagcagtgtacatgtatccaggaagcagtgttccagagtggttggcatataagactagaaaggattatgtaa

SEQ ID NO: 22748 - DNA, 543 bp, Glycine max
  Peptide Sequence Number=SeqID_114433
atgggtagagcctccatctaccaagatgaccactgggtggcggcacaccgtaccgaggagaggaaacgtttggggggctggagtgccctccatcgcattcaagctgatgtgtggggtaataggaagatccagcccgggggaggtggtgtcgttgttgggggtgaggtccgcagggggttccggttcgtcgtcggcaatgaaaaggtgctaacggggtttgcagcggtggccgtgggaccacttttcttcatagtggtagcagagtccctgctcgcggcggaccgtgagttcctagaaggggaaaaggaagtgggaagggaacgctggccgcggcggcgatcaagcagtttatcttcctggagacgcgcgagttctgtcgcatggggaagggacattggccgtaatgcttggacctcccggcggagctccggaatcaaacctgagacaaaacaactcagcaggcaggacgggggaaggcccaaagtgcgattggccaggcgctcgaattccgtgaggtactcgctgacactgtcggtttgctga

SEQ ID NO: 22749 - DNA, 318 bp, Glycine max
  Peptide Sequence Number=SeqID_114434
atgacattgctacttagcaacattctgcccagagaccgcaatgccaatctccccctgcaaaagtatcagttggtctgtgtcgtcccgacgtggggatcgcacccacaagacacccagtggacccggaaagtccacaggccctggggtttcagctctggttacgggcctctatcagtcctacagggtgccgtaccccccggcaaggcaatagacgcaccgccaccacctttagagttcacctctgctcatccacaaaaaggtttgagtattgcctacgacacatggccgaccattaggcaaccaagtccaaagccaaag

SEQ ID NO: 22750 - DNA, 477 bp, Glycine max
  Peptide Sequence Number=SeqID_114435
atggaacatccgatggaaaacggtggcctgatgtcctacctcgtccttgcccgcaagtggcgtccgaagcgttttgccgagctggtgggccaggaacacgtggtccgtgcgctcagcaacgcgctggacagcggccgggtccaccacgcgttcctgttcaccggcacccgcggcgtgggcaagaccaccatcgcgcgcatcttcgccaagtcgctgaactgcgagcagggcaccagcgccgacccgtgcggccagtgcgcggcctgcctggacatcgacgccggccgctacatcgacctgctggaaatcgacgccgcgtccaacaccggtgtggatgacgtgcgtgaggtgatcgagaacgcgcagtacatgccctcgcgtggcaagtacaaggtctacctgatcgacgaagtgcacatgctgtccaaggcggcgttcaacgcgctgctgaagacgctggaagaaccgccggagcac

SEQ ID NO: 22751 - DNA, 900 bp, Glycine max
  Peptide Sequence Number=SeqID_114436
gagatcagcagcatctgcgggcggaagtcgtcgatggtcggcagcatctcgtcggcccagacgttgcggaagccgaagccgccgctgcccggcggcagcaggatgttcatcatgctgccggcaccgcggtcgcggcgcatgccggaattgggaaacagcccggcctggtgggtgctgtagtacgacacccgggcatcctgctggaagatgtcctgggtgccattgccgtggtgcacgtcgaaatcgaccaccgcgatccgctccaggccatggcggtcgcgggcatacgcggcggcgatggcgatgttgttcaacaggcagaagcccatcaccgtgctgctggtggcgtggtggcccggcgggcgcaccgcgcagaaggccagcgggtcctcgcccagcatcaccgcatcgactgcggccacaccggcaccggcggcgtgcacggcggcgctggccgagccgggcgaggtccaagtgtccatgtccagctggcgcaacggcgcggtctgcggctgcagcacgaagtcgagcagggcgctgtcgtggacccgggtcagttcgccgaacttggccggcggcgcttcgcgccactccagctggccggggaaggccgcgtgcagcgcgtccagcacatgctgcaggcgttgcgggcattcgggatggccgggaccggggtcatgcagcaggcaggacgggtgggtatagaccagcatcgtgccgactcagcgctggcgctgctgcggttgccacagcgcttcgccctggccatcggcgcgggccagcacccgggccagcacgaacagcaggtccgacagccggttgaggtactgcagcgcctcactgcgcacggcttcgtggcgggccagggtgaccgtttcgcgctcggcgcggcggacgatg

SEQ ID NO: 22752 - DNA, 201 bp, Glycine max
  Peptide Sequence Number=SeqID_114437
atgggatcaagtcaaacgccttcgcttaaaaagaggttctatcaagtcaagctccagcggcaagcttttcgcaaagcttacggtaaaatctgggacctagccatggtagaagtctccacagaggccattgcctccctcgcccagtattatgatcagccgttgagatgcttcacctttggggacttccagctatcacccatg

SEQ ID NO: 22753 - DNA, 498 bp, Glycine max
  Peptide Sequence Number=SeqID_114438
atgcagtcccagtttcaatcacagatgcaatcacagggactcgcactgcctcctcagcctgaggttggtccttcagctgctcgtgtcagcacaaaggagacttgtgttgatccctcagggaacgatctagacacgggtgactcagacagatgcaggttgtatatcgaagaaaatcctccccacttagttgccctaggaagactttatgagggatccataaccgttcacaacattcctttgctgcatgatcaagtcaaggttggtgttgaggaggttagagatgcaaatgcttccattcctgtacccattgaagaggttaagttagtgaggcaaacacttaacaccttccttgcttggccgacacatcttgtcaagcgtttatcagaacagggagctgtgggactggtgaaacctgcagatatgctagatcatgatgtcgatgatcccctatatccgatgacattgaccatcccacaactttttctgaagccgttgtag

SEQ ID NO: 22754 - DNA, 610 bp, Glycine max
  Peptide Sequence Number=SeqID_114439
atgtcgactctgaaagaacaaatggcttccatgatggaggccatgttaaggatgaggcaaatcatggagaaaaacgtggccaccgctgccgccgttagttcggctgccgaagcagacccaactctcctagctaccgcgcaccatcctcccccaaatacaataggacgaggaaggagcacactggggcacaacagcaacccccatttgggatacaaccgggtggcttacccttatggattgccacctaattacacgccgccagtcatgcaagatgatgcgggtcatgtctcttcccccatccttgaaggggagcctcctcaacagccccacgaggcccatgaagatcatcaagagcatgcccaaggggatgttgatttctatcccccgatccccgttgaggggccgacaaccaacacattgcctcagcacaacctcacagcacagccagtattcttgtccacggaaggaccacccccggcggccgaagaaagaaggaaactcgatctcctcgaggagagattgagggctgttgaaggctttggtgactatccattcgcggacatgacggatctttgcttggtatcagatgttgttatccccccaaattcag

SEQ ID NO: 22755 - DNA, 405 bp, Glycine max
  Peptide Sequence Number=SeqID_114440
atggcaccgaggaagctctccgcaaagagatctaggagggacgccgaggccgaaggaaccagcgccgctcctgagtttgacagccatcgtttcaggagtgtagagcatcagcagggttttgaggccatcaaaggatggtcgttccatcgagagagacgcgtccagctcagggatgatgagtacacagattttcaggaagagatagctcgccggcgttggacgtcgctggtcactcccatggctaagtttgacccagatatagtcctagagttttacgctaatgcttggcccacggaggagggtgcacgggacatgcaatcatgggtaaggggccagtggattccttttgatgcaaacgccctcagccagttcatgggtgacccgctagtgttagaggagggctag

SEQ ID NO: 22756 - DNA, 447 bp, Glycine max
  Peptide Sequence Number=SeqID_114441
atgtctacatcacagggaatcaggaagaagatgcaagagatccaaaaatacaatgactgcccccatgtactttctcgtggggggtatgatttgcttgaaaagaagatgatggaggagaagatgaacaaaagacaacatgacgcaatgacaactgagaatacaccaaactctgcggatcccccatctcccattcaaagacatgcctcattggaagaacaaacgagacagggtacctttgtcccccatggtcgtgaagacatactgaacactgccatcgggcgaccggatcatggaggccgtgttcgggcagcggggtttggggtcacaataagtcaatactttggaagggcagcacgtggctccagttgttcatcagggtcgatcagccaagtacaaatggctgaaataattggaggcctacaggaacagtggaaaaatgaaatacag

SEQ ID NO: 22757 - DNA, 660 bp, Glycine max
  Peptide Sequence Number=SeqID_114442
atggctaagaattcatacacgagggaaaacttcgaagctctggaagaggatgaagaagtccaagctctaaaatcagagctaggacaggcaagactcgccaaagaaaaattcaagttagtcactacagacatcgggaaagagtgcaccgaattacaagaaggaaatgcagctaccgcaagagcccttgaacaagaaaccaagagggttcgcaaggaagagcatggccgagacaaattctgtggagctttgtggggcagcaacaatgagctcaagcttcgcaggaaagagagggaccaatcacgagtacatagcatggtcttaaaggaagagttagctgtttgctcaagatccaagaggagtttggcccaacacatagaagccactgagcaaagcatgctagctataataaggcagtacaaagaggagctaaaccaatctttggctcatgagcaaaagctagtagaggacttcgcacaagcatacgccgagaaggaggcaagagggagggtgattgatgcattgcatcaagaagcgaccatgtggatggataggttcgccttgagcaaaggccatggccgaagtgtgttcagccccagaggaaattcacgggctaatcaattattgtcaacacatgatagatttaatggcccatataattag

SEQ ID NO: 22758 - DNA, 204 bp, Glycine max
  Peptide Sequence Number=SeqID_114443
atgattatgaggggccaagacatttatagtagtcaagatgaggctactacttcaccttcctctagtgaaagtgaagaagcaaaatgggaagaatctagttttgagggaaggagcccagagtatgaagaacctcgggatttgaggtcaaatcctttccatggtgaagggactgatgcaatcctaccattcaagggcattgggtag

SEQ ID NO: 22759 - DNA, 393 bp, Glycine max
  Peptide Sequence Number=SeqID_114444
atgacacgcagagacaaaatttggtcattctacacccttgtgtcatccagaggcggcgggcccgatgggcccgatgacacgcggagataccttacggttatccgcaccctttgtcatccagaggcggcgggcccgatgacacgcagagacaaaatttggtcattctgcacccttgtgtcatccagaggcggcgggcccgatgacacgcggagataccttacggttatccgcacccttgtgtcatccagaggcggcgggcccgatgacacgcggagataccttacggttatccgcatccttttgtcatccagaggcggtgggcccgatgacacgcagagacaaaatttggtcattctgcacccttgtgtcatccagaggcggcggacccgatga

SEQ ID NO: 22760 - DNA, 444 bp, Glycine max
  Peptide Sequence Number=SeqID_114445
atgaggtccttcaatggtgattttccaccatggagatgcagcggaagacaaaggagaagaggtgagaggaggtgccacccaatagggaaggaggagattcaccaccaagaatgtgtcttggataagaagcttggagaggatgcttcaatggaggaaaagaaagagacagagaaagagaaagggaagagcacgaaattgaaggaggaagcttcaatgaggtccttcaatggtgattttccaccatggagatgcagcggaagacaaaggagaagaggtgagaggaggtgccacccaatagggaaggaggagattcaccaccaagaatgtgtcttggataagaagcttggagaggatgcttcaatggaggaaaagaaagagacagagaaagagaaagggaagagcacgaaattgaaggaggaaagggggagagaatttgaactttga

SEQ ID NO: 22761 - DNA, 477 bp, Glycine max
  Peptide Sequence Number=SeqID_114446
atgcaatcacagggactcgcactgtctcctaagcctgaagttggtccttcagctgctcatatcaacacaaaggagagttgtgttgatccctcagggaatgacccagacacaggtgacttagagaaatgcaggttatacatcgaagaaaatcctccccgcctggttgccctaggaagactttatgagtggtcgacaaccattcataacatccctttgcgcaatgatcaagtcaaggaagttgtgggatcagaaaaacttgcagataacctggatcatgatgttgatgttcccctatatctgatgacattgaccatcccacaactttttctagagccgttgcaggttatgtgggatgctaccatgtttggggtgtttaatgacaactttcccttgtacataaagcatgaagatctgtctgaaatagcacacggtggtcaatgtctcaacatctctgttatacaattgtggattctgtaa

SEQ ID NO: 22762 - DNA, 375 bp, Glycine max
  Peptide Sequence Number=SeqID_114447
atgcacggccgcgacagaaaaggggcggtggcctcgttaacgtcggtcgccaagctgccgttcacctatgctaaagacgggatctcctacaccttctccatcgtgccgcaggcgctgggcaaggacgagctggtgcgcaaaaccaacctggtggggctgctggaggggtacttccatcacgaagcgtccattgagggcgggcagcatctgaacgtcaacgtcatgaaccgggaaatgctcctcgatgccattgcgcatcccgagaattacccgaacctgacgatccgcgtttcaggctatgcggtgcgttttaacgcactgacgcgcgagcagcagcaggatgtgatttcgaggacgtttacgcaatctatctga

SEQ ID NO: 22763 - DNA, 114 bp, Glycine max
  Peptide Sequence Number=SeqID_114448
atggggaaggttcctccagaaggctattgcttctggaggaagcaacctggctcgcctgggcgagctgggcgggaggcatctcccctattttgctatagagaggggaggaagtga

SEQ ID NO: 22764 - DNA, 201 bp, Glycine max
  Peptide Sequence Number=SeqID_114449
atgtgggatactctccagttaacccatgaaggaaccacagatgaacacgagatggaacttcaacgcctcaatcagaatgaagaaaatgacaaaaagaagagaagcatagcccttaaagcctcatcttcaatacaagatgaaaacgaagaaggagattcagatgatgaagaagatttttccttctttgttaagaaattttag

SEQ ID NO: 22765 - DNA, 325 bp, Glycine max
  Peptide Sequence Number=SeqID_114450
atggaagagggatatgaggctgtgccatctgccccatctgatttgttagactctgaatggaggctcttgtctcttgctgaaattgcatattatggatggtcatttgcctcactaactcttctaaggaaggttgaggaggagcctcagttgctggttgtctttgttgtgactactgctactgttgctgcattggaggaggaacatatggcttgcttggaccaacaacattctggagaggagggacatgctgttgttgttgtggaggacttatccatctcagatttggatgattcctacaacctggattgtatctattgcttgaaag

SEQ ID NO: 22766 - DNA, 204 bp, Glycine max
  Peptide Sequence Number=SeqID_114451
atggctgtcatattcgggagcggaactggggttgctcgcccaggcaagctcagctcgcccaagcgagctaacctgccattttttttaggggaaacattaaccatgcctcccccccttacagcgacgttctctgcttgcccagcaccgggaagggacgacgatcggtcggtcgtgaccctatcctctatttgcatccgtccctaa

SEQ ID NO: 22767 - DNA, 767 bp, Glycine max
  misc_feature (44)..(44): n is a, c, g, or t
  Peptide Sequence Number=SeqID_114452
atggtgaaagttggaacctcttacgtgccgatcaacgtctcatnttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggcttcgcatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 22768 - DNA, 339 bp, Glycine max
  Peptide Sequence Number=SeqID_114453
atggacttggttcaaagtgacagggatgatcctagcctaccactgtggagggatctaaagataatttttcagaatacacaacagggtgagaagatcaaaaaagggatctcatggaaggtggggagaggggacaggttcaaattctgggaagatgagtggatacaaggtgaggtctcattaatcacaaagtatcccaggctgtttgtaatctctcaacagcagaacaactcaatccagcagatgggaggcttcaaggataatgaatgggagtggaacttgtcatggaggaggccattgtttcataatgaacaacggcagaacaactctattttagtctga

SEQ ID NO: 22769 - DNA, 428 bp, Glycine max
  Peptide Sequence Number=SeqID_114454
atgagggttcatatcacctttagagggctacacatcctcattttcattcctgggccaccccctaatattggagggcgaccaactgtgcgagcacatccagagagggaggctatcatgcatctactatgcataccggggcaagatttcacccgtgccgctgcaaagagacgaggatcgcacccacaaagacacccagtggacctgaagaagtccaacagggccctggggtttccagctctagttacgggcctctgtcggccctacagggcacccgttccccccaacaagttcatgtcgtcgtggcatagggattgtgcccgcaagacacctagtggaccctgtcgcaacctacccttcggcgggagggcgaagcgtgactcgcgggatgcgtgttccacgaaaggaatacgcgcggagtcgccaccaac

SEQ ID NO: 22770 - DNA, 285 bp, Glycine max
  Peptide Sequence Number=SeqID_114455
atgtcaaatcataaaagcaccgggtcagcattgaagaaccttgaggtccaggtgggacaattggccaggcagatagctgacaagtcatccaacagttttgtggcaaatacagaaaagaatcccagggaggaatgcaaagctgtgatgacaaggagtaaaaggtttgtggaggctaaggatgaagaaagtattgtgcataagaagaaagctgttgaaaagaaaggtactgagggcaagagaaaggatgttagaggtgaaagcatcaagaaaaagagaaacaaataa

SEQ ID NO: 22771 - DNA, 791 bp, Glycine max
  Peptide Sequence Number=SeqID_114456
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggcgcttggtgctgctacagcactgctgcccggagagggactggcacagagggactggcacacggggactggcacagggggactggcacagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 22772 - DNA, 319 bp, Glycine max
  Peptide Sequence Number=SeqID_114457
gttgttgttcctcgatttaagttacaatgcttatgaaggtgaaactttgaattttcaaagtggagggtttcagaaactaaagcgactgctactcggatatttggatcaattgaagtgcatccttatcgacagaggagcactgtgttctttggaagtattttctttacgagacctctcccaactcaaaacagtaccctctggaattcaacacttggagaagcttaaagatctctatatcgagttcatgccaactaaatttgagcagtgcattgctcctgatggaggagaagaccactggatcatccaagatgtgccccat

SEQ ID NO: 22773 - DNA, 1131 bp, Glycine max
  Peptide Sequence Number=SeqID_114458
atgggattaataatcccacaagattatgctgaagaagttgcgaatcgctcgatcgaaggccagagagcacttcgattaacacccaagaccttagatcaaaacccacgaaagctgttcctaaagtacatgaggatttttctgagctttgacaagtttcttccccaacatgctccattcattagtcgagaggttggcccggcctggttcactgactattttcctgctgtcgatccggacaatgaagaagaagtgaacgaaatatggtcattttacttgaatccacagatcctgtcttgtcgtacaggtgttcaatcgaactatttaggcctggttggataccagcctaatttggtttcaagacaatttggcctctcgcaaatccgtcctaaaagcttgttcgaagatcctcgagacgttataagaggggccaatctttcggaaaagactttcaagaagtttttgaagatttctcttgatgaaaactataacctgcatccttttgagttcaaccattcccacttttgcaccatggggtttgttacctggtgggagaaatattattcgacccgttcagttggagacactactatcatgatctccagacttgagagtggttttacacaaccaacggtcgagaatatccgctcaaaccttcaagctcgaggcaaaacaatcatgacgaagaaaagtgctgaaacgtctcgaactgatgtgagacccaagaaacccactggggtgaagatccaagaagggaaacaagaagagaaggaagaggaggaaagaccactcataagaaaaagaaaatttccttcgacttcgaccaagtctactgaacaaacagaggcaggcaattcccaggctcaaatgcctaagaagaaaaagaaggtaaagcaggtcgagcctgaacctcctgtggctgtcgagggtggtgagtcaattaagaagaaaaagaaaaagaccaagtcctcaaaagaacaaggtaataatcaacctgttgacgtccaaccaccttcgaccaacattgatggcactgaagtagaggctactccttctattgctgagatgggcaaccctgtcgatcgaccgaactcaccccgagaacaatctgtcgtcgaggtatcatcctcttaa

SEQ ID NO: 22774 - DNA, 279 bp, Glycine max
  Peptide Sequence Number=SeqID_114459
atgtcatggtttctcttgtatagtatgcttccgctcatgaagaagccggccgccaatctcctcaatgtccttttgacgttgtcagaagcctctggtaggtactatttgctttcaacgtatcgcttgatatcgaaataccaaggcttaccgtcccgttcctcttccaccaaacaaaaatgtgcgggtctgccacgacacctgaactcaatgtacggtaggtccacgtgcggtgttagctggaacatggatgctaaagtggcaagcacatctgccatttga

SEQ ID NO: 22775 - DNA, 261 bp, Glycine max
  Peptide Sequence Number=SeqID_114460
atggagagggagatgataacaatgatagtagacacgttactggtgttctactatgagaagatggtgggttacatgccttcaagctttgctgatttagtgtttgctggcgaaaggatcagagtgggtctgataagaggcaaatttaattatcctgctttgatgaataggaagacaggggcaaatggagagaataagaaggagggaggaacccatgatgtgactgtcgttcctacatggccaaatttcccaccagctaaataa

SEQ ID NO: 22776 - DNA, 459 bp, Glycine max
  Peptide Sequence Number=SeqID_114461
atgagcccatcaaggaatatgctcaaagatacgctgcctacgttatactacgagaagctgataggatatatgtcggtcaactttgcagaccttatcttcgccggagaaagaatcgagtccggattgaggaaaggcaagtttgaatacgcctccaacgctggccccaacagcaatagaagagccctagtggtgggcacacggaaaaaggaaggggatacccacgcggtcaccaccgccccaacgtggatgaaaacgccccaaaatgccaaaaacttataccaacacaaccacccgaacttctggatccgagccgaaagttccctcctaactcaagtagaagggcctgccacgacagaaaaagcgcatgcacaacacgcggctccatccacaccccggccagccaataatacgactcctagcacgagctatgacaatcaacgacaccccccgagagactag

SEQ ID NO: 22777 - DNA, 661 bp, Glycine max
  Peptide Sequence Number=SeqID_114462
caaagaaggagcctctgtcaacaagttcccccgatggaaagaaggaagaaccggggctcttatttcgtgcggaggatttccaaatgttcccttgatggggacaaagggttgcatcagttacaatcccgtccgcaaggcatgggagatggtgcaaaagaaggacaaggaactcagaggcagtaacaacgggcccatcagcggctaccgtaggtggttgaaagcccacatgcaaagtctggattggctcctgagtttgagaaccactaaaggggtggaagtcgaagcaccggaggaagacgaagaggtacaggcccttagggcagaactcgagaaagcccaaacagtcaaagaaaggttcaaatcagtagctcttaagatccgaaaggagaatgccaaactgagagacggcagtaacaatgagcttaagcttcggagagaggaaagggaccaatcacgagtagacagtttactcttgaaggatgagttgaaggtttgcctaaggtcaaagagaaacttgtcccagcgtttatgcgagacagagaccaacatgttagccatcatcagcaagtaccaagaagaattaaatctagccacggcccacaaacacaaagtggcagacgagtatgcccgagtgtatgcggaaaaagaggctagaggaagg

SEQ ID NO: 22778 - DNA, 257 bp, Glycine max
  Peptide Sequence Number=SeqID_114463
atgaaggaaggcataggtcacatcttagacctcactcccataggagagaaaaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 22779 - DNA, 648 bp, Glycine max
  Peptide Sequence Number=SeqID_114464
atgccggacacgccgcgcagcattgtgctggtggccgatacgttgcgccaggaagatgcccggttgctcagccagacctcgctgccgctgcagctgtgggtgcctggcactgcgcccggcggccccttgccgcccgctttcgccagtcaggctattgatacccgcctcaacgtggcgcgcttccagcagctacgcgacaacggcgtggcggttacgctcgccacccccgatgacagcgatctgcttgccatcaggcaccatattcagcaaagcctcagcgcccagcaaaacagtcgcggggatctgccgtggcacaacagcggctactggctgattgcgccgatgttgttgctgccgctgtggtggcgtcgtcagatattgatcgtgctgattgtgttgccgctcagtgggataacgccgccggcggccgccgcgctgctggatgcgtttatcccgcccgacctgcaagggcaacatgcctttcaacggcagaattacgcgcgcgcggcgcagcactatgtcgatccgctgcgccgcggcattgcgctctactatgccggtgatttttctgccgccagcggcgcttttcgtcaggcacccgtgacgcctgaatcgctgttgtggctgggcaacagcctggcgcagcag

SEQ ID NO: 22780 - DNA, 384 bp, Glycine max
  Peptide Sequence Number=SeqID_114465
atggtgggttacacaccttcaagctttgcggatttggtctttgctggcgaaatgatcgaagtgggtttaaaaagaggcaaatctgatcatcatgccttgacaaatgcaaaaaaaaatattggggcaaatgaagagggtgagaatgaaggagaaacccatgttgtgactgccattcctatacagccaagtttcccaccaacccaacaatgtcattactcagccaataacaaaccttctcctggcccaccacccagttatcaacaaaggccatccctaaatcaaccacaaaacccacctaccacacaaccaatgctaaacaccacttttagcacaaaccaaaacaccaaccaagaaatgagttttgcagcgaaaaaaaacctgtag

SEQ ID NO: 22781 - DNA, 409 bp, Glycine max
  Peptide Sequence Number=SeqID_114466
gtagttgatatcggccaggaaagacgaccgatccatgatgagaatcatgaaactggccaaatagaggctaaaggcccaagtggagaaggacgaaggcccaagtggagaaggacaaagcccccgagtggagaaggacttatcaaggtaatccttgtggcgtctaccctgacttatcttccttcactggaagtggcgtctatccagacttatcttccttcaccggaagtggcgtctacctggacttatcttccttcaccggaagtggcgtctaccttgacttatcttccttcaccggaagtggcgtcatccaaactctgtaacctgtatcaacgatccgccccgctaaatgcccaagtggagaaggacgaaggcccaagtggagaaggacaaagcccccgagtggagaagg

SEQ ID NO: 22782 - DNA, 386 bp, Glycine max
  Peptide Sequence Number=SeqID_114467
atgctccagtggcttctgtttctatcagctgtccctcctgttcagctactgacggggtggtgcgtaaacggcaaaagcaccgccggacatcagcgctagcaagtgtagcgggggggcaactgttgggaagggcgatcggtgcgggcctcttcgctattacgccagctggcgaaagggggatgtgctgcaaggcgattaagttgggtaacgccagggttttcccagtcacgacgttgtgtgactatgatagctccagtgatatcaagcttatcgataccgtcgacctcgagggggggcccgcggagtgtatactggcttactatgttggcactgatgagggtgtcagtgaagtgcttcatgtggcaggagaaaaaaaggctgcaccg

SEQ ID NO: 22783 - DNA, 817 bp, Glycine max
  Peptide Sequence Number=SeqID_114468
atggcggtgtttgccatggctagtattcgtgagctcaacggaaagctgttttttgattttagatttagaggccagcgatgtcgggagtacaccgcagtactggacaacaaaaccaaccgtagcaaaatggaaaaaatcctcaccaaaattgaggaggacattgaagccgatcgctttgagtatcgtcgctatttccccaatagcaagaacgctgtgaagtttgatgacccggctacagttttaagcaaagtcgcagcagaaacgcaaaaagcctttacgaggaatccaagtgttggaaataccccattgttctctgagtttgttgaacagtggttcaatgagttttcggtgggatggcgacgaacgtacatcagcactgttcgccagattgtcgatacgcggttaattccggagtttgggcaatctagggtcagcgacattcatcgtgaggacatcctcagttttcgttctactctcggcaaagaaccaggacgtaaacaggactcaaaactatcgccacgcagaatcaatgcaattgttctggtgttgacgcaagtactcaacgaagccgccgaccgctatcactttatcacatcgggtgatcgcatcaaaccgctgaagctgaagaagacccatgtacaaccttttagtcttgaggaggtgaataagatcatttcgatctgtcgacctgacttcaaggactactttattgttcgttttttcacgggtatgcgtacaggggaagctgacggactgaaatggaagtatgtcgattttgataaacgccttatctacatccgtgagacttttacggcag

SEQ ID NO: 22784 - DNA, 249 bp, Glycine max
  Peptide Sequence Number=SeqID_114469
atggatcacttcctagttactgcattttcatgtttatttgattcgggtacggcctcgatcagagggctcacgggtgtgtcttccaaaggaggaaaatgcacggagtcgccaccaacgtttatttgtggaaaacttcggaaaaaccgaaggaaaccggtcataaagaatattccagattcgggagttgcatttacgtttgaggaaggtattaacacctctcacgtttgtcccaaaggacaacaaccttaa

SEQ ID NO: 22785 - DNA, 207 bp, Glycine max
  Peptide Sequence Number=SeqID_114470
atgttggatcaatttcatttgtgcacccaggattctattgaaaacattattgatgtcaaagcggatggtaattatggttatcaggcaatagctgtgttattgggtatgggtgaaaaatcgtggtcattggtgcgcaaccatctgcataaagaactgacaagctgtccgaagagtatatcaacctggttaccatggacaagtggatga

SEQ ID NO: 22786 - DNA, 477 bp, Glycine max
  Peptide Sequence Number=SeqID_114471
aatcatagtgggttgaagagaaggaagttcgattacatctcctccacaaataccaacgctaggaggatcggagcaactggggcaaaaaggaaggaaggagatactcatgtcgtcacttcagcacccgcatggatcaaaccatcacagacctctcatggtacccatcagtacgcacaacatcacccaagcttctcagctcgcgccggggacccgtccaattcggcacccgtacaagctagggcgcctgcacccatccagagggagaccccccaagctacagctctaaccccgactcgcccggctggcaatgcccactttggcgtcagttccaacgcgataaggaactttcctccaaggcgaatccaagacttcaccatgatccccatgacgtatgaagacctcttacctcgtcgccaaccagatggttgtgatatctctcggaaagatttaccagcctcctttcccaaagtggtataa

SEQ ID NO: 22787 - DNA, 624 bp, Glycine max
  Peptide Sequence Number=SeqID_114472
tgatctccgtcacaggtatttattcggcgcaaagtgcgtcggctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatctttaaggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaaggctgcaccg

SEQ ID NO: 22788 - DNA, 231 bp, Glycine max
  Peptide Sequence Number=SeqID_114473
atgggttcgaaatctatcctaaggctcatgagaaccttagggtcttctgttgcatctctggctcaatcttcttggagtcttctatccaatgcccttgggggttatgaacctatttgggaaattattgataagaggtgggagaaccaactttataggcctttgcatgcaggtgcatattatcttaatcctcaatttcattttgaagatgattttaaaaaggataatggataa

SEQ ID NO: 22789 - DNA, 591 bp, Glycine max
  Peptide Sequence Number=SeqID_114474
atggcaagagctggtgacaatggtggtgtatatcatcaactggacgaatctcagcgcttatcgatcaacacgaccactacacgagtgcaacgtttgttgaactgtaacaaagaagagccctacagacgaatagccaaatcttcctcgtttactcttaaacctctatcccctagaaaaggatgtctttcccaaggagatcctcatggactgccaccttcaagaagcatagaacatcaagttgatctccttctagaagcttcattgcctaacaagccaacttacaacagcaagccccaagagactcaacataaggatgcacaggtcaaagttgagtatgagaaaagattgtatgaccaagtgaaggtgcaaattgcaaagaagaatgaaagctatgccaagcaagccaacaagaaaaggaaggaagtggtacttgaactcggtgatgatcctggacatttgaggacaaatgttttccaagaaggagggaatgatgagaatcatgaaactggccaaatacaggctaaaggcccaagtggagaaggacgaaggcctaagtggagaaggacaaagcccccgagtggagaaggatga

SEQ ID NO: 22790 - DNA, 318 bp, Glycine max
  Peptide Sequence Number=SeqID_114475
atgtcaagcaatatagacaataatagacaatcgaattcctgcagcccgggggatccactagttctagagcggccgccaccgcggtggagctccaattcgccctatacacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 22791 - DNA, 180 bp, Glycine max
  Peptide Sequence Number=SeqID_114476
atgaggaacccacacgcacaactcttttctattagaggtcgacaaactcaggcaatgatcaactccggttcccagtattctgaagtcctctctgatgcaatgaatagcggtcaacaagaatctaatacacacattgtaaatgaattcgacagacacaatcacacttttattataacatag

SEQ ID NO: 22792 - DNA, 324 bp, Glycine max
  Peptide Sequence Number=SeqID_114477
atgatatcaactaagcctgttgatcgatatacaagaccagaatttacagagaatgggccgttggcaattgattctaaacaggctattaatcatattaagaggaagtatgagttggagaatatggaaattgtgaacaaggaaaaagaaaaggttcgatatgatttcctggctgacaaagccattgcagaaattgaggcaaagtgtggccaaaaaattgaagaatgcaaagaagaacaaaggcagcagttgatgcgcattgaagatgaacacacgttgctcgtaagcatagaaaaagtcttgaatttgaaattattggctgcttag

SEQ ID NO: 22793 - DNA, 151 bp, Glycine max
  Peptide Sequence Number=SeqID_114478
atggaaaagataagagggggttggctgttctccactgttacaacactactcttactgtggtcttacaagctttgctatgatgcagcatactgtcatctcattgaaagttgcatccctgacaacaaagatttccttactatcattgttcgag

SEQ ID NO: 22794 - DNA, 918 bp, Glycine max
  Peptide Sequence Number=SeqID_114479
atggcagagcatagagaacataaggttgttgataaatctcaggtagctccagctacaagtagaaccatgtcatttcctctatcattccttgacttgccttatgcacgtcttctttatgtgaaacgtttattcttctatcactttccccatcccccacacattttctatgaaactttactcccttctctcaaacacaatctctctcttacccttcaacatttcttccctctcgctgggaatctcctgtgtccaccacaacctaacaaacccttcattcgctgcaccgatgatgactctgtcaccttaaccatcgtcgagtccaaagcatatttcaaccatctctcatccaaccaccccaaaaatctaaaagatttggatcacttagttcccatgttgacattcacaaccgtgcatggtgatgatgatgaggacacgtatgtttcgccattggtggccttgcaagtcacggttttccccaaccatggcctttgcatcgccataacaaattctcacgtgatcatggatggaaggagtagctgttatttcattaagtattggtcaagcatttgtagaagtggtggagttgacttgacaacaccttgctttgatagggaagtgttcaaggacaccaagggacttgaggccatcttcttaagagactactttgaagagaggtcaacttggaaggacaaactcaaactcattggtcaaactcctaatcatcatgaggactatgttaaggcaacagtttcctttggaagagatgatattgacggaatgaaaagatgggtgctgaatcagttggaaaaaaatgatgaattgatgaaagcaccccaatatctatcaaagttcgtggttacatgtggtttcgagtgggctagctgggttaaagcaaaatatagacctgatgatatatga

SEQ ID NO: 22795 - DNA, 2868 bp, Glycine max
  Peptide Sequence Number=SeqID_114480
atggaattgagacctcacatacttcgaagagttatcaaagatgtggagaaatcattaccccccaaaattgagcgtatccttagggttgaaatgtcgcctcttcagaaacagtattataagtggattttggaacgtaattttcacaatttgaacaaaggagttcgtgggaatcaggtttctcttttaaatattgtggtggaattaaagaagtgctgcaaccatcccttcttgtttgaaagtgctgaccatggctatggtggggactcaggaagtagtgacaacagtaaactagagagaattgtttttagcagtggcaagcttgtcatacttgacaagctccttgttaaattgcatgaaaccaagcatcgtgttttgattttctctcagatggttaggatgttagatatactgggagagtatatgtcccttcgagggtttcaatttcagaggcttgatggcagtacaaaagctgagcttcgacaacaagcaatggatcatttcaatgcacctggtagtgatgatttttgcttccttctttcaacacgggcaggaggtctgggtatcaaccttgctacagcagacactgttataatatttgattctgattggaatcctcaaaatgacctgcaggcaatgagtagagctcatagaattggacaacaagaagttgttaacatatatagatttgttacaagcaaaagtgttgaggaagatattctggaacgtgctaagaagaaaatggttctggaccacttggtgattcaaaaactaaatgcagagggtagactggagaagaaagaagccaaaaaaggaggaagttattttgacaaaaatgagctgtctgcaatcttacgatttggagcagaggagctctttaaggaagaaagaaatgatgaagaaagcaagaaacaactcttaagtatgaatatagatgagattcttgaaagagcagaaaaagttgaagagaaggaagctgacggggaacaaggaaatgcgttattgggtgcttttaaggcaagatatgtggacagtactgttgccaatttttgcaatgatgaagatgatggaagtttctggagccgttggataaagcctgatgctgtattccaagcagaggaagctcttgttcctcgatctgctagaaatattaaaagttatgcagaagttgatccatctgaaaaaagtaataaaagaaaaaagaaggaacctgaaccacttgaccgagtttcgaaacgtcggaaagcagagtattccgctcctgcagtaccaatgattgagggagcatctgtccaagttatgaaatatggcaatgagagccaagttgacttaattgttgccgaggttggtggtgctgttggggctgctccacctggagtacagattgaacttttcaatgctcttattgatggctgtacagaagcagtagaacttggaaatcttgatgcaaaggggcctttgctggatttttttggtgtaccagtgaaggcaaatgatctacttacccgtgtccaacaacttcaacttttggcaaagcgcattggtcgatatgaagatcctattgcacaatttcgtgtgctgtcatatctcaaaccatcaaactggtccaaaggttgtggatggaatcaaattgatgatgctagattgcttcttggaatacattaccatgggtttggtaattgggaaactattagattagatgaaagacttggccttacgaaaaaaattgcacctgtagaacttcaacaccatgaaactttcttgccacgagctccaaatttgaaagaccgtgctaatgcccttctggagcaagaacttgcggttcttggtgtgaaaaatgccaacagcagagttggacggaagccttccaagaaagagagagaaaatatgattaatatctcactgttacgtgggcaggagaaaaagaaaaaatcgagttctgttaatgtccaaatgagaaaggatagatttcagaaaccccagaaggttgaatctatagtaaaggaagagggtgaaatgtctgacaatgaggaagtatatgagcagtttaaggaggtaaaatggatggaatggtgtcaagatgtgatggttgaagaaatgaaaactttgaaacgtcttcacaggttgcagcaaactagtgccaatcttccaaaggaaaaggtgctttcaaaaatacggaactatttacaacttcttgggagaaggatagatcaaattgtgctagaacatgaacaggaaccctataagcaagatagaatgactgtgcgactgtggaaatatgtgtccaccttttcccatctttcaggggagaggcttcatcaaatatattccaaacttagacaggagcaaaatgaggcaggggttggcccctctcacgccaatgggtcagtatctgtttcatttagcagaaatggaaatccattccatcgccatatggagaggcagagaggattaaaaaatatggctccctatcaaatgccagaaccagttgataatactgggaaatctgaggcatggaaacgaagaagaagaactgaaagtgacaatcatttccagggtcagccaccacctcaaaggaccttaagtaatggaatccggattactgatcctaactcactcgggatcctaggtgctgggccatcggacaaacgctttgctagtgagaaaccttataggacacaacctggtgggtttccttcaagacaaggcttctcttcagcttcagcaattgtacattctgtggaatttttttcttccacccatgcgaataagaccttgcggatccctttttggtgtgttttggcggatatgagaaatatccctacactgggattcacatccttgaagatggctgaagccgaaaagatctaa

SEQ ID NO: 22796 - DNA, 1074 bp, Glycine max
  Peptide Sequence Number=SeqID_114481
atgttaaccgcaatcctcagaagaacctgttccactctctcaaggcgcggtttccccgctgccttaatctccgcctccaccgccggaaaccacttccggccaccctccgcggcctttatttccagaaccttccactccaacactggccccttgaatttccgctcctcttcatgtcaccgcgcagaatacgccgtcgacgatttcccttacgaagaaggctccaaagggaacgccgccgacgaaggcctcgagatcgcgaagctcggaatttctgaggatattgtctccgctttggccaagaaaggcatcaccaagctcttccccattcagagggctgtgttggaacctgctatgcaaggtcgtgatatgattggtcgagctagaactggaactgggaagactcttgcttttgggatacccatcatggataagatcattcagtttaatgctaagcatgggcgggggagggatcctttggctttggttttggctccgaccagagagcttgctcgacaggttgaaacggagttctgtgagtcggcacctaatttggatacaatttgtgtttatgggggtacacccatctctcggcagatgagggaacttgattatggggttgatattgctgtgggaacacctggtcggattattgaccttctcaacagaggtgctctaaatttgaaggatgttcagtttgttgttcttgatgaagctgatcagatgcttcaggtgggctttcaggaagacgtggagaagatcttggagaggttgcccccaaaacgtcagactcttatgttctctgcaacaatgccatcttggataaagcagatttcgcgcaattacctgaataatcccctgaccattgatcttgttggagattctgatcagaagttggcagatggaatttcactgtactccattgcaactgatttgtatgttaaagcgggaattcttgctcctctaataacgggttggtgccttctgactcgaaggtcacaggtacaaattctagaaacagcctttccgcttgaggcagtaaggctgtgtacatctacactccttagacccaactag

SEQ ID NO: 22797 - DNA, 841 bp, Glycine max
  Peptide Sequence Number=SeqID_114482
gtttcatcctcttgaagaactgaaaggttccaacgatattcagccagctagactctctcctgccgaaatagcaaaaacaactgtagaggctaataaaagcgctttgctagtatttcctggaatggtacactgtgaaccacatgaccagatttcatgggctgagtttcaatatcatattgatgatgttggagatatatattttgaaatctctgatgatgcaaaccttttggcggattgtggagctaacaatcctgtgaatgctttgattggaatggacatcccaatatatgataataatagaaggactgctagtgaatatgacattttcaataatggcagcgatgatgaattcaaatttgatgatgatgatattgaggtttcagaaatggaggagtttaatattccagtgaattggggacagtctgatactacaaagtctgttcatccaatttatttctcgaagtgcttagcaaaggccatcaacaacatggaatatgttaaaagaatgaaccatccttcaaatggtgtttctataatagggttccttagacccgtttatggtgaagaaaagtcatatctaagatggatgtatcacactgaagatggcgatgtatacatctcagactggagagatgctgaacctgatattcttgcacattcttcttcggaaattctggaacgcttcaatcaattctgcgatgatgaaattaaagcactttgcaagaagaaaggtctttatggcgagggagcttacctggttggggttgacagccttggtgtggatgttagagttctttcaggtgcagaagtaaaaactcatcggtttccattcaaagtccag

SEQ ID NO: 22798 - DNA, 1455 bp, Glycine max
  Peptide Sequence Number=SeqID_114483
atggcggaatcatcgtcatcgtcgttggcgaagtccgactcggaggtagaagaaatgctggatcggatgctgactcgtttggctctctgcgacgattccaagctggagccgctgctctccaagcttctccctctctgcatctcctccctctcctcgcaatccgtcgccgttcgcaacaaggtgcttgagattttgagtcacgtgaacaagagagtgaagctccagcctcaaattggtctacctttgtctgacttgtggaaattgtattcggaatctgctgctgtccctatcataaggaatttctgcattgtgtatatagagatggcttttcagcgtgttaatgcaaaggaaaaggaagatctggcacctgatctcttggtgaacatctcaaaacttccacttcaacaccaggaaattatccttagaatcattgttaagcaaagatcaccctcagttataaatcttcaggatatgactacttatggatttctgcttccttctagtggtggattccctcctgggctttcagtagctcaagtcaatcgtgttacggggaaacaacaattgcaaagtaatgaaattttactaagaaagttgggtattttgaatgtcattcaagctatggagcttgctcctgagcttgtttatcctttatatattgctgcctctgtagattgtgaagagcctgttattaagagaggcgaggagcttctaaagaagaaggccaatggtgctaatttagatgatttaaatctgatcaacagactatttttgctatttaatggtactgttggagttgaacatgttgattcagaatcaagagttagtcccgggagtcctgctttaaaggcaaaattaatgtctatattctgcagatctattgcagcagcgaacaatttcccatccaccttgcagtgcatttttggttgcatttatgtttgtggaaatagactctattaccagaaaggagaagataatcaagatatagaaaacgagaatgggcaaacccttaaagatagaaataaaaaaaggaacggtaccacatcaaggttgaagcaattaggaatggaattcactgtttgggtatttaagcatgcaaaaattgatcagcttaagttaatgggtcctgttattttgagtggaattatgaaatccctcgacaaccatccaagttcagaagcagatgccagtgctcgggaggtcaaaacttatgcatttcaggcaattggattaattgcacagcgcatgcctctcctcttcaggaaggttaacaatgtggctgatagtccttgtgccttcaaaggagattggcaattgtgccatttaatggaaaagattgacattgctgcccgtctttttcatgccttgaaagatgaatcccagtctcttcgatttgttgttcaagaggcaactatatctcttgcttcagcatacaaatcatggaaaatgtattga

SEQ ID NO: 22799 - DNA, 2811 bp, Glycine max
  Peptide Sequence Number=SeqID_114484
atggcacttgaaggtctttgtcttcttaaaagtggaagtgaaattgttggtcttaagtatcccaaactgggtatgatgctggattacattcttcggcaacagccaaagttgttggagtccagtgaaactagagaacagaaccttctttttccttcaaatacatatgtggccatgattaaatttttattgaagtgctttgagtctgagttggagcagaacaaatccttagaaggatcatctgaatttatttcatcagtgaagacattctgtttggttctcgagcattctatgtcatttgaaggctctgttgagttgcatgccaatgcttccaaggcattgcttataattggatcacatatgccagaggtggtagcatcacattttgccctaaaagtttcatggcttaagcaactattaagtcatgtggattgggacactcgtgaatccattgcacgcatacttggtattgtgtcttctgctcttcccatccctgatgttatgtctgaattgacttccttattcagccaatcacacaaatcaaggtttgagactcagcatggagctctttgtgcaataggatatgtaactgcaaattatttgtctacaacacctatgccagaaatatttctccaggatacacttagatgcctggttgatgtggttaattctgaaacttctgcactggctgctgctgcaatgcaagcactaggtcatattggactacgtatttcattacctccacttgatgattctaattcagatggaattctgataatgttatctgataaattgagcaagcttctctcgggtgatgacattaaagcaatacagaagattgttatatctattggacatatatgtgtaaaagaaacatcgtctactgagctagatatggccctaaatttgattttcagtctctgtcgatctaaggttgaggatattctcttcgctgctggggaggccctttcttttttgtggggtggtgttcctttcaatgctgacataattctgaaaactaactatacttcgctgtcaatggcttcaaattttttgatgggagatttgacctcttcagtatctaagcagagtactaatgaacaaagtgaatatagtggagattatcatgctgctgtgagagatgcaattaccaaaaagctctttgatgttcttttgtatagtagcaggaaagaagagagatgtgctggaactgtttggctagtatcacttataaagtactgcagcaatcatcctactattcagcaaatgcttccagaaattcaggaagctttttctcaccttcttggtgagcaaaatgaactcacacaagagttggcttctcagggcatgagtattgtgtatgacattggtgatgaatctatgaaaaagaatttggtgaatgcacttgtaaataccttgactgggtcagggaaacggaaaagagccatcaaacttgttgaagacactgaagtatttacggatggagctcttggggaaagtgctagtggagggaaactgaacacttacaaggagttgtgtaacttagcaaatgagatgggacaaccggacttaatttataagttcatggatttagcaaactatcaagcttctctgaattcaaagaggggtgctgcttttggcttctctaaaatagcaaaacaagcaggggttgttcttaagccatacttacgttctttaattccaaggcttgtacgctaccagtatgatcctgacaaaaatgtgcaggatgcaatgatacatatatggaagtcacttgtggatgattcaaagaaaaccatcgatgaaaatttagatctcatcattgatgatttactagtacaatgtggatccaggctttggcggtcacgtgaggcatcatgtcttgcccttacagacattattcaaggacgaaagtttcatgaggttgggaagcatttaaagagattatggtctggaacatttcgtgtaatggatgacataaaggaaactgttagaatttctggtgaaaaattatgccgtgctgtaacttccttgacaacaaggctctgcgatgtctctctaactgatatgtcagatgcgcacaaagcaatggatattgttttgccttttttgcttgcagaaggtatactaagtaaagttgatagtgttcgcaaggcatcaattgcagttgttatgaagcttacaaagcatgctggaactgcaattcgtccacatatgtctgatttagtgtgctgcatgcttgaaagtttatcaagcctagaagatcaatcactcaattatgtcgagcttcatgcggcaaatgttggaatacagtcagaaaagcttgaaagtttgagaatttccatagccaaaggctctcctatgtgggagactttggattcatgcataaaagttgttgatgcagaatcattgaacacattgatcccacggcttgctcatttagtgcgatctggagtgggccttaacactagggttggtgttgccaatttcattaccttgttgcttgaaagtgttggtgttgacatcaagccatatgcaaatatgttggtgagattgttgtttccagttgttaaggaggaaagaagtactgctgcaaaacgtgcctttgcaagtgcctgtgcaaaagtcttaaagtatataccagcctctcaagcacaaaaacttattgaagatactacagctttgcatgctggtgacaagaattctcaaattgcatgtgcatttctcttgaagagctattcatccatggcagcagatgttgttggtggatatcatgctgttatcattccagttgttttcctttcaaggtcatga

SEQ ID NO: 22800 - DNA, 1455 bp, Glycine max
  Peptide Sequence Number=SeqID_114485
atggctacaggattttgtgtccaaactataccctttctctctcacacaattcatattttcataggtgaaaatgggacaatagatgggcaaggagatgcgtggtggaataagtggaggcagggaactcttcagtttaccagaccaaacctagttgaatttgtgaattctagagatattattatttcaaatgtaatctttaagaattctcccttttggaacatacacccggtttactgcagcaacgttgttgttcgatatgtcacgattttggctcctcgtgactctccaaatactgatggcattgatccggattcaagttcaaatgtgtgcatagaggattcatacatatctactggagatgatcttgtggctgtgaagagtggatgggatgaatatgggattgcttatggccgtcctagctctgacatcacgatccggcgcataactggatcgtctccatttgctgggattgctattggcagtgaaacctctggtggggtggagaatgtacttgctgagcacatcaacctttacaacatgggaattggtatccacattaagaccaacactggcaggggtggatttataaagaatataaccatgtctcatgtgtatatggaggaagcaaggaagggaataaggatctcaggtgatgttggggaccaccctgatgacaaatttgatgccaatgctctcccacttgtgaagggtgtcacaattaagaatgtttggggtatgaaggttttgcaggctggtttgatacaagggttgagaaattcacctttcactgatatttgcctatatgatatcaaccttcatggagtgacgggacctagaactccaccttggaagtgttctgatgtgtctggatttgctcatcaagttagcccttggccatgttctgagcttagcagcaaccagcagggatcatttgtaattggtgctcttggtggccctgaaattgtaatcggtgcccttggcgaccctgcctttggtggccccgaagttgtaatcggtgcccttggtggccctgcctttggtggtcccgaagttgtaattggtgctcttggttgccctgcctttggtggtcctgaaggtgtaattggtggctctggttctgaagctgtaactggtgcccttggtggccctgcctttggtggccctgaagttgtaatcggtacccttgggggcccttcctttggtggtctcgaagttgaaattggtgctcttggtggccctgcctttggtggtcctgaagttgtaactggtggctctggttctgaagctgtaactagtgtccttggtggccctgcctttggtgacctcgaagttgtaatcagtacccttgggggcccttcctttggtggccccgaagttgaaattggtgctcttggtggccctgcctttggtggtcctgaaggtgtaactggtggctctggttctgaagctgtggct

SEQ ID NO: 22801 - DNA, 528 bp, Glycine max
  Peptide Sequence Number=SeqID_114486
atgatttggggtgagattgtttacctgggtggccatgataacggcaccggcagcgagatacagcgtcatgtggctggccttggtgttgagggtgcgtccatcacccacgcccccaaactccgttatggatatgttgtcgttgtaattggtgctcttggtggccctgaagttataatcggtgttcttggcggccctgcctttggtggtcccgaagttgtaatcggtgcccttggtggtcccgaagctgtaactggtgcccttggtggccctgcctttggtggtcttgaaggtgtaactggtggctctggttctgaagctgtaactagtgcccttggtggccctgcctttggtggtcctgaaggtgtaactggtggctctgattctgaagctgtaactggtgcccttggtggccctgcctttggtggtcctgaaggtgtaactggtggctctggttctgaagctgtaactgtgagaacaaatacaactagtagaggaaaaattgctataaacactttcttcattttgtaa

SEQ ID NO: 22802 - DNA, 1485 bp, Glycine max
  Peptide Sequence Number=SeqID_114487
atgtgttcagaatgcaagatacaaagaggatcattctctaaaagcctttgctgtgcaaatgatgacaagcagcaggagaggtccccatctgttattgtcattggaggtggcatggctgggattgctgctgctcgtgctcttcaagatgcctcatttcaggttattcttctagaatcacgagaaagacttggtggccgaattcacactgactactcatttggctttcctgttgacctgggtgcatcgtggttgcatggagtttgcaaggagaatccactggctccattgattgggaagctgggactacctctttaccgtactagtgaggataattctgtcctttatgaccatgatttggaaaggttggaagggctttcccacaaggtgctacagtggtatttatgcagaatggaaggttggtttgctacagatgctgataccatatcactgaaatgttgggatcaggaagtattgctccctggtggtcacggtcttatggtcaggggttaccagcctgttataaataccctagccaagggtcttgatattcgccagggacacagggtaacaaaaatagttaggcaatataatgaagtaaaggtggcagtggaaaatgggaaaacatttgttgcagacgctgctattgttgctgtacctcttggggtgctgaaggcaaagagcataaaatttgagccaaagctaccagactggaaagaagctgccatttctgatattggggttgggattgagaataaaataattttacactttaaaaatgttttctggcctaatgtggaattcttaggagtagttgcagagacatcttatggatgcagctactttcttaatctccacaaggctacaggtcgtcctgtccttgtttacatgcctgctgggcagctggccaaagacattgagaaaatgtctgatgaagcagctgctagctttgctttcatgcagctcaaaaagatccttccagacacttcttcaccgattcagtatcttgtgtctcgatggggtacagatattaatacactaggttcctatagctatgatgcagttgggaaaccacatgacctgtatgagaggctacgggtccctgtagataatttattctttgcaggggaagcaacaagtatgttgtatacggggtctgtgcatggtgcatactctactggaatgatggctgctgaggactgcaggatgcgtgtcctggagcgttatggggagctagatttggtcccgccgaccggtaggacagtaggatatatacatggatgtatggttcgtgcctcaattcatccagaacagtatatttatcatacggaactcatcgatggtgtgaagtttgctgctcccgatgattggagttccattgcaatcgaaagtgattccaaaaaggtaggtaacattaatagaaatgtaacagattggtctgaactaggtgttatttatgagggcataagattagcagtcattgtttga

SEQ ID NO: 22803 - DNA, 1110 bp, Glycine max
  Peptide Sequence Number=SeqID_114488
atgaagaacagtattcctggtttggattttgagagtgatgcatgtctcaccaaccaaagaaagctcatagggccggaccaagaacttgtagagctcctatggcaaaatgggcaagtagtgaggcacaaccaaacacataggaagccacttgggaattcatctaacttgagacaggcgcagaaaactgatcattcaacattaaggtctagtggtccctatggaaactcaagcaacttggatcaagaagaggccaccccatggatccaattcccacttgaggacccattggaacaagacttttgttcaaaccttttatctgaactaccaccaacttgtgaatttgaatcttacaagccaatcaagcaattggaagaggacaagtttaccaatttttttgcttctagtaccccccatcatcctactacttcaagttcaaaaccactaccacctaacatgacatcctcatgggttcaacgaatccaagggaatcctaatcccatgcctgctccaagatttcatgttcctgattcatcccagaaagacaatgacttaggtgcatcacgaaaggttctaaattttcctcacttttcaacaccccgtaataatgtttcttcagcacctggtagtacacagtttagggaaaaaactactgctaacttgtcacaaagtgaggctagagagtactcagtgatcacagttggttcaagtcactgtggcagcagtcatatccctcaggagaaagatgtaagcagggtttcaagcagtgctgtttgggctactaataataataatagtttatctgctgagcctgaagctgtcagagattgtgtccagagaccaatttgtcctaggagtgacaaaggaaaatcagagatgattgaaccaactgtgacttcatcttctggtggctcaggcagtaccggtattggaagaacttgttccctatcaacaagagatcatggccaaaagagaaaagggacagaagaagaagcatctgaggaacaaagtgaggccacagaacttaaatcagctgatggaaacaaggcttctcagcggacggggtcttccaaaaggaaccgtgcagctgaagtgcataatcaatcagaaagg

SEQ ID NO: 22804 - DNA, 924 bp, Glycine max
  Peptide Sequence Number=SeqID_114489
atgaacacaagcagaaaaggagaagagtgtgtggaggaagaagaaggaatcggcggtgttcaactgacgatcgcatctcaaagtttggtcacgatcgttgctttgcttgttcgcttctttttgtcaggactcagttttattggggcacttttcatgggaggtgtggaagatgaagaaccatccatgaaacgaatgaaattatcctctaaaggattagttggcttgtctaacggttcttctaaagagcctgttggaggcttgtccagtgacttgatggctcggcccctaccatccaaaggggacgaacatgttggttccaaaggggttataaagaaagaagaatttgtcaggataattgcaaaggcattatactctcttggttacggaaagagtggggcacatctagaggaggagtctggaatacctttgcactctcctggggtaaatctgtttatgcagcaaatacttgatggaaattgggatgacagcgtagccacattgtataaaattggtctggcagatgaaagtatggtcaggtcagcctcattcttaatattggagcagaaattttttgagcttctaaatggtgaaaaggtcatggaagcgttgaagaccttgaggacagagattgctccactttgcattaatagtagtagaattcgagaactttcttcctgcttagtttcagcatcttctaggctagacattctaagggtgaggtctcgatcaaagcttctggaggaattgcagaaactgcttccccctacagtaatgatacctgaaaagaggttggagcatctagttgaacaagccctaatcttgcaacgagaggcatgcccatttcataattcattggataaggagatgtcattatattcagatcatcattgtggaaaagatcagataccttccagtacattacag

SEQ ID NO: 22805 - DNA, 1233 bp, Glycine max
  Peptide Sequence Number=SeqID_114490
atggcttcattatgccggcggttatccgccgccgcaccggccggtcacttccgattccatcggcccgccgggatttgcgcggttcgatacggttattccgtccggcggccaatgcggttggttgcggcggggaccaccgtgggcggcggcgcgtgggtgacatccgatgacgtcggagggagggaggagaaggtggggccctgctcctacgccgtggaggatcggagggtggcggaagatggcggaagcgatgcggtggtaggaagtaggaaccgggtggtggaagtggcggcggcggcggttgcaacggtggtgctgggtgttgggaaccgggttctgtataagttggctttggttccgttgaagcactaccctttcttccttgctcaacttgccactttcggatatgtaatagtgtactttgcgattttgtatattcgacaccatgcgggcattgttactgatgagatgttagatgctccaaaggctccatttatagttgttggtctattggaggctctcgctgctgccactggaatggccgcaggagtcccaatatccatctacgtgttcaccatgccattgccataccttggtgttgcctcctctcttccaacaggctttatggcaggggccattatcctcattttgggcttactcatttatgcttggaccccttcaaatggttcctcggatagtacaacaccacaaggaactaattcaggttcgcttttaggagatggctataagaaggagaaagaaatagggcgttcttcttcgtatggcactggggctagtggtgctgctgaaggtgataggccaagggagatattggtgcagcatttgttggtaaaagaagatgaccagaagcttctgttgtatcttcagcagaaaatctcttcaggtgaagatttgagtgatcttgctgtggaatattcactatgcccatccaaagaagaaggagggatgcttgggcagttttgccggtttcagatggtattcatcactgccttgtgtaaagtagaggaagcatatgaggttcctgaatttgaagaggctgcatttactgcacctttaaaccaagttgtaagggaagaatcaattcttcaagacattcaacctgatgagctgcatatgaaaattcaagatcccagctttttggatgaggcacaattaattgatgtgcgagagcctgatgaagtgtatgctcatattttcttcaaccataattag

SEQ ID NO: 22806 - DNA, 2313 bp, Glycine max
  Peptide Sequence Number=SeqID_114491
atggtaagtggatgtcagtgtagaatccgttacactgatttacttctcttctgtgttgacttttgctcaactaatttacttatcccgttctacgttatcaaagagttagagcttcgattcttaagtttttgtgatgcgggaactgaaattccatcatccaagctgttgatcaagggtggcacggttgtgaatgctcagcaccaccagattgctgatgtttacgtggaagatggcatcattgttgcagttaatcctaacatcatggttggtgatgacgtcactgtcattgatgccaccggcaaatatgtcatgccagggggcattgatcctcacacccatctagatatggatgttggttttactgcaacggttgatgacttcttcagtggtcaggcggcagcattggctggtgggacaacaatgcacattgacttcgttataccacttaatgggagtttgacagctggttttgaagactatgaaaagaaggcaaagaagtcttgcatggattatggttttcatatggttattaccaaatgggatgaaactgtttcgagagaaatggagctcatggttaaggagaaagggatcaactcttttaagtttttcatggcatacaaaggaattcttatgatcaatgatgagcttcttctggaaggatttaaaaaatgcaagtctcttggtgccgtagccatggtccatgcagaaaatggagatgctgtgtatgaagggcaacggaaaatgatagaacttggaataactggtcctgaggggcatgctctttcaaggcctgcagtgttggaaggagaggcaactgctcgtgccattcgcttagcagattttgtgaatactcctttatatgtggttcatgtaatgagcattgacgcaatggaagaaattgcgaaagcccggaaagcaggacaaagggtaattggagagcctattgcctctgggttagcccttgatgaatcttggctttggcatcctgactttgagattgcagcaaagcaagtgccttcacttgtttcaatgtatgtcatgagcccccctattaggaaacgaggacatgataaggcccttcaagctgccctttcaaccggcgttttgcagctggtaggaactgatcattgtgcctttaattccacccaaaaagctcgtggaatcgatgacttccggaaaatgcctaatggtgtcaatggtattgaagaaagaatgcatttggtatgggatatcatggtggaatctggccaaatatctgtcactgactatgtcaggataacaagcactgaatgtgctaaaatcttcaatatatatccaaggaaaggagctgttctcccaggatctgatgcagatattatcatcctgaatccaaattcgagctttgagatgagtgcaaagtctcaccactccagactggacacaaatgtctacgagggaagaagaggaaagggaaaaattgaagtgactattgcaggaggaagagttgtttgggaaaataatgaactaaaggtcactcctggcactgggagatacatccaaatgccaccttttagttatctgtttgatggactggacaaaaaggacgccatttatctaaattcccttcaggccccaggtggaagcacgttcgagatggagcaggcattgttattagggttcgaagaagatgcgaagatggttacagagtcatcatcatcaagcgcacacagattggtcccttggttgaactgggatgagtggctcttcgttaaaaatgctctcttctccgattctcctcactctgtttactccgctctcaaacgaatatccgcatggcgaagtcgaggttccttgccagttctcatcgaagtcactacttccatcatcgaaattcaactcaaagacccctctttcagacatgatcaatggaatgacgcttctctttcagaggagatgcttgctatgctgtattgtatggccatcatgaggcttgtgaatggtgttgttgagaagacacgcaagaaagaagtggcgtcgatagcagtggcagctgatgcgattggtattccgcgcatgctgattgatattcgccacgagggatcacatcgtgagcttccttcgcttaagattgttcgtagtgcttctgttaaggcacttggttggttaaaatcttattattgggaacctcagagcaaagcaattccttttcatggtgaaggaatagcaaaagtcaacaaagaaattaagtctaggattcgtgaattagctatctgcttgaaagtcaatgggagtgcccagtctagttcctcactactaaaagcaaaacgtctgtaa

SEQ ID NO: 22807 - DNA, 1482 bp, Glycine max
  Peptide Sequence Number=SeqID_114492
atggaacgagcgttgggtcatcttggacccgactacggggagaatggaatacaagtatgtgtttgcatattggtttctgtttgtgtggggaaacggaaaatcactttgattactgatcttctgtattgttttgaatgttttcctttccttaggataagacgaaatgaaccttctgttaaaggaacaattatatttgacgccaatagcaccatcaccatatctcccgtgaatttccacgggcttccaaagtacgatgggtgctgcttttgtatcctttttgtcgcatttactacttatgaatcatcagatattgggacaccacagaaaaaggattacttcctctgtgcagagactcctggtgcagctagagcatgggtgtcaactttacatgcaactcagttggttctaaaagcccataaagaagctgtgaattccttaagtgggaatggttctacaaaattaggaactgttgcaacagttgttgctgcagccaattcaacagccttggaatgttcaaaagaaattgaagcagcaatgcagatttctttgcgaaatgctctgggaatgatgaataataggactactgatggtcctatggatgatttaacaatcatgaaggaaacacttagagtgaaggatgaggagctacagaatttgtctcgagaccttcgggcacgtgattcaactataaaagatatagcagataaactctctgagactgctgaagctgctgaggctgcagcatctgctgcatatactatggatgagcatcggagaattgcttgtgcagaaattgagcgtttgaataatgattctgagaagcagcaagagctgtttacacagaagctgaaagagtctgcagaaaagattgtgggcttaagcaaagaaagagagcaattaatcaggcagagagatgctgctattcaggaagcaaatatgtggcgttctgaactggcaaaagctagagagcatgatgtgatcttagaagcagctgtagtaagagcagaagaaaaggttagggttgcagaagcaaatgctgaaactaggataagggaggctgttcagagagaatccgcagcattaaaagagaaggaagagcttcttgcatatgtgaatgtactaaaagcccaacttcaaaggcaacacattgatacaactcaagtttttgagaagacagagtcatgctcagatacaaagcatgttgaccccacagaagagaatgtggataaagcatgcctgagtgtttctagagccatccccgtccctgcagagaatgtagtccacatggcaacagatcaggtgaacattcaaccagttggagataatgaatggagtgatattcaggctacagaggcgaggatagctgatgtaagggaagtagctcctgaaactgatggaagcagcttggatattcctgtggttagccagcctggaaccaatcaccaccatgaacaaggagctaactctttccatcaaccctga

SEQ ID NO: 22808 - DNA, 2634 bp, Glycine max
  Peptide Sequence Number=SeqID_114493
atgggtgggatattgaagcaacccggcgcgtttgcaatcacaccgcacaaagtatcactctgcatacttcttaagatctacgctccacccgctcagatatcggtccccttccctttcgcttccgttgctcagcacaatcgccttggcttgttcttattagccctcaccaagtcctgcgatgatatcatggagccaaaattggatgaactcatccatcaattgagaatgatgagccaaaactgggaggcttcctgggttattgatcagttgatgagcagactatcatctctgtcatcacctgatgatttgtttaatttttttagcgatatacgaggaatacttgggggtcctgattcaggtgctgtggaagatgaccaggttattttggacatgaacagtaacctggggatatttcttcggcgttgtgttcttgcttttaacttgctatcgtttgagggtgtatctcatctcttgacaaacctcgggatctattgtaaagaagaattctcaaattgtccttcctatgaagaacacggtttagatgattctagtagtaatctggagacatattcagaatatgagaatatggacctggagaactttgtctatgaaaaggtttcagaagaaattgaagcaagaaaggaggctagtgaaattgttccattccatcttcatacacacaacactcttctgagtttagttgatgatattgatgtgcctgctgattcagtatccaaacagagtgagaaagttagagtagctagtccatatggggacccttcaagtaacatgctgcgagatgttgatcacagcagcccggtatttctgcggacaaactggcaggtacaagggtacttacaggagcaagctcataccattgaaaagaatggtagtgctgtatctttcaatgggcttgaaatcattctacggcaactacaaaagttggcacctgaactgcatcgggttcactttttaagctacttgaatggtctttctcatgatgattatatttctgctttggagaatcttcattgctattttgattacagtgcagggactgaaggatttgattatattccttcagttagtggtaatggctttggaagatatgaaattggtttattatgtttggggatgatgcattttcactttgggcatccaaagctggctttagaggttttgtcggaggcagttcgtgtttctcagcagcaacaattgtttgttctcttgagaggttctttaaagagagcagaaagtttaaagttaaaacggttggtggcttccaatcatctggcaatggccaaatttgatctaacgatgagacctgcatttgagagtgtttgggtttatgccagggaggttatgtctacagcagggtgtgatcatgtacagcggcccttgctatcatttggtccaaaaacttccatgaagctcagtacttgccccgttaatgtttgcaaggaaattcggttgagttctcatcttattagtgattttagctatgagagttctgcaatgacaattgatggtgcctttagtacagcttggcttaggaatttacaaaagccgacgggttctcttgttttgtgtcaagagaatggatctggcaacagttctaatgcttcccaattcattgcacaaccaacctcaattcctggatctgtgttgcaagtattgggtttgtcttatatacttcgtgcaactgcatgggagttatatggaagctcatcagatgcagcattagcatatgtaaagctcattcaacatttagcagtatctaaaggatacaaagaggcctttttcgcccttaaaatagcagaagagaagtttctatctgtctcaaaatctcaaatcttactgctaaagttgcagctgcttcatgagcatgctttacatcgtggacaattaaagctagcccagaaactgtgtgatgaacttggtgttttggcatcacgagtaactggtgtagatatggaactaaagacagaagcaagccttcgccatgctcgtacattgcttgcagcaaatcaattccgagaggcagctgctgtggcacactccctcttctgtatgtgctacaaatacaatcttcaagttgagaatgcttcagttcttcttttacttgctgagattcacaagaaatcaggcaatgcagttcttggtcttccatatgctttagcaagcctctcattttgcctctcatttaacttggaccttctaaaagcttcagccacacttactctagctgagttgtggctctctcttggatcaagccatgcaacaagggctctaaaccttatccatggagctttcccaatgattcttggtcatggtggtttggaactccgctcccgtgcctttattgttgaagcaaaatgctatctgtgtgattcaaacttcaatgtctttgaaaattatgagattgtgatagattcattgagacaagcatctgaagaactccaacttttggagtttcatgaactggcagctgaagctttctatctgatggccatggtatatgacaaactggggcaattagaagaaagggaagaagctgcagcttcatttcagaaacatattttggctctccgcaatcctcaagatgaggatgatcctcttgttagtgtgttttga

SEQ ID NO: 22809 - DNA, 360 bp, Glycine max
  Peptide Sequence Number=SeqID_114494
atggggcaatcaaactcccaccatggcatagctacatttagatattgttggccaaatattattattagaggcgtatcctttgctttggttttgccttctccgtccatggcaatgaaaatcttaattgcctcattttcctctgcttctttccccacttttccatatattatggccttatatgacaacaatgatatgaacttagaagaaatagatttggaggtctttgaaattgatgcggccatcctaagagaattgctagaagaagatcaagagggcaaggatgataaggatcatggtaaagtagaatgcatggtagaatccgtagaagaaaacgatgctcatcctgacatgatgaaatag

SEQ ID NO: 22810 - DNA, 927 bp, Glycine max
  Peptide Sequence Number=SeqID_114495
atggtagattttgatgaggttgttgtgtttatgggtcagaaaagaaggcttggagtgaagagaagcagtggtgctgagattgatggccatacagtgaggaaggatgtaaattataagagaactgtcattgcctgctttatacaggcagtgtacttgcttgaacttgatagacaggagaagagaacacaaggaaatgctcttgccccaaattggtggattcccttcaagtacaagcttaaacaaacactaattgatgaaagagatggatccatttttggtgcaattcttgaatgggatagatctgctgcattggctgacttgataccaattagaccaagtggtgcccccagggctgttttagcactcagaggaacattactcaaaagccctacaatgcgaagagatatcgaagatgacctccgttttgttgcttgggaaagcttgaagggctctgtgaggtttaaagcagctttggaggtactaaaattgatttgtggtaaatacggaagcaataatgtatgcattgcagggcattccttgggggctggttttgctcttcaagtgggaaaagaactagccaaagaagggacttatgtggaggcacatttgtttaatccaccttctgtttcactagccatgagtctcaaaactattggagaaaaggctgagtttgtgtggaatagacttaaatccatgcttccttatattggtgaggctcaaatcagcaatggtggtttgaaagatgctagtttgggggtggcaaaatgggttccttatttgtatgttaacaagggtgactatatctgttgctattacaatgatggtgctggcacaagcacaaaggtgaatgtaggaactacaaatggacaagcaaagttgtttgttgtctctaaggagaaacagaagtttctcgagggagttgtttag

SEQ ID NO: 22811 - DNA, 3138 bp, Glycine max
  Peptide Sequence Number=SeqID_114496
atggctggcaatgaatggattaatgggtaccttgaggctatactatccactggaactggggctggcaccgttgatgagcaaatgcaaaaagcagtgactccaccagaaagtggacattttaatcccacacagtactttgtggaagaagtggtgtctagtgttgacgagtctgaccttcaccgtacatggatcaaggtggttgccactcgtaacaccagggaacgcagctcaaggttggagaacatgtgctggcgaatttggcatcttgcccgcaagaagaaacagttggaaggggaggagctgcagagatttgcaaacagaagatgggagagagaacaaggacgcagggatgcaacagaggatctgtctgaagagttgtcagaaggggaaaaaggagatggcgttggggagatgatacaaattgagacatcaaagaaaaatttccagaggcagatttccaacttggaagtatggtctgatgacaaaaaggaaaagaagctttacattgtcctcgtaagtttgcatggtttggttcgaggagaaaacatggagcttggtcgagattctgatactggtggacagattaaatatgtggtagaacttgctcgtgcactagcaaaaatgccaggagtgtatagagtagacctcttcacacgccaaatctcatctcctgaaattgattggagctacggagaacctacagaaatgctaactgcaggcacagatgaggatgatgataacattggggagagcagtggtgcatacatcataagaataccctttggtccacgtgaaaaatatctacagaaagaacttctttggccccatattcaagaatttgtagatggggctttagctcacattctcaatatgtcaaaagtattgggtgaacaagttagcggggggaaaccagtgtggccacacgttattcatggacattatgctgatgctggagatagtgctgctcttctttcaggtgccttgaatgtgccaatggtgctcactggtcattcacttggaagaaacaagctagaacagcttcttaagcaagggcgtcaatcgaaggaggatatcaattcaacatataagataatgaggagaatagaagcagaagagctttccctagatgctgctgaacttgttatcactagcacaaggcaagaaattgatgagcaatggggactttatgatgggtttgatgtcaagcttgagaaagttttgcgtgctcgagttagacgtggtgtcaattgtcatggccgattcatgccaaggatggcggttatcccgcctggtatggactttagcaatgttgtgacacaagaagatggccctgaagttgacggggagctcacacagcttactcgtggtgttgatgggtcttcaacaaaggctctacctacaatctggttagaagtgatgcgtttcttcacaaatcctcataaacctatgatcttagccttgtcaaggccagatccgaaaaagaacataaccactttgttaaaagcctttggagaatgccgccccttaagagaattagctaatcttacgcttataatgggaaacagggatgacatagatgaaatgtcctctggcaatgctagtgtgctcacaacagtgttgaaattgattgataagtatgacctgtacgggcaagtggcatacccaaaacatcacaatcaatctgatgttccagagatatacagatttgctgcaaaaacaaaggcagctgcccatggacttccaatggtggccactaaaaatgggggacctgtggacattcatcgggccctgaacaatggtttgcttgtggaccctcatgatgacatagcaattgccgatgcattggtgaagttgttgtcagagaaaaacatgtggcatgagtgcaggaagaacggttggaagaacatacaccttttctcatggcctgaacactgtcgcacttacttgacccgggtggctgcctgtaggatgaggcatccacaatggcaaaccaacaatccagaggatgataaagctgttgaagaagaagagtctttcaacgattcgctcaaggacgaacacgacatgtcccttaggctctcaattgatggtgacttggctgcagcaagtggaggcactggtctagatatgcaagaccaagttaaacgcatcctaagcaagataaggaagacagattctggctcaaatggtaatggtggtggaaatatcaatatgctgcttgacaatgtaacgagcactagcactagcactaacactagcaaatatcctctattgagaagaaggcgtaggttgattgttatagcacttgatttgtatgacaataatggagctccggagaagaaaatgattgagatggtgcaaaagataattaaagctgtgcaactagaccctcaaactgctagagttacagggtttgctttatcaactgctatgccagtgatagaaacagtagagttcctaacatcaggcaatgttcaagtgaatgagtttgatgctttaatttgcagtagtggaagtcaagtttactaccctggcatcaatacagaagaaggaaagcttttgcctgatccagattatgaggtacatattgactatcgttgggggtgtgaaggtcttaagaaaaccatttggaaacttatgaatggtgatgagaacagccccattgaggaagatctcaaatccagcaatgcacattgcatctcatacaaaataaaggatcttagtaaggcaaaaaaagttgatgagttgaggcagaagcttaggatgagaggtctacgttgtcatcctatgtactgcagggggtcatctagaatgcatgtgattcctcttcttgcatctagagcccaggcactcaggtatctctttgtacgttggaggttgaacgttgcaaacatgtacgtcatccttggagaaaccggggacacggattatgaggagatgatttctggaactcacaagaccataatcatgaagggagtggtgtctaagggttcagaagagttactaagaggtccaggaagctaccaaagagatgatattgtcccaaatgagagccctcttgttgcatccattactgaaacaacacatgaaaacattgctaatgctttgaagcaactttccaaatctggaggaatctga

SEQ ID NO: 22812 - DNA, 540 bp, Glycine max
  Peptide Sequence Number=SeqID_114497
atggactcaaatttggaaggaaaaaatattgaaagatgttgtgaaattgaaaaagagaattataacagcaaaggccttacttgggttagtgctaatgatgacagcagttccaccaaaattgcagctatttggaacaggattcttttgataatacttattgaaggcataagaagcatggtccctgatggaatttgggttgcagttgggcttgcaatgcaccagcttgcacctgaggagattggagaattcacagtggtgggagtggtaaatgggattgtggaggctggagagactgtgtctggattggaattaggattcaggaatggagatgttgaaatggtgggagtggttggaactaagtttggaatggtggtgatgggagtggttgtgagagacaaaggagagggtttaagaaagcaaaaatggggtgtggtgagggagagtgttggagggtgcaagcaagagaaggagcaaaaaggaggggaaaaggtgacgaagaaggttgaaaacgaagtaaaggaagaattgtttggaatatag

SEQ ID NO: 22813 - DNA, 352 bp, Glycine max
  Peptide Sequence Number=SeqID_114498
tgaggaagcaaatgaagtctatggtgattcttctttgcctctaactgatgtggcttcagaggaaactgtggagacaagcgttctaaaatcagatgagaatgaccaggttgctccaaccataattgagaaatcattggattttgagccaacattggatgagattgaggaaccatcaggtggtcaagaagagtcatcctatgaaagtgccaagcagtcttttcaaccatcaccaagtgttcctgatgctgaaagcactgaaaatccgaacattgttcctgtggctcaaagggaaaacacctcttggaagagttgctgcggactctttgagattatgaggggtggtgatagataa

SEQ ID NO: 22814 - DNA, 2508 bp, Glycine max
  Peptide Sequence Number=SeqID_114499
atgacagttttacactgtcatccaatcacaatccaacctttatggaataggctggaagtcttggaagaagcggtgagtgcccttccacagaggggtggtgaagtaaacctgacgttggggggtattgacttaaacaattcagggagtgttgtagttagagaagacaaaaagcttcttacagtattatttccagatggacgtgatgggcgagcattcacccttaaggctgagacatcagaagacctgcttgaatggaagacagctcttgaacaagccctcgcacaggcaccaagtgctgcccttgttatgggacacaatgggatttttcggagtgacgcaagtgattctattgaaggctctttccatcaatggagggacaaacgtccaattaagtctctggttgttggaagaccaattctgctggcactagaagatattgatggaggcccatctttccttgaaaaagctcttcagtttctagagaagtatggaactaaagttgaaggaatactgcgacagtctgcagacgtggaggaagtagataggagagttcaagaatatgaacaaggcaagactgaatttggtcctgaggaggatgcccatgttgttggtgactgtgttaagcatgttctaagggagctgccctcttctccagttcctgcttcatgctgcactgctttgttggaggcttataaaattgatcgcaaggaagctaggattaatgcaatgcgctgtgctatattggagacttttccagagccaaatcgacgtttgttacagagaattctgaagatgatgcatacaattggttctcattctcaggagaatagaatgactccatctgctattgctgcttgcatggcacccttgctcttacggcctctgctagctggagaatgtgaactggaggatgaatttgatgccagtggtgatagttcggcccagcttcttgctgctgctaatgctgctaataatgctcaagcaattattacaactttgttagaggagtatgagaatatatttgatgaagaaaatatacagagatgttccatgtcagcagattctcaggttgaaaacagtgggagtgaagattcaactgatgatgataatatagatgtgaaagaaaatggttaccatgatgcagagaatgaagttgatcaggagacagatgatgatgctgatcgtattcagagtggaaaattgagtgagagtagtggttatgctggcagtgatctttatgattacaaggcatttggaggtgatgattccgatgttggatcctccagtagtaaccatgctaagactgaaaatgctaatcttaatgctgttccagataccccactctctgaggatcaaaacaagcaaagaaagggcagtgaaaacccagttgatgagaatgatgcttcaaatttgttgccttcaactgaatcttatcgatccatgggtgagattttatcttctatggaccccggcaaccatttacccatgccagtgattgaatcaggttctggaaagcaaacaagtaaagctagtagtgctagtttcagttctaagcggtcgacattctggggaaggagcaatccaaggaagacaccgtcagtggaatcagttgattcttctggagaagaggagcttgctattcagagactggagattgcaaaaagtgatttgcaactcagaattgcaaaggaggctagaggcaatgcaattttgcaagcaagcttagagagaaggaagcaagctttgcatgagcggcgcttggcacttgaacaagatgtttcaagattgcaagaacagttgcaagctgagagggatcttagagctgcattggaagtaggcttgagcatgtcttcaggacagctttccagttcacgtggcatggattccaagacaaaggctgagctggaggagattgcacttgctgaagctgatgtggccaggttgaagcagaaggttgcagaactccatcatcaacttaatcagcaacgacagcatcactatggttcacttactgatgtaggcgatcgataccaacatgcccaaaatcatcctcaacagaggtttcttcagcaagattttgattcaaccctggcctttgttaatcacgagaggaaacaaaggactgaggagagtttgttgggcactgattggagaaatatcaaaggacaagtattggcatctggtagacagccttctcgaaagcaatttttagagtcaagtcctagcgattccaaaagtaccgaggcatcaacaagcatgtctgtcgatgatctcggtgcccttgattcggcctctgtgccttccacctcaagagcagcagaggtgggggaatatgcaagacatccatcagtagcatcttcaacattagtagagttaactactcgtcttgactttttcaaggaacggcggtcccagttgatggaacagctccataaccttgatttgaattatggttctacaacttcccaagactttgtctataaaccgtcgtcgccatcatggagttga

SEQ ID NO: 22815 - DNA, 114 bp, Glycine max
  Peptide Sequence Number=SeqID_114500
atgcagtggattcatatcaatttagctgtcaaaggtggttgtggtaactgtctcaagcgcaatattgctgtcacaattacagccagcattattgctggtgcacccagcacttaa

SEQ ID NO: 22816 - DNA, 1335 bp, Glycine max
  Peptide Sequence Number=SeqID_114501
atgaagaaactcagagatgagttgaccagagcgctaatagaggcaaatgatggcaatgctaatgaaggaggagcaatgtcatttaacgagcttgtgaaagtgttggcgttaaaacaagacctcaaggcatttgctttcaagaccaaagccatgctgtcacagatggaacgtgaggtgcaatcagcaagaaagaaggagtcacttaattggcatatagcttcacacggtgttcctcaaagtctgcattgtctttgtttgaagttggctgaagaatacgctgtaaatgccatggcacgatctcgtctaccttctcctgaacatgtctctcgccttgttgaccccacctttcaccacattgttctcctaaccgacaacgtccttgcagcttctgtggttgtaacctccactgttgaaaattcagccaaccctggaagactagtctttcacgttgttactgacaagaaaacttatactccaatgcatacttggtttgccatcaactctattaactcagcagttgtacaagttagagggttacaccactgtgattggtctaaagaagtgaacgctggtgttaaagagatgcaggaaacaaatcagttaatttggaagcactactacaacaactataaagaaaaggagcttgaccatagtgaagagcatgacagatattttgaagctttaaggcctagcagcctttccttgttgaatcatctccgcatctatatccctgagctgtttccagatctaaacaaggtagtattgctggatgatgatgttgtagtacaacatgacatatcttctttatgggaactggatcttaatggcaaagtcagtggttcagtgttcaagtcatggtgtgagaacagttgctgccctggaaacaaatacgtcaacttcttgaatttttcacatcctatcatatcatccaactttgatggtgataagtgtgcatggctctttggcgtgaatatatttgatcttgaagcttggaggagatcagatattactaagacctatcatcaatggttgaaacttaacgtccagtctgggttgacattatggaatcctggagtgcttccacctgccttgattgcttttgcgggtcaagtgcaccccatagattcatcatggttcgtcactgatttgggttatcgccatcgatcagaagaaattagcaatagcatagagagagtggaagctgctgctgttgttcatttcaacggcccagcaaagccgtggcttgaaattggcttacctgaggttcgaactttatggactagatatgtaaatttctccgataagtttattagcaagtgtaggattatactgtga

SEQ ID NO: 22817 - DNA, 192 bp, Glycine max
  Peptide Sequence Number=SeqID_114502
atgacaattcacagtcaacgcttacggagtagattcagtgtaacgaatggaatgtcacgtggggagaaggttaacaagactgctgagtcatcaagtgagagaggattgcataacaaacttgctgattttgaggaattgggacgtgggaagagagagaagaaaccaagttggaaaataacggaatcccactag

SEQ ID NO: 22818 - DNA, 690 bp, Glycine max
  Peptide Sequence Number=SeqID_114503
atgagggtggcggaggaggagaaagcagtgttggaacaagtgttcgggtcgtcatcatcagaagaatgtgattctgatggatacagcgagagcgagagcgagtgggagcccatctcagaagtgaatggcctatggctgtgccctcacttcctctctccacgccgccagtctcacatactctcctccatccaagccgacaattggttcccctccccttccatcaaccaggccatgcgcttcggcctacaacacctcccttcttgggccacccctctggcccactccattcgccgctccgtccaagcccaggcccaagcccaaacccacccaccgcccttccccctccacctcctccacagagaacctctcttcgaccagatgatcgccaacgtctaccagcccggcgaaggaatctgcgcccacgtcgacctcctccgcttcgacgacggcatcgccatcctctctttagaatcttcctgcgtcatgcacttcactcccctctctggttccctttccgttcccgttttgctcacccctggttccttgattctcatgtccggagaagcacgctaccgttggaaacacgaaattaatcgcgcaccggagtttcagatatggcgcgctcaaccattgactcaatccaaacgcacctctatcaccctcaggaaactttgcccctcctctccctga

SEQ ID NO: 22819 - DNA, 1701 bp, Glycine max
  Peptide Sequence Number=SeqID_114504
atggtggcggctacgtttgatggattctccataagggactacacatccaagatgagatccatcgacgttttcaagtgctggccgtttgcatctacctcctcacgtgacgtatcagatgaggaggttcagtcgtggcttccgccgatgaacccgtgccctagatccgacgattctaccgaccaccgcgctcaaaatctggagattccgccttctgctgcggaaaccgatgaagacgacggcgatgtagattgcagcgaagaggaatctgcagaatctatggaatctgagaaatccgcgcctccttccgactcctccccggcgaacaacaacaacaacaatgaagacgagaaactggagatggtttgtccggtgtgccgcgaattcaacgccgcgacactcacggcggtgaacgcgcacatcgacggatgcctcgcgcagacgatgagagaggagcgtcgccacatgaggattatgaatttgaaatcttcgtcgtcaaagtcgaagccgtcgaagccgctgaagaaacgttccatagccgagattttcatggtggaggagcagccacatctgccacagccacagccgcagcctcagttgccgccgcaaatcgagagcgtgttgaagttctggccgttccgcgagggcaaggtggacgatgtatctattaccgttacgaagttcgagtggctttctcggcgactggaggcgctgagatccacgcgcgtagacggtgagtccgccaaatcggaccaaggagatatctcggaggagaagatggagatgttgtgtcctgtttgtcgagatttcaacgccgccacggtgacggcagtaaacgcacacatagatggttgcctcgcacaagctgtcagggaggaacgacggcagatgagaaggtcgaccggtaattgcaagcccatacctaagacgccgaagaagcgctcgcgctcgatcgcagagattcttacagtggcgccaccgatcgaagctggcaaaaggaaagcgattcaggttgaggaagaagatgaggagaaatccgattatggctattcaggtggagattcaactagggccgccactcctgctccttctgccgctgttgctactcccgttgcttcggtaattaagaacaagaagagtacgatgaagaataggaacaagaaaaagttgatgaaggtgaagaagaagaaaagcaaggtggagaagcacggcgatagtggtgtgtggttcgtgaacaatgagaagaagacggttgcgagcaagaagaagaagaagaaaaagaagaatgtcttcaacaacagaccaactgggaacaagcgaaatacgcggcaagtaaaagttgggaaaggagagttacaagaaaggaaaactaagacaagtgccttcgtgcgcggaagggattcagaaggtagtgaagcctgtaagaatgttgctccagctgtagtgtgtgctgtgtgtataatcagtacaagtaccctagctagaaggggccactcatgggttacgagtttttcggacgtagagaggttttatacgcagcttacagctggatgtattttggctagtgggagatctgtaagtggagataatttcgagtgtctattagaacccaacctaggaggtctatatagaaccaatggaaatcggaaaacaatgtcagtttgtggttacgctggccgaaatttgaaagtggaagtaaattag

SEQ ID NO: 22820 - DNA, 396 bp, Glycine max
  Peptide Sequence Number=SeqID_114505
atgtctctggatgagatctctcccttaacatttagcattggaaacaccatgaaacgtatatctgttatagtttcttcaatcattatcttccacacaccagttcagcctattaatgctctaggagctgctattgccatcttcggaaccttcttgtattcacaggtggaggaacctacactgtctactactactgtgcaaactgtcttgggattatacttcaaaagatgttcggtggaacaatttgatttttttgctgtggagggccttgaaatatcaagaaaaagattggtggtaagaaagcaaatcagtagggttgaggagttgagaattatccccgaacttctttacatgtggtcatacaaggtcaccgataaggaagttagttttggaatgtag

SEQ ID NO: 22821 - DNA, 1392 bp, Glycine max
  Peptide Sequence Number=SeqID_114506
atgagcatcaattcgttgccaattgaattgcttataactattgtttcacttcttcccttcaaggaagctgtgagaacttctgtcctctcgaagaaatggttagagttgaacgtttgcaagttcacaaaaaacatagagtttgatgaactcttttttgttaaacctgatcaacctaatgaaacaagagaaatccaaagaaggacttttcttgacttcattaatttgtggattgaaaattacaaaggaactttggtggagaagttctcttttaggttatcaaatcctagaaatggtggtgagatcattgatcaatgcgttgcttttgccacagaatgtgaggtgaaggagttggaacttgactttgctgatccaaactggaatgaaaataatatctattatggtaattatgaggaggcgctgtttaaattgccagcacgagtttaccagcatggtagccttgagtctttgaagctatattcatgtagttttgttgagactgaagtgcttaactttcatgcactcaaagaagtttctttgggttggatggaagtgagactcagtgctatcaaagctttgctttccaattgtaacatgctggagagtttgagttttaaaaggtgttggaactcagacaagtttgacctaggcgaagaagaacacacaggtcttagaaagcttgtcctggacaagtgccgctttgaatttgatgttttcaaagtgaatgcaccagatctaaaaattttccagtactgtgggttaatgaactttttcatcacggaaattcattcacccgcaatggaagaggcaaatattgatttctctccagaatatggattcgaaggactaggtcatcctctttataatctggtggaaaatctatttattgttagagttttgactgtatgcagttttgttcttcaggttattcctactggacccgaactgctaggttttcaaagtggcatgcttgtgcaacatttgatcttgaaaacggctttgcacaagaacgagtttttgggaatcacattcttcctcaacagttgcactatgttagagtgtctcaccattgatctatgttccgaaaaagatttgtttgattatgaagcaccttttgtgtttaaccgcaagcgattctggagtgacaatgtgggagtatatgaaagcttgagtttaagtctggaagtggtggagattaatgggttcagtggaactgagaatgaacttcttgtgctcatgtatttcattgctaatggagatatgctgaaaaggattagtataaacatgttggaggatgattctggtaggaccatggaacctcaaatccgtgaaaatgcagaatttttgttgacagttccaagggcttcaacaaacttagagatatcaatctgttaa

SEQ ID NO: 22822 - DNA, 291 bp, Glycine max
  Peptide Sequence Number=SeqID_114507
atggtggttgtggtggatttgggaggggaaattcaacagggtagtgcagctgatgttgccatgtgtgctatgttgcaaatttccaagaataaacggttgaaggagcttgggtggaagttacttctacaggttcatgatgaagtcatattggaaggaccaacggaatcggctgaggttgcgaagtccatagttattgagtgcatgtccaaaccctttaacggcaagaatattcttaaagttgacctctctgttgatgccaagtgtgctcaaaactggtactctgggaaatag

SEQ ID NO: 22823 - DNA, 2512 bp, Glycine max
  Peptide Sequence Number=SeqID_114508
gcatttacttttagggcccttatttaagcttcttagcaaggtattttcagaagaatgggtgaatggtgccttttccccggtgataagagtctttgcaggagaagttttggagcatatgcttgatattctagaagttattggacaagcagctgtcacacagattgacagtcattcgaagcatgtttttgaggatcttatatctgcaattgttccgtgttggctggctcagacagatgatgtggagaaattactgaagattttcatggatatattgcctgaaattgttgagcacagaaggctgtcatttgtgttatatctattaagaactttgggtgagggtaaaagcttagcctcattgcttatcctacttttccgttcattaatttcaaggaaagctgcctgtttcctttatgttgagacacatgctttaacattttatactgaggagtgggaatataaatttgcagtgcaaatttgtgaacaatatacaagtacgatttggcttccttctttagtcatgctgcttgaacagaggggaaatagtgatgttgaccaggcactgtttctggaattgtttattgtaatgcaattttctttgcaaaagttgcaagatccagaatttgtgtttaagttgaaatcaggagaagataccacagtcattcagcttctatttttgcctgacccatgcccaataatggctaacagatacatacagtttcatgctgagatgtttttggttttagtgtttaatgttgagatgctgtttttggtttcctattgtgatagcaatggcattagtgttatgaacatattcataatcaaaataaatgtgatcgcttcttcaatatttcagagggcgttgggtgagcttatggagcatgttgttttactcttgcaacttgtagatgcatggaaaaagcaactgaatttccctgtaattctgaggagagagttgaaggaaactatgcgtgcggttgtaaggaatctaacaacagtcatgatacctgccggatactttaagagcataattaaattgcttcaccatgcagacaagaatgttggaaaaaaggctcttgggctgttatgtgaggcttcgagaaatcataaaaatgtcagcttaaagcttaaagacaataaaggttcaaggtcaactccaagttttcttttgcttcatatgaacgaaacttctcaagaatcacttaataaattgtgtttagaaattatgcgagtacttgatgattcatcgaatacctccttgaaagtggcagcagtttcagcattagaagttctggctgaaagatttccttcgaataattccatctttagtttgtgccttggatctgttacaagacatattgcatctcataacttggctgtgacttctagctgcctcaaaacaactgctgccctgatcaatgttctaggtccaaaatcactggcagaacttcccaagattatggacaatgtgatgaagtcatctcgtcgagtattggctgatatgaaacccgaaaccattgatgttttatcagcctcaaatgaatcccatttttatgttctcatcactttggaggcagttgtggacaagcttggtggatttttaaatccgtatcttacaaatatcatggagcttctggtgctttatcctgaatatgtttcaggagtggatgtaaaggtggagtctagagctcatggaatacgaaagcttcttgctgaaaaaattcctgttcgacttgccctgccacctttgttaaaattatacccagcttccattgaggctggggataaaagcttaacaattgtatttgatatgttgggaaccataattggtacaatggacagatcatctattgtggcattccatggaaagatatttgacctttgtttggttgctcttgatctgcgccgtcaaagtcctccttcagttcaaaacattgatgtagtggaaaaaggtgtgcttaacgcaatgactgttctaaccttaaaacttactgagagcatgttcaagcctcttctcataaagagtattgagtgggcagaatctgaagtggatgaaactgcatccagcggaagcattgatagggccatatcattctatggcatggtaaataagcttacagagagccatcggtcattgtttgttccttacttcaaacacttgcttggtagttgtgttcatcatcttagcgatggtggagatgtgaaagtgtctagagtgaatcggaagaaaaaggccaggattctagatgatggcaatataaaagaaataggcagtgtgtctatcaagggctggcatctcagggctctagtcctgtcatccttacataagtgtttcttgtacgacactgggaccttgaagtttcttgactgctcaaatttccaggcaagtgaattcttttacataataagaactctcatttgtttcatctatttgtatccgataccaaaacttttaaatacttcactgatacgtgtctgtgaagtatcaagcctttttaaaggtgtgaaaatctaa

SEQ ID NO: 22824 - DNA, 112 bp, Glycine max
  Peptide Sequence Number=SeqID_114509
atgactgaagggtatagaaaagttctcctccaagttcctcagccagataacagatatgtatcattagatttggtcaatatagctgatggttgggtggacttccctgatatag

SEQ ID NO: 22825 - DNA, 549 bp, Glycine max
  Peptide Sequence Number=SeqID_114510
atggtggcgaagtggcgtggaggagatgggatagggtggtggcacaacgcagaggttgtcaatgatggtaatggttgcatgattgtggtgagaggactgtcaatccgcgggggattggatcaaatatccttccctaggaaccaaatgaacaaatgcaaccacaaatatggtgtggttgcatttgctgagagctccaaggggaaggctacctggcttagagatcctgatcaagatgtggacatcatctcggtgcatcatgcttcaggtctcatctgcgaaataaacctaagcaaccctctctccacttctgatgatttgcgcttcttgggaacctttcacgtgttttctgtcacaggcttttacaacaacaacctttcagcttcttcatcccccaacaacaacagcattccctattcatcctctgcaattcaattcacgagaggaagccctcccaaactctttgaaggtcttattggaggcaagcttataggtgtagaacctgtgcaggtcatggcttctatcgttaagaagcgaacatgttctacttga

SEQ ID NO: 22826 - DNA, 579 bp, Glycine max
  Peptide Sequence Number=SeqID_114511
atggaggttggcagtgtgcgccaggtggtggtggaagttgtgctagaggcgaggcgtccagcattgtggctctggctttggcacaatagggccctaggaagcgagcgtagtgagatccttccgcaacaacttccatggggccccatcggtgttcaagacgaatcctcgttcggcaaggacgacgagggtgtcaaggatgtcgttgatggtctctgcgtcaaatctgataacatgcccccgcaccttacagtacttcagagcaccgtcctctgggtcgtagattacccggtgccattgcctccattggagctcttcgtaaaattcattgaacatgcctgtagagagctccacattcctctccggaggaatcccatgtggattcccctccttgagtgggcactgctcggcgtttccatgaggccatccgaaaaaataggtgcgcatttagctcctagtcttgaggcttctgggcttagcgctacagtctcgcttagcgcgagctactcgctaagcgatttcatccatctatatgagtgtgctactcgctttgctcgcctagccatgctcttcaattgctaa

SEQ ID NO: 22827 - DNA, 360 bp, Glycine max
  Peptide Sequence Number=SeqID_114512
atggctacagccaggtgggcactcaagcatcccgtttatggcattgtgatactacggacgacgttcctaaatgaaaaactctacacagtcccggaatttcaacaaacattattgacaacaatgaaacaaaaaaaaggaggtgatcctgatgtgatcaagtgggcaagactagaagttaatgctttggaagcaccagaaatgcttgatgatgaagcttgtccaccttccaatttgcagtctcatctcaaccttgcactgcttgacgtggaggacgactcgctctccatgtgcagcctcgccccaaaacgtctcgttggaggactcccccagaggccggtggagccgctcatcaagctttga

SEQ ID NO: 22828 - DNA, 371 bp, Glycine max
  Peptide Sequence Number=SeqID_114513
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccgggtaaggctaaactgaaaggacaagttttggtgactgcgctcctccaagccagttacctcggttcaagagttggtagctcagaagaaccttcgaaaaaccgccctgcaaggcg

SEQ ID NO: 22829 - DNA, 201 bp, Glycine max
  Peptide Sequence Number=SeqID_114514
gtcagacatgattttgcaattcctaacggtgagaatgctcgaaattgggttgcgaatgtggtgctcaaatttcacgacgatccaacggttaatgagtccgagatcatcgtttttctgagacaagttttgtgggctgcgggaaaaagaaagggttttgagaggagaaggagaaaaacgaaaatgagaggcaaagaaggctga

SEQ ID NO: 22830 - DNA, 579 bp, Glycine max
  Peptide Sequence Number=SeqID_114515
ccgccgggcaagacgcggcaggaggcaccgcgccacttcctttgtccgggctggcttaaggccatttgtgtcgttcatcgccacaaaactgtaacagttgcgaatacactattcgcggcgattgtaggaaggcgcttaactaagtgcaagaataattgttgcactttatgtgctattcggtcggatgttaaaaaggcccgtttcaggctgcgtggaggtaacccgatgaacacgggcgcatttatgcatgatttactcgactggatcgacaacaaccttgatagccggctggatattgagtccgtcgccaggcgctccggctattcgaaatggcaccttcagcgactgtttaaagaacatacgggctaccctctcgccggatacattcgcgcgcaaaagctgcaaaaatccgttgagcgcttaacccacagcgacgaaccgattctgaacgtggcgatcgcgttgggttttgactctcagcaatccttcaaccgcagttttaaacggcaatatggccaggctccaggcgcatggcggcgcagtgtggcctgccgtgaaacccagcaggcgcacacgtaa

SEQ ID NO: 22831 - DNA, 389 bp, Glycine max
  Peptide Sequence Number=SeqID_114516
acttcacactttatgcttcggggtcatacaatgctcaatggaatgccccagggctcctccacgataagcacacgttgcgttcgagtcgtatcctcagaaaaatggaggttgatgaaccttggttggggctttttgctgcaaaattcctttttgttggtgtttttttggtttgtgctaaaggtggtcttcgtcattggaataatgacactgttgggtttggtgggaaacttggccgtataggaatggcagtcacagcatgggtttctccctctttctcaccctctcatttgccccagtttctcagtcgtcctagtaggatgatcaatttgcctcttttcggacccacatcgatcctttcactggcgaagaccaaatccgcaaagctttga

SEQ ID NO: 22832 - DNA, 267 bp, Glycine max
  Peptide Sequence Number=SeqID_114517
atgagtcattattcaactagtgttaatggcaagggtactagtcataaagaccctttatctcgaatcttagatgagttgagttccctcaatagtcataactcttgcaagagcctaagtgaagaacttcgtgactattacgaaggaaggcataggtcacatcttagacctcactcccatagaagagaaaaggaaagaaagcctcaagaggctaacattaacctctcatacttccatgggaaggacaatgtggaggctaacttagattag

SEQ ID NO: 22833 - DNA, 196 bp, Glycine max
  Peptide Sequence Number=SeqID_114518
gatgatcacctatgggggggcaattacgtgcgcaactggtggtctcgacgaactctacatgtccttattggatccatggatggatgatgagaaattgttgaatatggatgatggcgatgaggcgggtcgttacaaatctaatcagcaacagggacagtggagaactcaccctggtaatcagttcaataaagactaa

SEQ ID NO: 22834 - DNA, 806 bp, Glycine max
  Peptide Sequence Number=SeqID_114519
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcggaattttaatgtatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 22835 - DNA, 270 bp, Glycine max
  Peptide Sequence Number=SeqID_114520
atggctaccagatgctatggaagggcctactccaatttccgcccttatacatgctgctactatggtatgaatatacacggtagtattatggagctacctttctattctttcacaagttcctatgttaatggaaaaattgtggcttctatttttccgacagcaatccaagggttatatgatgttagctctcgccgtatgtgggatcttttcgccctagcttttggttcacacgtcctattgcggcaaatgcttgtcaaaaagcatttgtaa

SEQ ID NO: 22836 - DNA, 459 bp, Glycine max
  Peptide Sequence Number=SeqID_114521
atgccagctctagatgctcaggcagctgctataggtgcactctataaccttgctgaagttaatatggactgcagattgaagattgctaacgagagatgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 22837 - DNA, 207 bp, Glycine max
  Peptide Sequence Number=SeqID_114522
atggataaagttgatatctttgtccctcatcctctcacaaacgcatgtttgcttattcaactttcaccggagtgtgggtgtaagccattggtctgtttgctcaagcaacctgcgctcctgagtgttgacttccaagaccgttcaatcagagattactcatcttgcacggggtgccgtaaaacaacgagcaaagttcaaaacaaataa

SEQ ID NO: 22838 - DNA, 342 bp, Glycine max
  Peptide Sequence Number=SeqID_114523
atgattatgaggggccaagacatttatagtagccaagatgaggctactacttcaccttcctctagtgaaagtgaagaagcaaaaggggaggaatctagtgaagaaatctacccccaagaagaaggacaacctttaatggttaaggagaagtgtaaagagacacttgttagcattgccacacctcttgggcttgagtttattcctcaagtaaaggagttgttggatgagagtttggaaggcataggtcacatcttagacctcactcccataggagagaaaaggaaagaaagcctcaagaggctaacattaacctcccatacttccatgggaaggaaaatgtag

SEQ ID NO: 22839 - DNA, 141 bp, Glycine max
  Peptide Sequence Number=SeqID_114524
atggagtcattgaagatgtttggtgaagacatagaagaggatgctgacattcctctcattcttggccacccattcatgtctactgcaagctacgtggtggacatgggaaagaaaatactgcagatgggcatagaagattaa

SEQ ID NO: 22840 - DNA, 195 bp, Glycine max
  Peptide Sequence Number=SeqID_114525
atgccgcaacacaattcgtctcatagccactacatgcaaaggcctccacaacctgctgccttcaattctacgcttggtaatcgattacaccccttggtaatcgattaccagaagccctcatggcttcctgacctcgttttcaagcctggtaatcgattacaccccttggtaatcgattaccagagaccatcttag

SEQ ID NO: 22841 - DNA, 444 bp, Glycine max
  Peptide Sequence Number=SeqID_114526
atgccaatctccccctgcagatgtatcgggatcgcgcccaaaagacgcccagtggacccgaagaagtccaacagggccctggggtttctagctctggttacgagcctctgtcagtcctacagggtgcccttccccccagcgaggtcatgccatcgtgacataggtaagggtcacgcccgcaagacactcggtggacacgaagaagtacgacaggtcttggagttgccagctctgattacgggcctctgtcagttctacggagtgcctgtcgcccccagcaaggtcatcagcccccctactaatcgagctttcatcaagaagtactgcgcccccaggcaggcgcagggcgaaacaccacaacagcctggggatggccagcagcgggcaacagacgcaccgccatcacctctagagttcacctcagctcatccacaaaaaggttag

SEQ ID NO: 22842 - DNA, 144 bp, Glycine max
  Peptide Sequence Number=SeqID_114527
cgccaacggaagagagcctctcgcctttccttgtgagagatttcagcgtgcaaagtctcaaggttatacaaagagtccacaaggcgtggagaattccgttgaggaaagacatgttggacaagtggcctcagatatcttaagaag

SEQ ID NO: 22843 - DNA, 444 bp, Glycine max
  Peptide Sequence Number=SeqID_114528
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttcccctggcggctcctcgtgcgctctcctgttctgcctttcggttaccggtgtcattccgctgttatgggcgcgtttgtctcattccacgcctgacaactcagttccgg

SEQ ID NO: 22844 - DNA, 528 bp, Glycine max
  Peptide Sequence Number=SeqID_114529
atgacgggagattcatcaaagttcacacaggtctctcccaagaaaagtgggcatgttacttatggtgataacaacaaagattctaaaggaaaagggaaaggaagcaatgaagatcctctagaagaagccaaatcaaattatgaacttccaaaagaattggacataaggagattggagttgcaaaaggaaacaaatcaagaagaaaagataagaagaagaagggaatatgctcttaaagctcatcttcatccagaggaaagtgaccatagaagatcaattgacttagatgaagatgaagatcttagctttatcaaagatgttacaaagtgcttttctaaatggcttaatcaaagaagacagtatatgttgaacttcaacctccagagaaagatttttctagagaagtccacactattaaaagagaaagatattggagataagaaggcaaagaaggcctgtatcacatgggattataacgacttagaatcgtctgatgattctgaaaaagaatggttaatctatgtctaa

SEQ ID NO: 22845 - DNA, 462 bp, Glycine max
  Peptide Sequence Number=SeqID_114530
atgaccatgattacgccaagctcgaaattaaccctcactaaagggaacaaaagctggtaccgggccccccctcgaggtcgacgaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 22846 - DNA, 279 bp, Glycine max
  Peptide Sequence Number=SeqID_114531
atggcgagcggagtggataaacgtgcaaatacatattatgcgccctttatcattcaggaacaacaagctaaattttgcgccctttatcattcagatttcgcaagttgggtgataaacgcgcagagacaaattttgcaccccttgtcattccgcacaccttttcactacccagaggtgatcgtgtccaacaaaacgcggagacaaattatggtcattctgcgtcttgtatcaaccgagaggaacaaattcgacagtatcgggatgatgtgtcggtattga

SEQ ID NO: 22847 - DNA, 465 bp, Glycine max
  Peptide Sequence Number=SeqID_114532
atgcagaacagcgctttgaaagcctggttggactcttcttacctctctggcgcaaaccagagctggatagaacagctctatgaagacttcttaaccgatcctgactcggttgacgctaactggcgttcgacgttccagcagttacctggtacgggagtcaaaccggatcaattccactctcaaacgcgtgaatatttccgccgcctggcgaaagacgcttcacgttactcttcaacgatctccgaccctgacaccaatgtgaagcaggttaaagtcctgcagctcattaacgcataccgcttccgtggtcaccagcatgcgaatctcgatccgctgggactgtggcagcaagataaagtggccgatctggatccgtctttccacgatatcgaattcctgcagcccgggggatccactagttctagagcggccgccaccgcggtggagctccaattcgccctatag

SEQ ID NO: 22848 - DNA, 138 bp, Glycine max
  Peptide Sequence Number=SeqID_114533
atggtagaagtctccacagaggccattgcctccattgcccaatattctagcactgttgatcttcggaggagtcctctttccgaatgtggatgggttggtggacctagcagcgatcgacgcttttcttgcctatcataa

SEQ ID NO: 22849 - DNA, 390 bp, Glycine max
  Peptide Sequence Number=SeqID_114534
atgccgtcaagatttcgggcggatagggtatggcccggccgtattagccagtgtttcaccagcgctggaacggtgtccgaggaggaggtggccgcaatagaagaggagttccctcaagacccaccaagttttgtgcaaccatgccaccccgattcccaagtggggaactggcgcgtgataagccagtcagaagtctataccgctaattcaatatatgagggtcgattctttgaggatcctaacaacgagggtttgacaatcgatttcaatcgagatataagccaaacggtaaatgaggaagaggaagaggacgtcctgtcaccagagttggagaggttggtcgctcaggaagaacgtgaaatgaatcctcaccaagaagaaaccgaattg

SEQ ID NO: 22850 - DNA, 237 bp, Glycine max
  Peptide Sequence Number=SeqID_114535
atggaagcatggaagccagcaaaaagagacaaaaacaaaacagggaaggcaggaaacaagggaaaaaaaatgaaagaattgcttttgttggaaacggtgcaactcaatagttgcttcttgaatgggaaaggtagtgatgatgtgaagagtctgaacgtgaatagttgtggaagtaaccgaacgttgagccctaaatgggttaattttttctatgaggttttcgccttaatggattaa

SEQ ID NO: 22851 - DNA, 162 bp, Glycine max
  Peptide Sequence Number=SeqID_114536
atgaagaagatccaaggccttcaagctccacatggagctacatcatgtgtttcctacatgatgcctatgaagaagttgagttgtggtgctgagttgtcactgcattttgttggatcaagtggcctcagaataattaagaagggggggggaaggttgaattaa

SEQ ID NO: 22852 - DNA, 1710 bp, Glycine max
  Peptide Sequence Number=SeqID_114537
atgtacggctcgcaggagctgaagagccgcgtcgccgaccccagctaccgtaacaactggggcttttacgacgatacggtgatggatgaagtgtttgaaaagtacgaggagctgtcgcgtcagcagaaacgctttgcgctgtttacactcaccgtggacacccatcatccggacggctttatttcgcgcagctgtcagcgcaaaagttacagctatgacggcaaacccaaccagtcgtttagcgcggtggcctgttcccaggagcacgtggcgcgcctgattgcccgcatcaaagcctcgccgtggtttaaaaacaccgtgattgtggtgagttccgatcatctggcgatgaataacacggcgcatcagtatctgatcaagcagccgcgccgcgatctctttatggtgatccgtggcgatcagccgcaggccgaggtgctggacggcaagcgcagcacgctggataacggcgccacggtgctggatattctcggcggggataacgcgattggccttggccgcagcgggctgtcttcggcctcgctctccagccagttcgatgacatggcgaagaaggtgacggcgtggaaagccgatatcattcagctgtggaatttccccagccagatgaagacgttcaccatcgaccagcccaaaaatacctttagcttctcgggcgcgacgttcaggctgccgatcctgttccgcgtatccgatcatcaggtagagccgctgccggaaggcgaatacgccgcgccgctgcgcttccagctggccgattttgccgccagcgataagtttgtctgggtcgatcgctgcttcaaaatgggccggctgtggcagccggcgctggcgctgtcgaccgatctctgtctggcgatgggccagaccggcggacaacccacggtgacgcgcatcgaccagccggtgtggcagggcaaagcgcagttcccgcaggtgaaagtcagcgcggcgacctatcagcttaacgagcagcaaatgcgcatcgaggacaatgccattcgctaccaggcggacagcttcctgctgaccgtaccgggcgcgccggccagcgtgaagcgctttagcggtatttcacggccggaaagctgggggcgctggtcgaacgccaacctcgcgccggaggtgaacattgaatatgtcgatccgctgccggcgcgttttgacgtggtgatcaccgcacgcgcctatggggctaacgcctatcgaccgattccggtgcgcgtcggcgagcaagtgcagcagctcaatctgggtgacgcgttctccacgcagacgctgcatttcaccaaccctggcgccagccgcaacctgatcatcacgccgccagaaccgcagctgtctaatctcggcaacattaccggccaggatccacgcaaactcggtatcggcatggcggaaataaaaataattccgcagcctgaaaagcaacaggaaaggcgaccaggagcaacagggatgataccgacgatgatgaacacccataaggcatttaaagcgctgcagcaggcgggcgtggccgatcaccaggccgaagtgatggtcgacatttttgccgaaatgcagcaggaaaacagcctgactaaaacgcacctttcgcaggccatggaaggcgtgatgcgggcaaatcacgccaccgcgcaacgtgtcgataaactggcacagagcctcaggcattttgaaaatgag

SEQ ID NO: 22853 - DNA, 213 bp, Glycine max
  Peptide Sequence Number=SeqID_114538
atggcacgtagtttgtttgctccgtgcccctatttaagggacctatacgggagagagctaactaggcttttagtgataacccccaaggtagtcatatctctcttgatggtttctagaggtatcatccccttcgaagaacatactgcagcagtagggactactagcaacaatatgttttcaaagagaaaaactctagatgagggttcactgtaa

SEQ ID NO: 22854 - DNA, 477 bp, Glycine max
  Peptide Sequence Number=SeqID_114539
atggcgggcggtgaggatttggcgcaccagcatcgccgcgccgctggcgataaaggtcaccaggaaagcatcgccgccgccgccgttgagcatgctgaaacacccgcaggacaaccccaccatcagcaccaccagccagcgcgggtggtgctcggcgaggatcacgatatgctgcacttcggtcaccacctgcatattgatgccgcgatcgacgttcttgcgggtggtggtcaggcaggcgccgtggctgagggtggtcaacaccaccgcattggcggagatcgagctttccacgctgtccatccccagcgccagccccatgcgggtcgacagctgttccaccaccgtgctctcggcgccgtgctgcaacagcagcagcgcgcattgaatgcacaggcgggtgatttcacgctgttgccggtgcggctccggccggtctgtggcgttagtctgctgcatggtgctccgttgctggcg

SEQ ID NO: 22855 - DNA, 129 bp, Glycine max
  Peptide Sequence Number=SeqID_114540
atggagattaagagagtcgtgaaagatgacaaagatgaacagataaagctcaacacaacaagagaaagttactattgtaccctcaaacagatgaatgaatacttgttcccttatccttctctctcgtag

SEQ ID NO: 22856 - DNA, 270 bp, Glycine max
  Peptide Sequence Number=SeqID_114541
atgtctgtgagctatctcctcctgaaaatctatgtactcatcctccctgagctggacgcgcctctctctgtggaacgaccatcctttgatggccttgaagcgctgctagtgctcggcgctccggaaacggtggctatcaaactcgggggcggcactggtcccttcagtcgcagcgtctctcctagacctcttcgcagaaagctttttcggagcaatttcctgcaaggacaaacgtttggaaagttaatttacaaggaaatgctattttaa

SEQ ID NO: 22857 - DNA, 594 bp, Glycine max
  Peptide Sequence Number=SeqID_114542
atgatgtttgcctttacttctgctggtattaagtttgacaaatcaattaatcattcaagaggacctcctacaataagaattcaaggtcaaccatgtcatagaataggtagtatgttaccgatgcctgggaaagaaccaaaatttgcacaattgtatatctttgacacagaaaatgaagtgcagaataggattaatgcaataagcagtccacataatcaaattcaagaacacattgtttcacaacttagtgagatgctagatgaatacaacatgcatgcaaaaactttcaggatgactagagatagattacaagatgttcaacatggacaactacaaaggatccatgaattacattctagctatctagctctacaataccctctcttatttccttacggggaagatggatatagacctgatattctacatagcagtcgatcagatggagactattccaacaatttgttgtttatggctatactatggttgagtcagaaaggctttcttacatcagaaacaaccaaaaaaaactttgagttgacaagttttgtagcttacaacagtcattggatgatggaagtaagagaggcctaa

SEQ ID NO: 22858 - DNA, 940 bp, Glycine max
  Peptide Sequence Number=SeqID_114543
tacacgtcctcgccatcagaggcctgcacaccctcccctttagaggacttcatgtcctcgccatcagagggctgcacgccctcaccttcaaaagacaacacgtcctcaccatcagagggctacacgccctcagcttcagaggactacacgtcctcgccatcgaagggctgcatgccctcaccttccaaggactacacctcttcgcaatcagaggactacacgtcctcgcctgtagaggactacacgtcctcgccatcagagggctacacgccctcaccagcagaggactacacgtcaacgccatcagaggcctgcacgccttcgccttaagaggactacacgtcctcgccatcagagtgctgcacgccctcaccttcagaggactacacatcctcgccatcagagggttgcacgccctcagcttcagaggactacacgtcctcgccatcgaagtcctgcatgccctcaccttcagaggactacatgtcctcgccatcagaggactacacatcctcgcctgtagaggactacacgtcctcgattgtagaggagtagacgtcctcgccatcggacggctgcatgccctcaccttcagaggactatacgtccaggccatcaaaggcctgcacgccttcgccttaagaggactacacgtcctcgcagtcagagggctgcacgccctcaccattagaggactacacgtcctccccatcagagggctgcacgccgtcagcttcagaggacaacacatcctagccatcggagggctggaagccctcaccttcagaggacaacacgtcctcgccatcagagggctgcacaccctcgcctttagaggactacacgtcttctcaatcagagggttgcacgccctcaccatcagagactacacctcctcgccagcagagggctgcacgccctcacctttagaggactacac

SEQ ID NO: 22859 - DNA, 504 bp, Glycine max
  Peptide Sequence Number=SeqID_114544
atgccgatctcccctgcggaagtatcagttggtctgtgccgtcatgacataggtaaggatcgcgctcgtaagacacccagtggacccagaggagcccaacagggccctggggtttccagctctagttacgggcctctgtcagtcctacagggtgctcgtccctccctgcaagggatcgcgcccgcaagacacccagtggacccggagaagtccaacagggtcttggggtttccagctctgattacgggcctctgtcagttctacggagtgcctatcgcccccagcaaggtcatcaagccccctactaaccgagctttcatcaagaagtactgcgcccccaggaaggcgcatggcgagacaccacaacagcctagggaaggccggcagcgggcaacagatgcaccgccaccacctctaaagcccctcagctcatctacaaaagctagagcgttgcctacgacccgtggtcgaccagcaggcgaccaagtccaaagccaaaggtaa

SEQ ID NO: 22860 - DNA, 216 bp, Glycine max
  Peptide Sequence Number=SeqID_114545
atggaagccatcacaaacggcatgatgaacctgaatcgccagcggcatcagcaccttgtcgccttgcgtataatatttgcccatgaaactgccggaaatcgtcgtcggtacgttcactgccagagcgatgtaaacggggcggtttccgagattgctcaggaagatacggttaacaagggaagtgagagggccgcggcaaagccgtttttcccatag

SEQ ID NO: 22861 - DNA, 534 bp, Glycine max
  Peptide Sequence Number=SeqID_114546
atgaaggtcgacctatcgaccttaaaagatcagatggcttttatcacggaggccatgctaaagcttcaaaaaactatagaagataatgctacggcggccgcttccaataaagctagggaagcggaaccggtgctacagcccacaataaacttggaccgagacagaagcgcgacgggttttaatcagaggtatagtcctcaagcctacccttatggtttgcctccagacttcactccccgtaccgctccagacgatttgagccaagcccctaccttcgaggggcagctccctcctcatgtcgactatcctctgcaagaagatgatgaaggagatgcccatttaggccctctacttcccctcaaggaaccagccccccatgagttgccccaaccaaacatagtctgccatgtcccgtctccatccgcacccgttaaggaattcgttccctttgcaaaagacaagggaaagattgatctacttgaagagaggcagagagcggtagaaggcctcggcaactatccattctcagattaa

SEQ ID NO: 22862 - DNA, 278 bp, Glycine max
  Peptide Sequence Number=SeqID_114547
atgggttaagaccgcagtccaagcagctattggatgcttctgcaggtgggcaaatcaagttgaagacccctgaagaagccatggatctcattgaaaatatagctgcaagtgacattgcgattttgagagatagagcccacattcctactagaaagagtttattggagctaacctctcaagatgcattgttggcacaaaataagttgttgtctaagcaacttaaggcattgactgaaacactaagttacaggatgtaccatctgtgggggagctcatga

SEQ ID NO: 22863 - DNA, 585 bp, Glycine max
  Peptide Sequence Number=SeqID_114548
atgacggacgcgtggggtgctaataccttccccgtgcataaatacaactctcgaacctttcacttaaagttcgtagatcacgtcttttctgttggtggcgacttcgcttgtattcctttcttggaacacgctcccacgagtcacgcgtcgccctcccatcgaagggtagggtgcgacatcgctatattagccgacctatatgacaccttcggccgaagatgtgagaagagcagtacgaggattgtttgttgtactccagctctttatctatggttggtttcacacctttttcaccaagaggtgaggcatgcttgcccgctagaaggtcaccattcatgcatagagaaaggaggcgcaaattgggaccaactcttagcaaacaaagaaggagcgtctatcaactggttccctcgatggaaagaaggaagaaccggagttcttattttgtgtggaggatttccgaatgttcccttgatggggatgaggggttgcatcagttacaatcccgttcttgctataagacaacttggctatcctatgagaggggcaccactagaggaagagatcgcgcccgtcattcacgag

SEQ ID NO: 22864 - DNA, 570 bp, Glycine max
  Peptide Sequence Number=SeqID_114549
atgcaattacacgcccaggggtcaacgctcgatctctcccatccgcatgtgatggggatccttaacgtcacgccagattccttctccgatggcggcagtcataattcgttgatagaggcggttaagcacgccaatctgatgattaacgccggggcgactattattgatatcggtggtgaatcaacccgtcctggggcggcggatgtcagcgtcgaggaagagctggcgcgggtgatcccggtggtagaagcgattgcacagcgttttgaagtttggatctcggttgatacctcgaaagccgaggtaatccgcgaatccgcgcgcgctggcgcgcatatcattaacgatattcgctcattaaccgagcccggcgccctgcaggccgccgcgcaaaccgggctaccggtgtgcctgatgcatatgcaggggcagccgaaaacaatgcaggaagcgccgaagtacgacgatgtttttgccgaggttgaccgtttttttgctgaacacattgtgcgctgcgaacaggcggggatcgcaaagaaaaattgttgctcgacccgggattcggattcg

SEQ ID NO: 22865 - DNA, 537 bp, Glycine max
  Peptide Sequence Number=SeqID_114550
atgggtgaagtgagaaagagtgatgcacatgagagaaaatttaattatttagcaaaggcgagtgaaaagaatgaaagctatgccaagcaagccaacaagaacaagaaggaagtggtacttgaaccaggagacaaacctttccaagtattagagataatcaatgacaatgcttataggatcggtattccaggtgataattctaaacatttgatggcaaatgctttccaagaaggagagaatgataagaatcctaaaactatccaaatacagggacctatgaccaggagtaggatcaaacagttaggggataccctccaacaaatggtagcagacatacttaacaaggcccaagtggagaaggatgaagacccagaggcagaggcactaccaagaatattaattgttgctgaaggccagactaatttgaaggcttatgctaaatatacttatcaagataatccttatagtgtctaccctggtttattttccctcactggaagtggcctcagccaaaactctgtaatctatattaagtga

SEQ ID NO: 22866 - DNA, 156 bp, Glycine max
  Peptide Sequence Number=SeqID_114551
atggctggacgcaatgattttgcgatagctgatgctctccaagccttagctcaggctatagggaatccgaataggggagaaactgttggacgcataaaggataactgttcttcaatcaatcccactggtaaattcaataggcaattaggcaattga

SEQ ID NO: 22867 - DNA, 321 bp, Glycine max
  Peptide Sequence Number=SeqID_114552
atgattatgaggggtcaagacatttatagtagtcaagaggagactacttcttccccttcctctagtggaagtgaagataaagtaaggggtgaagagtctagtgaggaagtctacccccatgaagaaggtggcctcctaatggttagaaagctccttgcaggaagtgatgcacctcatgggacttccctccaagggcaattggatagggaagacctccgtagaagattggcaaagatgctaagagaaggccctagggttccctccatgagccttagggtagattatggactcagggcaaagtatgagcccacttatctttga

SEQ ID NO: 22868 - DNA, 219 bp, Glycine max
  Peptide Sequence Number=SeqID_114553
atggacactctcgcccccgttttcacatgggcaaatatatacgcaaggcgacaaggtgctgatgccgctgcgattcagtggctgctgccagtggtgcttttgcatgtctttccgggttggactcaagacgatagttaccggataaggcgcagcggtcggactgaacggggggttcgtgcatacagtccagcttggagcgaactgcctacccggaactga

SEQ ID NO: 22869 - DNA, 382 bp, Glycine max
  Peptide Sequence Number=SeqID_114554
atgactagaggcaatccatctgacttacaaccctttgatcctgagatagataggacatttcatagattagttaggcatcattttataccttttgatcattctgagcattccataactggtgaatttgtgcattctgttattggtgattttgaacatcctgatcttgagcattataattttgagcattctgattctgagcattctgattttgcacattctgagaacatggcacaacctccacctcgtgagaggactctaagggaaatggctgcacctgatttcacctatgaaagcttgtgcatccaataccctgatgaggatgtcccatatgttcttaagactggactgattcatttgcttccaaagtttcatggccttgcag

SEQ ID NO: 22870 - DNA, 255 bp, Glycine max
  Peptide Sequence Number=SeqID_114555
atgtggttgatacctgtgatgatcgcaaaccttgtttatggaagcagaatgacagcagtaggatgcagggatgagattctattgaggagccgccaagccgacgtgatgacattgggattattttggggagagaaagcaagcttcatgatgatgaatcaagttgattcaagtagttttgatgatgacaaagatgatgacaaaaagaccaagaaaatgatttcaagattgagtcaacaagttcaagatcaagattaa

SEQ ID NO: 22871 - DNA, 369 bp, Glycine max
  Peptide Sequence Number=SeqID_114556
atgatgagcatgaagaagataatggaagccaatgcggttacagttgccactaccagcactgttgctaaggtgaacccgacgcccccatccggcctcaaccaaatgaatcatccaacctcagatatagtaggtctggaaggcaaagagttgggaggtacgggcgaccctcatttagtgcgaaaaacaagcatgccttcccaccatatggcttgcctcccaactatacaccacccaatgtggcatacactcctagtgaggatgtcaataactccgttcccatactcattgaaagccaacaacctcaatctgatcatgcacatgtctctcaacccattggggagacacatgaaatgccccaccacaatctag

SEQ ID NO: 22872 - DNA, 310 bp, Glycine max
  Peptide Sequence Number=SeqID_114557
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccggtactatcgtcttgagtccaacccggaaggacatgcaaagcaccacctggcagcagccactg

SEQ ID NO: 22873 - DNA, 342 bp, Glycine max
  Peptide Sequence Number=SeqID_114558
ttgatgcactccccagggttattgtcaccgataaggatttgtctttgatgaatgcagtggaaactgtattctcggatgctacgaacttgttgtgtcggttccacattgaaaaaaatatgaagacaaagtgcaaaaccctggttgctcaaaagaatgcatgggattatgtgatggaggcttggaggagtttggttgactgtccatgcaaaaatccttcacgttgtggatgtgtcatgaggagtacacatggtcttccatatcaagggttatgtgagacacaagtgaccataattgaggagatggaaaccatatcgaaatgctttgagcagctcgatgtttgcg

SEQ ID NO: 22874 - DNA, 129 bp, Glycine max
  Peptide Sequence Number=SeqID_114559
atggagaaagagttacctctagattcagctcaagcaactgaggcaagatataggtctaaaatggttaacctgggaggcctgatcatgtttaggaataagcgcaataatagcatggttgagctgctttag

SEQ ID NO: 22875 - DNA, 684 bp, Glycine max
  Peptide Sequence Number=SeqID_114560
ggcttccccggtatcaacagagacacaggattatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccaggaaggccaaggagctggaatattatcatttagatcacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 22876 - DNA, 504 bp, Glycine max
  Peptide Sequence Number=SeqID_114561
atggctgctagtgaccatgcaatcttgcatgatagagcacacatcccaaccaaaagaagcctgctggagctttcatcacaggacgctttgttggcccaaaacaagttgctatccaagcaacttgaagctttaactgaaacactaagtaagttgccaactcaattgcatgctagacaaccttcaccctcttctgttttgcaggttgtatgttgtgttatatgtggtggagcacatgattctggctgttgcattcccacaaaagatacaacacatgaagtgaactatatggggaaccagccaagaccaaactttaatggacagtggagaactcaccctagtaatcagttcaataaagaccagggtgggccacttaataggcagcaacaagggcctagtctctatgacagaatgatgaagctagaagagactcttgctcagttcatgcaagtatccatgtccaatcaaaagagcacagagtcagccatcaagaatctagaagtccag

SEQ ID NO: 22877 - DNA, 684 bp, Glycine max
  Peptide Sequence Number=SeqID_114562
atgggatcaagtcaaaagccttcgcttaaaaagaggttctatcaagtcaaaatcaagagcttagaggtcactagtttacgagagttggggcaattaatgggtcaacttcaaaggcaagccttccgcaaagcctatggtaagatttgggacttagctagggtagaagtctccatggaaccgattgcatccctttcccagtattatcaccagcccctaaggtgcttcacatttgaggacttccagctagtgccgactgtgaaagagtttgaagaaatcctgggatgcccactgggaggaaggaagccatatcttttctctgggttctatccctccacgacaagagttgccaagttgtctctttccgaatatggaagggttagtggactagcagcgatgacactttcctcgctttcatcatggcaaggaaagcccggtcgtcgccatttgggccataaggaaggaagaatcaggattctatcttcatgcgaaggatgtccaaatgttttcttgatgggaacaaggggttgtattaattataatcccgtcctcgccataagacagcttggctaccccatgagaggagtgccatcagacgaaagcatcacgcctttcatcgcacggggtttcagtgaccacaacgcgagggtactccaaggagttcgcaaggcatgggatgcggcgtga

SEQ ID NO: 22878 - DNA, 465 bp, Glycine max
  Peptide Sequence Number=SeqID_114563
atgacacagtctgagaattcttttgattctggtaatcgattacctttccttaatcaagatttcaaaactagtagcaatgagttcttttgtttctcaaaagttttcaaaactgaattgctaagttccaacttgtttcaaaattggaggtgtaatcctgatggtacaagtttagagggtaatcgttaccagtgggttgttgtgactgagataaaattcaaacaagagaggggtaatcgattgctagcgttgttcaatagagaacaagggagggtaactccttccaatggatctttgcttgttcaaaggtctaactcttcacaaggtttcttgacagacagaagagtctataacaaggaccggcttggggacttggatgttcaaaaaggagggttattgccgaaccagtatacaccaactcttgtgtgtaaccttttgattctttcttcttcttcctctcacttttaa

SEQ ID NO: 22879 - DNA, 453 bp, Glycine max
  Peptide Sequence Number=SeqID_114564
atgttcctccagaaggcggttgcttctggaggaagcaacctggcttgcctgggcgagctgggtggcaagctcctcccctattttcctataaagagggggaggagtgaaggagaaaggggttcagcccttctggcgaggtgcttccgtaacgtttccgtgggtgatttcgcgaagattgtcaaccgttcttcgtcgttcgtcgttcgttcttcgtcgttcttcggtcttcaactggcgctaataccttcctcaaacgtaaatacaactcccgaatctggaatattcttcatgaccggtttccttcggtttttccgatgttttccacaaataaacgttggtggcgactccgcgcattttcctcctttggaagacgcacccgtgagcctcgcctcgctctcccgcaaaagggtatgttgcgacaggtggcgactccactggggactgtttttgtga

SEQ ID NO: 22880 - DNA, 744 bp, Glycine max
  Peptide Sequence Number=SeqID_114565
atgggatcaagtcaaaagccttcgcttaaaagaggtttttatcaagtcaaatcagagcttagagtcactagttacgagagttggggcattatgggtcacttcaacggcaagccttccgcaaagcctatgtattatgatcagccgatgaggtgcttcacctttgggaacttccagctatcacccatggtagaagaatttgaagagatcctagggtgtcctctaggggggaggaaaccatacctcttcacaaggttctatccctcattagctagaatttccaagatagtccaaatcttggcgcaggaattagaccacaggaagcaagtcgaaaatggggtggttggaataccgagaaaatatttggaggcaaaagcaagaatcttggcaggtaaaggcgagtgggccccgttcatagatattctcgcactgttgattttcggaggagtcctctttccgaatgtggatgggttggtggacctggcagcgatcgacgtttttctcgcctatcataaccacaaggaaatcccggttgtcgctatgctagccgacctatatgacaccttcgaccgaagatgtgaaaagagcagcgcaagaattgtttgttgtgcactggctctctgtgtgtggctggtttcgcacctttttctccaagaaggtaggcccgtctatccgctacaaggtcactgctcgtgcgtcgaaaaaagaaaggcgaattggattgggccttgtattttggccatctag

SEQ ID NO: 22881 - DNA, 441 bp, Glycine max
  Peptide Sequence Number=SeqID_114566
atggattcgaagacgaaggtagcaatacttattcctggcatgttagccatactccttttcatctcctcagaggtggcagccagggacttgaaagaggagggggttcttaaagagacaagtaaagttggtgatgccaaattagttggtggagggttgcaaggctctggtcgtggctcacctactcctgtcttccctggtcgtggcattcctggtcgtggctttcctggtcagggctttcccggtcagggcttccctggtcagggcttccctgttcaaggctttccctttcccggtcagggctaccctttggtccctggtcagggcttccccggtcagggctttcccggtcagggcttccctggtcagggcttccctggccaattccgttgcattaatggctgttgttatgggaatgcgagaggttgcttagcttgctgctaa

SEQ ID NO: 22882 - DNA, 426 bp, Glycine max
  Peptide Sequence Number=SeqID_114567
atgggctacgtgggagtacgtgagctcagttggaggtgggcaacaggggatggtggatttatgcgcgcattgtggatgtggaaaacttgttgtgcaccatcgcccgaccgccacctagtaccacatgtgatggagtggtacctggagatatgtcgcgggggtcaggagaccttggggacgtcaggtggggtgctattgcccaaaaccaagcttgaccaatcccgacccaacccgggtgtcgcaacctacccttcggcgggagggcgacgcgtgacttgcgggatgcgtgttccacggaaggaatacgcgcggagtcgccaccaacgtttatttgaggaaaacgtcggaaaaaccggaaaagacgcgatctacgaactttttagtgaaaggttcgggagttgtatttacgcacggggaaggtattag

SEQ ID NO: 22883 - DNA, 726 bp, Glycine max
  Peptide Sequence Number=SeqID_114568
atggcctcctcaaatcccttgtttcctgaaggaaattccattcacagaccacccattttcaatggtgagggttaccattattggaaaacccgcatgcagatattcattgaagccatagatctaaatatttgggaagcaatagaattaggaccacatatacccactatagtagatgtaagcacaagcactacaacccaaaaacctagagataagtgcatagaagaagataggagaaaaatccagtatgatctcaaagccaaaaacatcatcacttcagccctaggaatagatgagtactttagagtgtcaaatgaacatgagatggaacttcaacgcctcaatcagaatgaagaaaatgataaaaagaagagaagcatagcccttaaagcctcatcttcaatacaagaagaaaatgaagaaggagattcagatgatgaagaagatttttccttctttgttaagaaatttcagaaatacatcaagaaaagaagaattgacaggcgccagaatttcaataatggaagaaaatcacaagatgattctcaagtccttaggtgttacaaatgcaaccaaattggtgacatcaaggccaattgtccgtcaaatgaagaatggtcggagaaaagtgaaaagaaaatatttgacgaaagaagaactaagaaagcatacattgcatggatgacaatgattcatccgatggttcagaaaaggagattaatcttctaa

SEQ ID NO: 22884 - DNA, 690 bp, Glycine max
  Peptide Sequence Number=SeqID_114569
atgcgtgcggcggcggcgaaatcgcgccgtaagttcctttacgacaccaacgtcggtgccggtctgccggtgattgaaaacctgcagaacctgctgaacgccggcgatgagctgatcaaattctccggcatcctgtcgggctcgctgtcgtttatcttcggcaagctggatgagggcgtgacgctgtccgaagctacccgcatggcgcgcgagctgggctttaccgagccggatccgcgcgacgacctgtccggtactgatgtggcgcgtaaactgctgattctggcgcgtgaggcgggtcatcagctggaactgagcgacatcgatatcgaaccgctgctgcccgccagcctgacggacatcgccgacgtcgatcagtttatggcgcggctgccggagctggacaacgcctttgccgcgcgcgttgccaaagcgcgcgatgagggtaaagtgttacgcttcgtcggcgcgattgaagagggcggcgcctgcaaagttaaaatcgatgcggtggacggcaacgatccgctgtacaaagtgaagaacggcgagaacgcactggcgttttacagccgctattatcagccgatcccgctggttctgcgcggatatggcgcggggaatgatgtcaccgcggcgggtgtgtttgccgatttgctgcgcacgctgacgtggaagttgggagtttaa

SEQ ID NO: 22885 - DNA, 374 bp, Glycine max
  Peptide Sequence Number=SeqID_114570
gaacaggggctgaaccaggaatcatttgtatgggctggatattgaattcaggtcgttcctggtttgctggtgctttggtggatgatggagatgatggtacagagggtgaaccaggagctgaagtttcttttggtggggtagccatggaaaagcagagcgtttggaatgtagtgaacgtgctattaatgttaagtgagacgtttgagcacgttcagatagcagtagctgctataatctcccttgctagcagacaaatcccagccgttgcccctcagtttttcaatgatctccttgcaatccaaggcagctcttcccagattttgaaatattaccatagcactcaagtgtcccagtactatggtcagacatcttga

SEQ ID NO: 22886 - DNA, 570 bp, Glycine max
  Peptide Sequence Number=SeqID_114571
atgcataaggcattgcgatcaaatgctcctcttccttatccccatttgattattctattcttgcatcatttcgatgtccctcttgactctgagccatttgttcaagtcatgagatcattttctattggggtgggggtagttacttccttcggataccgcaaagagcgtgatggctcatgggtgaagaaggacgctcctgcacaggcagcagaggaccgctctccatcaccacctcctcaaagagatgactcttcatcccttatgcaaatcgttcttgacagactggatggactatacatcttcgttggtgagcgttttgactccttggacagccgcattgatgccattgatgcacggtttgcaggaatggatacacgcatcactcaacttgaggaggacatgagttttatttggggagattgtggaagcaatgctttccaagattattttgatgatgccaaagactcaagtcaagaatcaagagtcaagcaagttttaagaatcaaagagtcgttcaatcgaagcaagtttcaagaatcaaagagtcgttcaatcaagattcaagattaa

SEQ ID NO: 22887 - DNA, 393 bp, Glycine max
  Peptide Sequence Number=SeqID_114572
atgacgagcgatcgggaagcgctgttgcaattttcgcaggcgttctgtgaagaattgagcgacgacgatgaagggttgaagcgtgaggtcctcgcgcatgcgggcaaccgttggtcgctgggggtattgcatatcctgggcacccacgggccgctgcgccacggcgaaataggccgccaattagcgggcgtgacgcagagaatgctgacgcggacgctgcgccatctcgagcgggacgggttgatatcgcgctgcgattatcaggaaaagctgccccgtgtggattacgccatcaccgacgcggggaagagatgctgctcaacatgctgccgctctggtcgtgattatcggctccgccgatgccttcagggcggcccgctcgcactacgatga

SEQ ID NO: 22888 - DNA, 218 bp, Glycine max
  Peptide Sequence Number=SeqID_114573
ttggccagggcttcccggtatcaacagggacaccaggatttatttatctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 22889 - DNA, 264 bp, Glycine max
  Peptide Sequence Number=SeqID_114574
atgggtcaggataacagaaagcgtggggcggtcgacaaaagcggggcttttgctcctacgtatcctcaatttgagatgaggaatttagacctacgtagttctagctttcgctatgtgcggataaccagaaggtgtctccgcatactaccagactcttgggtcatgatagcaaaaggtggggcggtcgacaaaagcgaggcttttgctcctacgtatcctcaatttgtgatgaggaactcagacctacgtagttctttcttgtga

SEQ ID NO: 22890 - DNA, 615 bp, Glycine max
  Peptide Sequence Number=SeqID_114575
tctgtgctcgtggtggatcatcatgtcatacatggcaagacccaaggtcacacgcacacacacacacacacactcacgcaggcacaaggggaggaggggctggtcgtccgtccgcccgggcacacactagggagggacgaatcaaagcgacaagggctgaatctcagtggatcgtggcagcaaggccactctgccacttacaataccccgtcgcgtatttaagtcgtctgcaaaggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattctcacgttccctattggtgggtgaacaatccaacacttggtgaattctgcttcacaatgataggaagagccgacatcgaaggatcaaaaagcaacgtcgctatgaacgcttggctgccacaagccagttatccctgtg

SEQ ID NO: 22891 - DNA, 177 bp, Glycine max
  Peptide Sequence Number=SeqID_114576
atgttagcagggaatgtaactatagaaaaacctagagatcaatgggatgaagatgaaagaaaaagagttcagaataacttaaaagcccagaatataatcacttctacattaggcatggatgagtacattagagtttcaaacagtaaaaatgataaagaaatgtgggatacattacaa

SEQ ID NO: 22892 - DNA, 193 bp, Glycine max
  Peptide Sequence Number=SeqID_114577
attcctccagaaggcggttgcttctggaggaagcaaccctgctcgcctgggcgagctgggcggcaaccacctcccctattttgctataaataggggaggaaggcaagaaggaaggggggaggaatctcgcaaagctttcaaccgttcttcgacgttcttcattcgttcttcatcgttcttcgatcttcaacgg

SEQ ID NO: 22893 - DNA, 251 bp, Glycine max
  Peptide Sequence Number=SeqID_114578
gcccacttgggccctccgaaatattcctccagaaggcggttgcttctggaggaagcaaccctgctcgcctgggcgagctgggcggcaaccacctcccctattttgctataaataggggaggaaggcaagaaggaagggccgaggcgcttccgaaacgtttccgtaacgttttccgtgaggaatttcgcaaagatttcaaccgttcttcgacgttcttcattcgttcttcatcgttcttcgatcttcaacgg

SEQ ID NO: 22894 - DNA, 216 bp, Glycine max
  Peptide Sequence Number=SeqID_114579
atggaccctaagagaataaaggtcattcctgagtggcctactccaccatttgttgaggaaagaatccctgagtttcaagtaactatgggtttgaggtcaaatgcttttcaagggggagggaatgatgcaatcctaccccccccccccgggcattggatagaagacttcaagaagattcggccagagatgcaagagaagaccctaaggttctcatga

SEQ ID NO: 22895 - DNA, 321 bp, Glycine max
  Peptide Sequence Number=SeqID_114580
atgggtgaagtagaggaggtacaagagaagatgaaggccgacatggaggccatgaaagagcaaatggccacgatgatggaggccatgatgatcatgaagataatggaagccaatgcggttgcagttgccgctacgagcactgttgctaaggcaaagatttgggaagtgcgggcggcccccatgatgtgcaaattcaaaacgagcaggccttcccgccatatggcttgggtgggcaactatacgccacccaatgtggcgtacactcccaataagaatgtcaataactccactcctatacccattgagagccaacaaccctaa

SEQ ID NO: 22896 - DNA, 372 bp, Glycine max
  Peptide Sequence Number=SeqID_114581
atgtcgcagggttccggagaccttggggagtcaggtggggtgctattgcccaatgaccaagttgacaatcccgacccaaacctttcgggcatagtcaatgggtcaatttgcttgagaaaatggagacagttatgttgtggaggccttggtaataggttactaatattctctggtattcgattacacagagtaacaagccactggtcaaatcgattaccagttatgtctaatcgatccagtcatattgcaggttttcagttccgaagcgttaaccgaactcagaacgaagaaaatgttactgggcttggagggattgatgggaacccggtgttgagaggaacgaggataaggggctacgtgggaagtacgtga

SEQ ID NO: 22897 - DNA, 201 bp, Glycine max
  Peptide Sequence Number=SeqID_114582
atgactggagatgcatcaaattttacacatatctctccaaagaaaagcgggcatgtaacatatggtgacaacaacaaagttagaatccttggaagattgaaaaatgagttttggaaaaatcctgaaaagaaaaatcatagtgagaaagaaactggaacattatttactcacatgggagaaaatgatgcattgaatctttga

SEQ ID NO: 22898 - DNA, 345 bp, Glycine max
  Peptide Sequence Number=SeqID_114583
atgttagactgggctatagaagtcatctggccagaaataagagctcctatgttcatgtccatgcgagagactaggccaaagatcagcctagctctgtccactatcagatcagaggtatgtgatgtgggggccaggttggagtatgagacaaaactccacacttgggctaaagtagtcaaatctttcctgagaatcctccatggatggccctcagcgttcaagatgaaccctcggcctggtgtctctaagaatgtgttgaggctgttagcgtcgatcttcactaggtggcctctaaccctggcttactttggtgaagaaccgtcagagctgtataggtttgcatag

SEQ ID NO: 22899 - DNA, 390 bp, Glycine max
  Peptide Sequence Number=SeqID_114584
atgcctgtaactcttggaactctctcaaatttagtgatgttagacctttcatctaatttgttagaaggatctataaaagagtcaaattttgtaaaacttttgaaattaaaggaactacgtttgtcttggacaaacttgttcctcagtgtcaactctggatgggttcctccttttcagcttgaatatgttttactgagctcctttggaataggtcctaagtttccagaatggctaaaaaggcaaagttctgtgaaggttttgacaatgtctaaggcagggtacattgccagtgtgtctgcaaatgttgaagtgctgaatgttgccaataactcagttcccggaacatttctccctttttatgtgggaaagggaaatgctactaataattaa

SEQ ID NO: 22900 - DNA, 979 bp, Glycine max
  Peptide Sequence Number=SeqID_114585
gtcgactctagaggatccccctctgtggggtagcaacagcaagcttaaactccggagagaggaaagagaccaatcacgagtacttggcatggtcttagagaaggagttagctgcttgctcaagatccaagaaaagtttggcccaacacttagaagccacggagcaaagcatgctagctataatagggcagtacaaagaagagttaaaccagtcgttgacccatgagcaaaagctagtagaggactttgcacaagcatacgccgagaaggaagcaagagggagggtgattgatgcattgcatcaagaagcgaccatgtggatggataggttcgccttgaccttaaatggaagtcaagacctcccgcgactactagctaaagcaagggccatggtcaaaatgaaggccgacatgtcggccttaaaagatcagatggcttctatcacggaagccatgctaaaaattcgaaaatcaatagaagacaatgctacggcagccgcttccaatacagctagggaagcagaaccggtgctacagcccacgatgaacttgggccgggaccgaagcgtgatgggttttaatcggaggtatagtcctcaagcctacccttatggtgggcctttagacttcactccccgtaccggtccagacgatttgagccaagcccctaccttcgaggggaaactccctcctcatgttgactatcctctgcaggaagatgatgaaggagatgcccatttaggccctctacttcccctcaaggaaccgcccccccatgagttgccccaaccaaacataatctgccatgccccatctcaatccgcacccattaaggaactccttcccatttcaaaagacaagggaaagatcaatctgcttgaagagagattgatagcggtggaaggcctcggcaactatcctttctcggatttagccaatctgtgtctggtacttaacatcattattcctcccaagttcaag

SEQ ID NO: 22901 - DNA, 312 bp, Glycine max
  Peptide Sequence Number=SeqID_114586
atgggtgatcaagaggagacacaggaacatatgaaagccgacatgtcggctctgaaagaacaaatggcttccatgatggaggccatgttaggaatgaggcagctcatggagaaaaacgtggtcgccgctgtcagttcggctgccgaagcagacccaactctcttggctaccgcacgccatcctccctcaaacacacccaacgaggtccacgaaaaccctcaagactatgcccgaagggatgtcgagttctatcccccgatccccgaagggtcggcacccaacacgttgcttcagcccaacctcacgacataa

SEQ ID NO: 22902 - DNA, 498 bp, Glycine max
  Peptide Sequence Number=SeqID_114587
atggtactattcccgaatctagatgggttgatggatctagcagcgatcgacgcctttctcgcttatcatcacaacaaggaaatcccgatcatcgttgttctggatgatgcatatgatacgtttgacctgagatgcgagaagagcaatgcaagaattgtctattgtacgcttgttctttatgtgtggttggtctcccacattttttttcatgaaggtagacctgtctgtcctctacaaggtcattgcatgtgcatcgaaaagggaaaagcaaattgggaagaactcctggcaggtatggtaggagcgtccattagctggttcccccggtggaaagaaggaagggcaggagtgttatgctcgtgtgaaggattcccaaacgtccccttgatgggaacgaggggttatattaattataatcccatgctggccataagacaactaggctaccctatgaaaggtgcaccgttagaggagatcatcacgcctttcgttgcgtga

SEQ ID NO: 22903 - DNA, 360 bp, Glycine max
  Peptide Sequence Number=SeqID_114588
atgtccaaatcttgtggatttgggatgaccggccctctcgatgagtcgatctcttgctttctcataagggtggacccttgggtacttgtacctatcaccttgagaggactacgtgtcctcgccatcagaggactgcatgtcctcaacttcagagggctacacgccctcgccatcagaggactacacgtcctcgccttgagagggctacacgccctcaccttggttaccctcaccgttgagaggactacacgtcctcgccttgagaggactacacgtcctcaccagcagagggctgcacgccctcacctccagaggactacacctcctcgccttgagagggctacacgccctcacctttag

SEQ ID NO: 22904 - DNA, 181 bp, Glycine max
  Peptide Sequence Number=SeqID_114589
aaaactgacttgactccttcatgcatgctccactcggctcggggggatatagctcagttggtagagctccgctcttgcaattgggtcgttgcgattacggaggaccgaaacatgccactgaaagactctactgagacaagacgggctgtcaagaacgtagaggaggtaggatgggcagttg

SEQ ID NO: 22905 - DNA, 537 bp, Glycine max
  Peptide Sequence Number=SeqID_114590
atggagacacatcttgtgctcgctagttactcatattctgattatgttgtagatttggatgtatggagatttgtgactgggtgcgcgttcacgattggaaattttcttaagggcaaggatcaagtctatcatgagaagactaagggcattgaaatcagataccacttcatccgtactaagaagagggttgaagtccataaagttgatgcgagggagaatccaactgatatgttcatgaagcctattccaagaagcaacttcatgcattatggccccttggagttgttgtttatctctaccatagagtgtgacgtgggagttcaagaagaagaagaggtagaagaaagcatcgtgctagagaaagagatgaaagcacaagccaaactttcaacccaagaccctggcttgcccaggctagcctttagctcgcctgggcccctaaattgcttcggggtgaaggaaccagctcgcctaggtgagccagcttacttcaggatgaagcaacaactcacctgggcgagctgccatgacccctaa

SEQ ID NO: 22906 - DNA, 561 bp, Glycine max
  Peptide Sequence Number=SeqID_114591
atgagtgaaatagaggaggtgcaagaacagatgaaggccgacatggaggccatgaaagaccaaatggctgccatgatggaggccatgttaagcatgaagaaaataatggaaagcaatgtggttgtagttgccactacgagtgccgccactgaggtagacccgactcacccatcgggccttaatcaactagcaaccccagttggggcatgcacattttgctcaacccatggggggggggcacatgaagaaccctgggaccgtgctctagctgacttcgagccttacctcggacatgccattgaggggctagcatttggtggcgttccccagtctaacacctcgaggggcccgcagtaccacccacaaccacaacccttgccttttgcaatgggaaaggtccctttcgccatggtggaaagggaaaaattcaatcatatagaggaaaggttgaaggccattgaggggattggtgactacccttttcccgacatggcagaattatgcctagtgcttgatgtcgtcgtccctcccaaattcaaggtgccagacttcgacaagtaa

SEQ ID NO: 22907 - DNA, 475 bp, Glycine max
  Peptide Sequence Number=SeqID_114592
atatgagggtcgattctttgaggatcctaacaacgagggtttgacaatcgatttcgatcgagatataagccaaacgataaacgaggaagaggaagaagacatcctatcaccagagttggagaggttggtcactcaggaagaacgtgaaatgaagcctcaccaagaagaaaccgaattggtaaacatggggaccacggaggaaaagaaaaaagtaaaggtaggaaccggtattgatgcaagctccattggagcttgtaggcctaggatcttcttcatcaatggattcctttgcttcttggaagatgaatggcagcggaatggagaaagggaaagagagaggagacgccacttcaaggagaagatgagtctagaagaagctcaccaccataggaggccatggataagagcttggaggaagaaggagatgaatgaagggagagggagagaagagcacgaaattttgtgctctaaatga

SEQ ID NO: 22908 - DNA, 624 bp, Glycine max
  Peptide Sequence Number=SeqID_114593
atgccatacgtggaagccgcggaggagtcaatggaaacgactttccaatcttttgaggtagtaagcatcacctccgtagattccctctctaggccgccccgcttgtctgatgcggcaatgatggtggcccgggtgatgctggggcacggctacaagctcggaatgggtttgggcaagaacaacagtggcaggaccagcatggctgacataaggataaatatctcggaaaggaagaacaaaggccagggctcgcggtcgggacaacgagccaaagaggctccgtcgtgccacatcagcaggaacttcataagtgtgggtttaagacgcgaaggtcaagtcgccacgatatgcgatggcgactccccgaggagatcggatttggtacggccatgccctcccagtttccaactaggaaattggcgggtggaggaacgcccagacgtttacgcgacaagcataatatccgatgacgagtcccgtgaaggtactagtaccggtgacctggccgtcgatttcgatcaaaaagcaagtcagacagagaatgaagaggacgagaatgtggggcttcccctagagctggagaggataattgctcaggaggatcgagagataaggctgcattaa

SEQ ID NO: 22909 - DNA, 273 bp, Glycine max
  Peptide Sequence Number=SeqID_114594
atgttctcatacgtaggaatacccccgttagccggcttttgtagcaaattctatttgttcttcgccgctttgggttgtggggcttacttcctagccccagtgggagtagtgactagcgttataggttgttgggcggccggaaggttgccacgattgggaaagaacggcgaagtccatccgaaccgtccaatgaagaataagagagagcaaagcgccaatggcgcgcgaagcgcatgcgaaacgggcacggagaaaaatcagtgtggaggataa

SEQ ID NO: 22910 - DNA, 285 bp, Glycine max
  Peptide Sequence Number=SeqID_114595
atggccccctacaggatactgggctgccttgcagcaacgttttccgcttgtccagcgccgggaagggacgatgatctgtcgatcgtgaaaaccctatcctctatttgcatccgttccctaagaccgaaagtaggaaacaacaatgcgtggcaaatcgtgattgggtcgtcgtcttacctgttgatttatgtcgttaactttgtctcgacttctgactgtggccctaaagacagattcatgcccatctgttatcacaaaatatgcatagttcatatgcatgcatga

SEQ ID NO: 22911 - DNA, 246 bp, Glycine max
  Peptide Sequence Number=SeqID_114596
atgtctaatcataagagtactaagtcagccctgaaaaaccttgagattcaagtgggtcaactggccaagcagttagctgagaagtcatcaaacaactttggggcaaatattgagaagaatcccaaagaagagtgtaaagttgttgtaacaagaagcagaaagcttatggtggctgaggataaggatgttgttgctttgaaggagcatgctcctttaaaggacactactattaaaaagaagaatgag

SEQ ID NO: 22912 - DNA, 123 bp, Glycine max
  Peptide Sequence Number=SeqID_114597
atggcctttgtggataactgggcggcgggtaaggagaaggtgccacttgagctaccaggtctctccacctttgggcgtattcttttgaaagatccgtgccccctttttgcacatgttctgtag

SEQ ID NO: 22913 - DNA, 321 bp, Glycine max
  Peptide Sequence Number=SeqID_114598
atgaatctatgtgaaggagtttctattgacatgcaaagtgagtttgagatgtccatgatgggtgagttaaattactttcttggactacaaatcaaacaaacaaatgatgggatctttgtcaaccaagaaaatgttgcaaggaactcatccaaagaaatggaaaacctcaagaacatcatcgtcttgacaatatcctatcggagatatctaccaaaagatgagtccgaacctaaaaactttaaagaagccataatagatgatcaatggatagtttctatgcaagaagagttaaatcaatttgagagaaataatttggactag

SEQ ID NO: 22914 - DNA, 444 bp, Glycine max
  Peptide Sequence Number=SeqID_114599
atggcacgcaacgtgtttgctccgtgcccctatttaaaggacctatatgggagagagcaaaaaaggtttctagtgataatccccaaggtggtcatatctctcctgatggtctctagaggtatcatcctcttcgaagaacatactgcagcagtagggactactagcaacaatatgttttcaaagagaaaaactctagatgagggttcactgaaatcaagcaagtcggagaccaagcatgatcacagattcacctccactccttatgttcccacgaacccggtccccagcggagtcgccaactgtcgcaacctacccttcgatgggagagcgacgcctgactcgcgggtgcatgttccaagaaaggaatacgcgcggagtcgccaccaacgtttatttgaggaaaacgtcagaaaaaccggaaaagacgtgatctacgaactttag

SEQ ID NO: 22915 - DNA, 153 bp, Glycine max
  Peptide Sequence Number=SeqID_114600
atgacaaaggaaacaatgaagatcctccagaagaaggcaaatcccaatgatgtactcccaagagaatggaaaacttcaagagatcatcccctcgacaacataattggtgatatctcaaaagggatatacttggatcattatttattaccataa

SEQ ID NO: 22916 - DNA, 141 bp, Glycine max
  Peptide Sequence Number=SeqID_114601
atgaccaggccttgcttaaagggaatagaagagaagactgccaagttgaaaggaagtgagaaggctctagttgcacggcatgaacctagtcatgctgtagtaggctctggttatcagactcctgggtttaatgacttgtga

SEQ ID NO: 22917 - DNA, 546 bp, Glycine max
  Peptide Sequence Number=SeqID_114602
atggtgggctacacaccttcaagctttgcttatttagttttcaccgacgaaaggatcaaaatgggtctgaaaagaggcaaatttgatcatcctgctttgatgaatgagaaaactagggcaaataaaaaggatgggaaggagggagaaacccatgctgcgactgccgttcctacatggccaagtttcccaccaacccaacaatgtcattactcagccaataacaacccttcgccttacccaccacccaactatccacaaaggccatccctaaatcaaccacaaaacccaccttccacacaaccaatgctaaacaccacctctagcacaaacccaaagcaccaaccaagaaatgaattttgcagcgaaaagacctgtagaattcaccccaattccgccataaccccaaccaaggttcctcaacctccatttctccaaggatacgactcgaacgcaacgtgtgcttatcatggaggagccccagggcattccattgagcattgtatgacctcgaagcgtaaggtgcaaagtctaattgatgcgagctga

SEQ ID NO: 22918 - DNA, 501 bp, Glycine max
  Peptide Sequence Number=SeqID_114603
gagtctgggccgtgtctcagtcccagtgtggctgatcatcctctcggaccagctactgatcatcgccttggtaagctattgcctcaccaactagctaatcagacgcgagcccctcctcgggcggattcctccttttgctcctcagcctacggggtattagcagccgtttccagctgttgttcccctcccaagggtaggttcttacgcgttactcacccgtccgccactggaaacaccacttcccgtccgacttgcatgtacaaagctgattcggaattctcttccattccaaggcataacttgtatccaggcgcttcatattcgactggagttcgctcccagaaatatagcccccccacccctcgtgtaatcccacgagcctcttatccattctcaattattattcgatcacggcatacaaatagaaaaacttacattgggtttagggataatcaggctcgaactgataacttccacaacgtcgtgacactctaccgctga

SEQ ID NO: 22919 - DNA, 216 bp, Glycine max
  Peptide Sequence Number=SeqID_114604
atggtcaactttgtactcactgggcagctcaactttgtaagcattgtcattgattctttcaagcacttgaaatggtccatctctgatgagaatcctgaaactggccaaatacaggctaaaggccctagtggagaaggacaaaggccccgagtggagaaggatgaaggcccagaggtagagacactatcaaggatgaaggatgaaggctcagattaa

SEQ ID NO: 22920 - DNA, 294 bp, Glycine max
  Peptide Sequence Number=SeqID_114605
atgtcgcccccgtgtggcgacatggatggggcattagctctccctgaaaaggaggtgatccagccgcaccttccagtacggctaccttgttacgacttcactccagtcactagccctgccttcggcatccccctccttgcggttaaggtaacgacttcgggcatggccagctcccatagtgtgacgggcggtgtgtacaaggcccgggaacgaattcaccgccgtatggctgaccggcgattactagcgattccggcttcatgcaggcgagttgcagcctacaatccgaactga

SEQ ID NO: 22921 - DNA, 255 bp, Glycine max
  Peptide Sequence Number=SeqID_114606
atgtttgtcgacccaaacaatgcaaacacaattacattgggtgaagttgtggagactttacagtatatggtgtcaccacaagggaggaacacttggacaattgatgatctcgtgccttacgtggaaaagttagcgattatatgcaaagagcaagagagaatcactgagtcagtgtcacatggtccagcatcagagcgtgaattcacagcacaagagtttcacattcttcagtcaagtgttgaaactcgagcatag

SEQ ID NO: 22922 - DNA, 386 bp, Glycine max
  Peptide Sequence Number=SeqID_114607
caagccctggacgcttgctttgttcaacgcgatgggatactactcttacgttgctagcctgattgtcgttggcagtagtcagtatcttggatttatgaaagacgaatcaactgcgaaagcatttgccaaggatggatcagcggatgttgcttttaggactccgctggcaccttatgagaaatcaaagtctttgggttccggggggagtatggtcgcaaggcgaaacttaaaggaattgacggaagggcaccaccaggagggagctctgcggcttaatttgactcaactcggggaaatcgcacggcctttgtgccggcgacgcatcattcaaatttctgccctatcaactttcgatggtaggatagtggcctaccatgggggtgacg

SEQ ID NO: 22923 - DNA, 603 bp, Glycine max
  Peptide Sequence Number=SeqID_114608
atgtggtataatgaaagcatattaaaacgttcaaatacctcaaacccacgattcagtctatgttgtggagatggcaaggttgaacttccattgttacagaatccacctaaatttctgcagcaagttatatttgagcaaatacagctcatgcaaaaaaattatcaacagaacataagaacttataacatgatgtttgcatttacttctgctggtattaaatttgacaaaataattagtcatttgagagaccctcctacagttagaattcaaggtcaaccgtgtcacaggattggaagtctattaccaatgccgggaaaagaacctaaatttgcacaattgtatatctatgaaacagaaaatgaagttcaaaatagaattaacaccatgagccaatataatgaaattgaggcacatattgtctcaaatttgcaaaaaatgatggatgaaaacaatgctcatgcaaagagtttcaggatggcaagggatagattgacaggcactgaagtgcataatgtcagattcaaattgatcgctggtcgggaaaaaaaaatggtcatacatataatgtaccaagtgttccagaagttgctgcacttattgcag

SEQ ID NO: 22924 - DNA, 643 bp, Glycine max
  Peptide Sequence Number=SeqID_114609
accaactgaaggagtggtggatattgctgtttctgagcatcaaattgccaaggaaatcactgccaagcaagtcaagcattggccaaagaaagggaagctttctgcagggaagctaagtgtgaagtatgcaatcctgcataggattggcactgccaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctcctctatccctgcattacaaactgtttgaggggacacatgtcccagacattgtctcgacatcagggaaagctgctgcttcaggtgctgtgtccaaggatgctttgattgctgaactcaaggacacatgcaaggtgctggaggcaaccatcaaagccaccacagagaagaaaatggagctggaacgcctgatcaaaagactctcaaacaatggcattgatgatggagaagcagctgaggaagaagaagatgcagcagagatacagaatcagatgatgatgattctgatgccaccccatgaccatcagacctttatttttgctttttactcttactag

SEQ ID NO: 22925 - DNA, 333 bp, Glycine max
  Peptide Sequence Number=SeqID_114610
atggggctccgaaaaaagactgagaatggagaattgctctattcaatcactacgcatggctccaaagctcgaaggtggaggacacatgaacgaaaacgcaattcatggggctcccgaaaaaagattgagaattggagaattgcactaagcaatcactacgcatggctccaaactcgtggaggacacaatgaacgaaaacgcaattcatggggctcccaaaaaagattgagaatggagaattgcactaagaaatcactacgcatggctccaaactcgtcgggtggaggacacatgaacgaaaacgcaattcatggggctccgaaaaaagattga

SEQ ID NO: 22926 - DNA, 606 bp, Glycine max
  Peptide Sequence Number=SeqID_114611
atgggtaaaggcaaatgggccccattcatagacattctcgcactgttgatcttcggaggagtcctatttccgaatgtgaatgggttggtggacctagcagcaatcgacgcttttcttgcctatcataaccacaaggaaaacccggttgtcgctatgttagccgacctatatgacaccttcaaccgaagatgtgagaagagcagtacgaggattgtttgctatactccagttctttatgtatggttggtttcacacctttttcgccaagaggtaaggcatgcttgcccgctagaatgccaccgttcatgcatagagaaaggaggggcaaattgggaccaactcttagcaaacaaagaaggagcgcctatcaactggttccctcgatggaaacaaggaagagttggagttcttatttcgtgcggaggatttccgaatgtttccttgatggggacgatgggttgcatcagttacaatcccgttcttgctataagacaacttggctaccctatgagtggggcaccactagaggaagagctcgcacctatcatttcacgaggtttcaataagaccaacttggagacacttcagaaggtccgcaaggcatga

SEQ ID NO: 22927 - DNA, 1191 bp, Glycine max
  Peptide Sequence Number=SeqID_114612
ggttgcacaccctcgccttcggttggctacacgcccttgccttccgagggctacacatcctcgccttcagaggattgcacgtcctcgccttcagagggctacacgctctagccttcagagggctgcacgccctcagctttagagggctacacgccctcacctttggaggattacatgcccacgccttcagagggctacatgccttcgtcttaagagggctgcacgccctcgtcttcagaggattgcacgtccacgccttcagaggactacatgtcctcatcttcagaggactacatgtcctcgacttcaaagggctgcacctcctctccttcagtggacagcacgtcctcgcctttagcggactgcacgtcctcacctttagaaaactacacgtcctcgccttcagagtattgcacgtcctcgccttccgagagccgcacacccccgccttcgaagggctgcacgccctctcctttcgagggctacaagtcgtcaccttcaaaggattgtccgtcctcgccttcagaagactgcttgcctcacctttagagggctacgcgtcctcgcctttagagggctacatgcccttaccttcaaaggactgcacgtcgtcgccttcaaaggactacacgattgcacgtcctcgccttttgagaactacatgccttcaccttcaaaggactgttcgtcctcgccttcagaggactgctttcctcgccttcatagggctacacaccctcgccttcaaagggctacacaccctcgccttcaaagggctacacgccctcgccttcagaggactacacgtcctcgccttcagagggcttcaccccctcacgattagagggccgcacgccctcgacttcagaaggccacagagggcttcatgtcctcgccttctgaaggccgcacgtcctcgccatcggagggccacacgtcctcgccttcggagggccacacgccttcgccttcggagggctgcacaccctcactttccgagggctgcacgtccttgccttcagaggattgcacgtcctcggcttcagagggctacatgcccttgccttcagagggttgcaagccctcgccttgagggctacatgccctccctttcagagggctacacgccctcgcaatcagagggctacacgccctcgccatcagagggctacatgccttcgccgttagagg

SEQ ID NO: 22928 - DNA, 237 bp, Glycine max
  Peptide Sequence Number=SeqID_114613
atgtgctaccgttcatctggaaatagcctaagcgtgtccatgcgacactctcacttaggaaaactaggcagcaagtatcgaggtcagcctatcatgcacatgaaactccctcccccacatggtgatcaactcgagtcacaagggagttccaaatcgagtgacatgcccccaagtacaaggatatccatcatggtcactgcaccccctatgtacatacacaacatgcatccatcataa

SEQ ID NO: 22929 - DNA, 615 bp, Glycine max
  Peptide Sequence Number=SeqID_114614
atggctactccacctgcctcgcctcctcctcctcctcctcctcctgcaatagcatcaacgtctccgtataccttgaagcggacatgcaaagccacacagctacgatccttggccactagaccacctggggcagagagaccagtggtccacatcgatcctgcgatcgggaaggccgacggtccccacaagaagaaattaagaacatatttggggattgtcgctcgtgataaggttgatgtgacatacgagacttggaaggaagtccctgctactcagaagggtttgatatgggaggatattcaggctgaatttgatatccctaaagcttctgatggtaggacaaagaagaaagtacttcagactgtcagcgagcggtggagacagtttaaatttggtttgacgaggaaatgggcacttgcagctgataaggacagtgtggatgacactgttcgtgaaaatacagcattagcaaggagaaattggcccagttttgtcagaccgtcagagacccctcgtgggaggatgtgtggaaaaaggcacaagccatccaaaagcaaaacactgccccccacgtgttgtcttgtgggggttatgaatattaagaatagaagctga

SEQ ID NO: 22930 - DNA, 305 bp, Glycine max
  Peptide Sequence Number=SeqID_114615
atgacgtcaatctccatgtgtcaacgggcacatacaatgattgacaaagggtgtagaagacgacatagcaaaagaatgtttgtgggttaccttcgggtgtctccgcatgtcaccggactcttgggtcacggcgaacaagtctctgacgcacaggagttttggttggcaatcaaagggagaggaccacttccggtcgtgggcaatgtttatggtgagttgggattttggctcaaggcttgtagaacggatggacatgatatacgtcagagcgttggtttggccagtggttcagggacaaaggggat

SEQ ID NO: 22931 - DNA, 465 bp, Glycine max
  Peptide Sequence Number=SeqID_114616
atggaaattctggtcgttgttgttttggttgatgcctatgacacatttgaccgaagatgcgagaagagtagcgcaaggattgtctgttgcacacccgttctttatgtatggctggtttctcacttttttggtcatgaaagtagacctgtttgtcacctacaaggtcaccacatgtgtgccgagaaagggaaagcaaattgggagcagctcttggctggtatggtaggggcatccgttaattggttcccccaatggaaggaaggaagggcaagagttttgtcctcatgcgaagggttcccaaatgtccccttgatgggaacgaggggttgtatcaattataatctcgtacttgccataagacagttaggctatcccttgagaggagtgccatcgaaagagagtattgcacccttcatcgcacgagcctttagtgaccccaatgcaaaaacgcttcaaaaaatttga

SEQ ID NO: 22932 - DNA, 270 bp, Glycine max
  Peptide Sequence Number=SeqID_114617
atgacagacgtgtggggtgctaataccttccccgcgcgtaaatacaactcccgagggtttcacttaaaagttcgtagatcgcgtcttttctgggttttccgaagttttcctcaaataaacgttggtggcgactccgcgcgtattcctttcgtggaacatgcatcccgcgagtcacgcgtcgccctcccgccgaagggcctgaaacacacacctttcacctgccatggggtgagtgcaccatcacacacaaagatgttgcactacatctag

SEQ ID NO: 22933 - DNA, 234 bp, Glycine max
  Peptide Sequence Number=SeqID_114618
atgggatccggggcttccgggacacccaacgttttttggagctggcttgcttccggagggagcaacccagctcgcctgggcgagctgggcggcaacctcctccccctttttcctataaaaaggcttaagggggctgttctaaggatccctcagccccctggctatgtatttcagctgttttgggtgaaaaaaattatttccgtgaagaaaattcaagccgagatgcttccgtaa

SEQ ID NO: 22934 - DNA, 1374 bp, Glycine max
  Peptide Sequence Number=SeqID_114619
aagtggggcccgtttgcagatattttagctttgctgatttttggggttgtcctcttcccgaacgtcgacggtttggtagacttagccgccattgatgctttcctcgcatatcaccatagcaaggaatgtccagtggtggctatcttggcagatttgtttgacacctttgatcggaggtgtgagaaaagcagtgcacggattgtctgttgtttacccgctctctgtgtgtggttgatttcacacctattccaacaagacacgagacacccgtgtccgcatcaaagctatcgctcatgcgccgagaaaggaagagtcgattgggaccaacatttggctgggatagggggcagcgcaatcaattggtttcctcgttggaaggaaggcaaggaaggagttcttttctcgtgtggggactaccctaatattccattgatagggactagggggtgtattaattataatcccgcactcgccataagacagctagggtatcccatgaggggagcgccaaccgaagaaagtctctcgcctttccttgtgagggatctaggcgcgcaaggtctcaaggttatacaaagaatccacaaggcgtggaggagtccgttgaggaaagacaaggagcttagaggcatccgaaatggcgtcatcggaggttatcatggatggctaagaattcatacgcgagggagaacttccaagctccggaggaagatgaagaagtccgagctctcaatattagagctagggaaggcgagactcgccaaggagaagttcaaatcagccgctacacacatccggaaagagtgcaccgagttacaagaggaaaacgcgaccactgcaagagcccttgaacaagaaactaaaagggcccgcaaggaggaatatggccgagagaaattccgaggagcattgtggggtagcaacaatgagctcaagctccgaagagaggaaagataccagtcacgggtgcatggcatgatcttaaaagaagagttagctgcgtgtgcaagatccaagaggagtttggctcaacacttggaagccacagagcaaagcatgctagctatcatagggcaatacaaggaagagttgaaccagtctgtggcccatgaacaaaagctagtggaggattttgcacaagtgtacgccgaaaaagaagcaagaggaagggtgattgatgcattgcatcaagaagcgactatgtggatggataggttcgccttgaccttgaatggaagtcaagacctcccgcgtctattagccaaagcaaaagccatggacgaagtgtgtacggcccccgaggagattcatgggctaatcaattactgtcaacacatgatagatttgatggcccacataattagaaactgttag

SEQ ID NO: 22935 - DNA, 207 bp, Glycine max
  Peptide Sequence Number=SeqID_114620
atgataatacagaaaagtgatcaaggggttctcacagaccctaagagaataaaggtcaatcctaagtggcccactccaccaagtataagggaaatctggggcttccatgacttaacaaacttttacaaaaggtgtcgagggaagaagcccaaagtatcaataacctttggatttgaggtcaaatcctttccaagggggagtggatga

SEQ ID NO: 22936 - DNA, 357 bp, Glycine max
  Peptide Sequence Number=SeqID_114621
atgggtgtcgttattaaaaaagggggtgcaaatagcaaccagacccacttgggcctttcagggggttccaacagaaggcggtgccttctggtggatgcaacccagctcgcctgggcggcaatcacctccttcttttctcctataaataggggaaagagggcagagcaaaaatgttcagcccttctggtatttaggattctctcgaaattagtgagaaaaattgtttccgtggaaaaaatccaagccgaggtgcttctgaaacgcttccgagacgtttccgtgagcgatttcgtgaagatccttcaccgttcttcatcgttcttcgttcgttctttgtcgttcttcggttttcaactg

SEQ ID NO: 22937 - DNA, 576 bp, Glycine max
  Peptide Sequence Number=SeqID_114622
atgaaagcacttacgtatcacggtccgcaccatgttcgcgtcgagaatgtccctgaccccatcattgaacagcccgacgatatcatcctgcgcgttacggccacggcgatctgcggctccgatttgcatctctatcgtggcaagatcccgaaagtgcagcacggcgatatttttggtcacgaattcatgggcgaaattgttgagtgcggctcagaggtgaagcagctgcagaagggcgatcgcgtggtgatcccttttgtcatcgcctgcggagactgtttcttttgtcgtttgcagcagtacgcggcctgtgagaataccaatgccggacagggtgcggctctgaacaaaaagcaaatccccgcgccggcagcgctgtttggctatagccatcctctacggcggcgtgccggggggacaggcggaatatgtgcgcgtgccgaaagggccggtggggctactgaccattgcctgcgcgcggctgttaggggccgagcagatctttgttatcgatcaccacccgtatcggttgcgatttgccgaggcgcgttacggtgccatccccatcaactttga

SEQ ID NO: 22938 - DNA, 355 bp, Glycine max
  Peptide Sequence Number=SeqID_114623
atgactaggggcaatccaggtaatttacaaccctttgatcttgaaatagatagaacctttcatagattagttaggcatagtgtgcatcctgataattctgtgcattttgagcattgtgagcattttgagcattcagagtattttgttgctggtgattctgaatattatgattttgagcattcgactactaattttcatactgagaacgtggctcaacctccacctcgtgagaggaatcttagggagatggttgcacctgatttcacttatgaaagcttgtgcattcaatatcctgatgagggtgttccatatgttctcaagactggactaatacatttgctgcccaagtttcatg

SEQ ID NO: 22939 - DNA, 144 bp, Glycine max
  Peptide Sequence Number=SeqID_114624
atggaagggtggacgtcattgtcctcaaactgcaaagatgggtttctcacccaagagatgtattctacatcaatccacatgtcctcacacaccacgaacaaaatggtcattgcagtctcaaaggaagaatcgtcatcttcttga

SEQ ID NO: 22940 - DNA, 521 bp, Glycine max
  Peptide Sequence Number=SeqID_114625
gatcccacacattcggaaggagtgtgccgggttacgggaagagaatgcaactaccacaagggcccttgaacaagagaccaagagggctcgcaaggaagagtatggccggaataaatttcgcggagctctatggggtagcaatagtgaactcaagctacgaagggaagagagggaccagtcgcgagcacatagcatggttctgaaagaggagttagttgcttgttcaaggtccaaaagaagtttgtctcagcgtttatgcgagacggagaccaacatgctagctatcatcgccaagtaccaagaagagttaggtctagccacggcccacgagcataggatcgcagaaaaagaggctagaggaagggtgatcgactctttacaccaagaggcaaccatgtggatggatcggtttgctcttaccttgaacgggagtcaagaacttccccgcttgttagccaaggccaaggcgatggcggacacctactccgcccccgaagagattcatgggcttctcggctatt

SEQ ID NO: 22941 - DNA, 859 bp, Glycine max
  Peptide Sequence Number=SeqID_114626
ggttcctccgcaaggttcgtccacggagggtgagtcagggcctaagatcaggccgaagggcgtagtcgatggacaacaggacgcaaggtgcccctgctttttcagggtaataaggggtagagaaaatgcctcgagccaaagttcgagtaccaggcgctacagcgctgaagtaatccatgccatactcccaggaaaagctcgaacgaccttcaacaaatgggtacctgtacccgaaaccgacacaggggtgcctcctcacaaagggggtcgcagtgaccaggcccgggcgactgtttaccaaaaacacaggtctccgcaaagtcgggagccgacgaccgaagccccggtgaacggcggccgtaactataacggtcctaaggtagcgaaattccttgtcggacatgtctgtgaagatgcgggactaccttgcacctggacagaaagaccctatgaagcttcactgtttcctgggattggctttgggcttttcctgcgcagcttaggtggagggcaaagaaggcctccttctgggggggccagagccatcagcctcccaaaaggtaacggaggcgtgcaaaggtttcctcgggccagacggagattggccctcgagtgcaaaggcagaagggagcttgactgcaagacccacccgtcgagcagggacgaaactcacatcgacgggaaggtttggcacctcgatgtcggctcttcgccacctggggctgtagtatgttccaagggttgggctgttcgcccattaaagcggtacgtgagctgggttcagaacgtcgtgagacagttcggtccatatccggaccgggaaggacgcacctctggtgtgccagttatcgtgcccacg

SEQ ID NO: 22942 - DNA, 218 bp, Glycine max
  Peptide Sequence Number=SeqID_114627
cggaccgatcactaagtggggatgctccctccagcatgagcgaaccttttcgaaactggttaggaatgggcgtcactatcccagccctgatccagccagaagaggaaatcgcaatgcatcttgctcagctggcaaggcgtagcttggagtgggagtgtagcgtgggtaaggtgccggaggtcccccagttcctcggcagcacctcgaggtgcatttag

SEQ ID NO: 22943 - DNA, 411 bp, Glycine max
  Peptide Sequence Number=SeqID_114628
atggccattgaggagctttacaaacggggtgaaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 22944 - DNA, 462 bp, Glycine max
  Peptide Sequence Number=SeqID_114629
atggaacaatgtagtgcaagggaagtccgggcgataaacgtccgtaacctcgggcaagaaggattggttgagggtcccctgtgggttgcacggggcccacccgaccctgtcggtctgtcgagggactctcgagctagctatacctgcgggcccgaaagagcgtggtggacgtatgccgagcggggcgaaccggatggaactctggctggaggttcccgggcagcgatactgacgatagctggagcccgcgggcgagttctatcgggacggtgcggctgctctgttgagccgcgccatggaatcgagagctccaagtgggccatttttggtaagcagaactggcgatgcgggatgaaccggaagctgggttacggtgcccaactgcgcgctaacctagaccccacaaagggtgttggtcgattaagacagcagacggtggtcatggaagtcgaaatccgctaa

SEQ ID NO: 22945 - DNA, 446 bp, Glycine max
  Peptide Sequence Number=SeqID_114630
atgtctgacggtcaagcctctcatgacacaaattgcagcaaagatacaggggaaatcatgcttacgtttatcgaactccttattggggtcgtcgtcattgtcggtgtcgcacgctacatcattaaaggctactcggccacgggcgtattatttgttggcggtttaacactgctgattatcagcgccataatggggcatcaggtattaccagccagcgcaaccagtacgggttacaccgccactgatattgttgaatacattaagatattactcatgagccgcggcggcgacctgggtatgatgatcatgatgctgtgcggctttgccgcctacatgacccatatcggtgccaacgacatggttgtgaagcttgcctcaaaacctctgcagtacatcaactcgccctatctgctgatggtcgccgcctatttcctcgcctgcctgat

SEQ ID NO: 22946 - DNA, 599 bp, Glycine max
  Peptide Sequence Number=SeqID_114631
atgagttatcattcatctagtgttaatagtgagggtactagtcataaggaccctctatctagaatcttacatgagttgagttccctcaagttatggaaagaaaaactagaaagaaaagaaaaaggaaaagagagggtagaaataaatcaagatgagagggaacaaataaggaaagaagaaagaaggaaaatactaaaagagttaagaaaagaaaaatatgcctcctatagtaatcatgactcttgcaaaagcctaagtgaagaactttgtgactattatgaaggaaggcataggtcacatcttagacctcactccaataggagagaaaaggaaagaaatcctcaagaggctaacattaacctctcatacttccatgggaaggacaatgtagaggcttacttagattgggaaataagggtaaagcaacaacttagaaggaagtctacttcaaaatcttatcgctctcactcatatccaaagaaagaccaaggtcaaggcatcttaggggcggcaccttctaagcccaaagatgataagggaaagacaatagaaaagcaaccccctaaggctaatatgcaagagaagactagctgtataaa

SEQ ID NO: 22947 - DNA, 1090 bp, Glycine max
  Peptide Sequence Number=SeqID_114632
ggcctccaactcccagcagtttagcgccataaatgatgccatagtcattagaggagtgcatgaggtagctacaaacccatctgcatcatctgaaactaagaagcttgaaggcaaactggatgcattggtcaacttggtaacccagctggccttgaatcagaaatatgtacctgtcgcaagggtttgtggtttgtgctcctctgctgaccaccatacagacctttgcccttccatgcagcaacctggagcaattgagcagcctgaagcttatgctgcaaatatttacaatagacctcctcaacctcagcagcaaaatcaaccacagcaaagcaattatgacctctctagcaacagatacaaccctggatggaggaatcaccctaacctcagatggtccagccctcagcaaaaacaacagcagcctgctccttccttccaaaatgttgctggcccaagcagaccatacattcctccaccaatccaacaacagcaacaaccccagaaacagccaacagttgaggcccctccacaaccttccctcgaagaacatgtgaggcaaatgactatgcagaacatgcagtttcagcaagagaccagagcctccattcagagcttaaccaatcagatgggacaattggctacccaattgaatcaacaacagtcccagaattctgacaagctgccttctcaagctgtccaaaatcccaaaaatgtgaatcttccactggcaattctgatttacagaagcagcatatccctcttccattccctccaagagcaatttccaacaaaaaaaatggaagaggcagagaaggagatcttggaaacatttagaaaagtagaggagctgtgcactaataagcggaagctgaaaggaagtgaaagaattagtatgggcagaaatgtctccgcattgattggtaaatctgtcccccaaatccctgaaaaatgtaaagatccaggtcctttgcactcaactgatgtggtaattcatttagctaatagaagtgttgcctatcctgttggtttcatagaggatgtcttagttagagttggtgaactgattttccctgttgattttatattttga

SEQ ID NO: 22948 - DNA, 657 bp, Glycine max
  Peptide Sequence Number=SeqID_114633
atggatgggttggtggacctagcagcgatcgacgcttttcttacctatcatgaccacaaggaaagctcggttgtcgctatgctagccaacctatatgacaccttcgaccgaagatgtgagaagagcagtacgaggattgtttgttgtacttcagctctttatgtatggttggtttcgcacctttttcgccaagaggtgaggcatgcttgcccgctagaaagccaccattcatgcacagagaaaggaggggcaaattgggaccgactcttagcaaacaaagaagaagcgtctgtcaactggttccctcgatggaaagaaggaagaaccggggttcttatttcgtgtggaggatttccgaatgttcccttgatggggacaaggggttgcatcagttacaatcccgttcttgctataaggaaacttggctaccccatgagaggggcaccactagaggaagagctcgcgcctgtcatttcacgaggtttcaataagaccaacgtggagacacttcagaaagtccgcaaggcatgggaggtggtgcaaaagaaggaaatagaactcaggggcagtaagaatgggcccatcggtggctaccgtaaatgtttgaaagccgacgtgcaaggtttggattggctcccgagttttgagaaccgctaa

SEQ ID NO: 22949 - DNA, 70 bp, Glycine max
  Peptide Sequence Number=SeqID_114634
gaattcacaaagattcaaccgttcttcgacgttcttcattcgttcttcatcgttcttcgatcttcaacgg

SEQ ID NO: 22950 - DNA, 237 bp, Glycine max
  Peptide Sequence Number=SeqID_114635
atgacaaaaggtgcaggagacgatgttagtctctgcgcgtcaacgggctcatttgcccttggtcgacgaaaggtgcagatagcaaaagaatgtttgcgggtcaccatcgggtgtcttcgcacatcaccggactcttgggtcacggtaacaaaaggtggggtggtcaacaaaagcagggtttttgctcctacgtatcctcaatttgtgatgaggaactcagacctacgtagttcttga

SEQ ID NO: 22951 - DNA, 129 bp, Glycine max
  Peptide Sequence Number=SeqID_114636
atggacaaaacctggaacttggcacatacaggaggctgcaaagatcctagagatactggtgctggggtccaaagctattacgcgatctatcagacaaaatccgcaaaccagcttgttcgtgttcaatag

SEQ ID NO: 22952 - DNA, 366 bp, Glycine max
  Peptide Sequence Number=SeqID_114637
atggcttacgaacggggcggagatttcctggaagatgccaggaagatacttaacagggaagcgtttccccctggcggctccctcgtgcgctctcctgttcctgcctttcggtttaccggtgtcattccgctgttatggccgcgtttgtctcattccacgcctgacactcagttccgggtaggcagttcgctccaagctggactgtatgcacgaaccccccgttcagtccgaccgctgcgccttatccgtcatgcgccggttaaggctaaactgaaaggacaagttttggtgactgcgctcctccagccagttacctcgttcaaagagttggtagctcagagaaccttcgaaaaccgccctgcaagc

SEQ ID NO: 22953 - DNA, 572 bp, Glycine max
  Peptide Sequence Number=SeqID_114638
ggtgaaaggtcatttagtgaagtttgatgaggataccttgaacacattcttgaagaccgctgtagtgttggaagagggggagaacttgtgcacttattctcgatttgcactcttgaggcctgatcctcaggagttggctgctaagctttgtatcccagggaggggattcgagcttaatgctgatgggcaacctttgaagattctaaggaagaacatgactatgctcgctcagacatggagcgttctttctctttctaacctcattcgtacctcccacaaatctgatgtgacattggatagagccaaattgatttatgggattattatgaagatggacatgaacctgggctacctcatctcccaccagatctctcggattgcacaacatgacaaatccagacttggattccttgctgtcgcaacatgcccttttgcgggcgagcgaggcgagcctcacgggaaggtcgacaaaagcggggcttttgctcctgcgtatcctccatcgaagaggaaatcagacctacgtagttctttcttaagcgtgaatcaaacgattctttttactttgaaag

SEQ ID NO: 22954 - DNA, 219 bp, Glycine max
  Peptide Sequence Number=SeqID_114639
atgtcgcggaacttcacggattgcttaacgatgggtgtcaagttccttgaagcggtcaagcgaaggttgcatgtcatcaaacaatggtccccagacgaaattaggcttgtaggcctaggatcttcttcatcaatggattcctttgcttcttggaagatgaatgacagcggaatggagaaggaagagagagaggagatgccacttcaaggagaaagatga

SEQ ID NO: 22955 - DNA, 180 bp, Glycine max
  Peptide Sequence Number=SeqID_114640
atggagagccaaataaccaagggaaagtgcacttacttttcccgtgagcttggtgtttttgaaggaagacataagcatggccctctatgggtcggtgttcgcttactcgaacccactcaggctgccttgcagcggcattttccgtttgtccagagctggggaaaggacgatgatctgccg

SEQ ID NO: 22956 - DNA, 1136 bp, Glycine max
  Peptide Sequence Number=SeqID_114641
atgggaacaaatcaaaccggcaagaggttctaccaagtcaaggtcaaaagcccagataccaccagcatcaaggaattagggcggttgatggaacccctccaaatgcaagccttccgcaagacttacggaaaaatcttagaattgaccatagcagaggtgtccatagaagccattgcatcacttacccaatactacgaccagcccttgagatgcttcacattcggggacttccaattagtaccaaccattgaagaatttgaggaaattctaggatgtcctctcgggggaaggaaaccatatctttcctccgagtgtctcccctctttgagcagaattgcaactgtggtcaaggattcagccagaggtttggaccgcataaaacagactcggaacggcatagcgggcctaccacagaagtacctagaagacaaggcgagggacctagcagcaatcgacgctttccttgcctaccgccatagcaaggaaagtccggtggtagccgtcttggcagatctatttgatacatttgaccgaagatgcgagaagagtagcgcacggatcatctgttgcttacccgccctctgtgtttggttggtttcacacttgttccaacaagacacaagacatccatgtccgctcctgagccatcgctcgtgtactgaaaagaggagaatggattgggaccagctcttggccgggataggaggtagaacaatcagttggttcccccgatggaaggaaggaaaagaaggagtccttttctcatgtggaaagtacccaaacattccgctggtaggaacgaggggttgtattaattacaatcccacgctcgctataaggcaactagggtaccccatgaggggagcaccgacggaagaaagcatgtctcctttccttgtgagggatctcggcgcacagaattccaagactatacaaagaatccataaggcatgggaaaccccgttaaggaaagatcaagagcttagaggcattcgtaatggcatcatttgtgggtaccacgaatggctgaaagttcgcatacgaggtttagattggctcgccaagttaaaagtcgtcagcgaagagaattttgaagcaccggaagaggacgaagaagtccaagctctcaagagcga

SEQ ID NO: 22957 - DNA, 306 bp, Glycine max
  Peptide Sequence Number=SeqID_114642
atgactaaccgcctgagaattctttgtcttaacacattggagggtacatcctttgtggtacaagtagaggctacatctacttgggttgttgtaactgagaacaagagagggtacatctcttgtggatcagttcaagtagagggtacatccacttggttgttcaaagagaacaagggagggtacatcccttgtggatctttgcttgtaaaggattttacaaggttgaaagaaatctcaagaaccggtggttgcttggggactggatgtaggcacgggttgttgcgaggccacttgatccaacaataa

SEQ ID NO: 22958 - DNA, 206 bp, Glycine max
  Peptide Sequence Number=SeqID_114643
acttatcaaggtaatccttgtggtgtctacccagacttatcttccttcaccggaagtggcgtctacccggacttatcttccttcaccggaagtggcgtctaccctgacttatcttccttcaccggaagtggcatcatccaaaaactctacagcctgtatcaagcgatccgccccgtaaggttcacatcatctggtatcagagccag

SEQ ID NO: 22959 - DNA, 587 bp, Glycine max
  Peptide Sequence Number=SeqID_114644
ggacacaggatttatttattctgcgaagtgatctttccgtcacaggtatttattcggcgcaaagtgcgtcggctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggagatgccaggaagatacttaa

SEQ ID NO: 22960 - DNA, 522 bp, Glycine max
  Peptide Sequence Number=SeqID_114645
atgaaagataagagggatgaggaagaaaaactagaaaaacaaaagaaaaagaaggatagtaaggccttgtcttcaaaggccaagggggaggaaaaggaatccaagaagattgttaagaaggaaaatcattttgcaacaaaaggtgatattaaaaaggcactccttcttaaacaatctttctaccttctcctatcaagggaaacatcccttagcaccgccatacctcttgagcttgaggttattcctcaagtaaaggagttgttggatgagggtttggtttgcaagagcttaaatccttgtgctttgttagtgcctaaaataggtattactaggcaccaaatccctatgaatggtggtatgatgaatgtgttgagtggtgcaacactcttttgtaaaatcactcatgcacccaacatcttcatgatttgtgtacataggaactcattaggtagtgatcaagggtttcctatggacgctaagagaataaaggtcattcctgagtgcctactccaccaagtataa

SEQ ID NO: 22961 - DNA, 383 bp, Glycine max
  Peptide Sequence Number=SeqID_114646
gaaatggcgctgaaaagcttccagccaagatgtcgaggaaagatgccaccggagagggttccagtgtggccctacaggtagatgttgagtttgatagacacaggttccagagtgaggaacaccagcgaggatttgaggccattaaaggctggtcgttcctcaaggagaggcaagtccagctgagggacagagagtatactaagtttcaagaggaaattggcaatggactcagctggtgtcacccttggctaagcctaggatcttcttcatcaatggattcctttgcttcttggaagatgaatggcagtggaatggagaaggaagagggagaggagacgccacttcaaggagaagatgagtctagaagaagcgcaccaccatag

SEQ ID NO: 22962 - DNA, 535 bp, Glycine max
  Peptide Sequence Number=SeqID_114647
tcgggaaacctgtcgtgccagctgcattaatgaatcggccaacgcgcggggagaggcggtttgcgtattgggcgctagcggagtgtgtactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaatggtggcgaaacccgacaggactataaagataccaggcgtttccccctggcggctccctcgtgcgctctcctgttcctgcctttcggtttaccggtgtcattccgctgttatggccgcgtttgtctcattccacgcctgacactcagttccggtaggcagttcgctccaagctggactgtatgcacgaaccccccgttcagtccgaccgctgcgcctatccg

SEQ ID NO: 22963 - DNA, 333 bp, Glycine max
  Peptide Sequence Number=SeqID_114648
atgtggacccacaacgggtacattcagaatgaatggaaagatgctcggttgtcaccaacgtttatttgtggaaaacgtcgtaaaaaccgaagaatgaaaccggtcaaaataaaaattctaagttctccgggagttatattacgtttgaggaaggggaccggagctttgccacccagctcgcccaggcgtaccctctcagaagacaacacctatgtagttctttccggaggaagaatctgcaaggcccaatcttcattcgaagaagttacgaaaactcacggaggaaaaacacctcctttcgatttcctcgctttgaattttacggataaaaag

SEQ ID NO: 22964 - DNA, 96 bp, Glycine max
  Peptide Sequence Number=SeqID_114649
atgacgggtcgacaactccgaatcacaagctattactactgtattgtattacacggtaacgcaccagacgcgcccccgccttccttgttcaagtag

SEQ ID NO: 22965 - DNA, 408 bp, Glycine max
  Peptide Sequence Number=SeqID_114650
atggagagaagtatgatagatgatgccagtggtggagcccttggagacatgacccctgctgaagccagaaatttaattgagaagatggcctccaactcccaacagtttagcgccagaaatgatgccatagtcattagaggagtgcatgaggtagctacaaacccatctgcatcatcagaaactaagaagcttgaaggcaaactggatgtgttggtcaactcccctaacccagctggccttgaatcaccccctctgtacctgtcgcaagggtttgtgcaacctggagcaattgagcaacctgaagcttatgctgcaaatatttacaatagacctcctcaacctcagcagcaaaatcaaccacagcagagcaattatgacctttccagcaacagatacaaccctggatga

SEQ ID NO: 22966 - DNA, 1018 bp, Glycine max
  Peptide Sequence Number=SeqID_114651
atggcttcctcaccaaaagaaacttccgctcctggttcacccgctgtaccatcatctccgcaccaggaacaaccagaattcaacatccaacccatacaaataattcctggtcaagcttcagtccctgagaaactgattcccagaagacaacagggagtgaagattgctgaaaaccctagccctgcaacaagtcctagggaagtagacacggagatggacaagaaaatccgcagtattgtgagtagcattctgaaagatgcttctgtgcctgatgctgagaaagatgttccaacatcttccaccccaagtgtttccgtgcctgatgctgagaaagatgttccaacatcctccgctccaaatgctgaagccctcccttcacccagtgaagaggaatcaacagaagaagaggatcaagccacagaggagacccctgcaccaagggcaccagaacttgctccaggtgacctcattgaccttgaagaagtagaatctgatgaggaacccattgccaacaggttggcacctggcattgcagaaagattacaaagccgaaaaggaaaaacccccattaagaggtctggacgaatcaagactatggcacagaagaagagcactccaatcactcctaccacatccagacggagcaaagttgcaatcccctccaagaagaggaaagaaatttcctcatctgattctgatgatgatgtcgaactagatgtctcgacatcaaagagggccaagaaatctgggagaaaggtgcctggaaatgtccctgatgcaccattggacaacatctcattccactccattggcaatgttgaaaagtggaaatatgtatatcaacgcagacttgcggttgaaagagaactgggaagagatgccttggattgcaaggagataatggacctcatcaaggctgctggactactgaaaactgtcaccaagttgggagaatgctatgaaagtctagtcagggaatttattgtcaacattccctctgacataacaaacagaaaaa

SEQ ID NO: 22967 - DNA, 795 bp, Glycine max
  Peptide Sequence Number=SeqID_114652
atgagcgaaatcgccgcggacttgctgcgccagcagttaagtgaaattgaacgagccagcgccgaaggtaagtggttgacgcgccagcaggtcgcggacgtgcaggataaaatccgccgggctttaaccgggttgcctttccctgagagccgtctggatgaattcgataattgccgcgaactgtggcgccagtgccaatgttggcttagcgatatcgacgaggctcgcctggcgcataatcaagcctataccgaagctatgctggaacagtatcgcggtttcttcgataagattgagtcttcgccgctcaacccggcgcaggcgcgggcggtggttaacggcgagcgttcgctactggttcttgctggcgccggtagcggcaaaacgtcggtactggtcgctcgtgccgggtggttattaaatcgcggcgaagcagcggcggatcagatcctcctactggcctttggccgtcaggcggctcaggaaatggatgaacgtattcaggagcggttgggaactgacgagattgccgcgcgaactttccattcactggcgttacatattattcagcagggcagcaagaaagtgccggcgatcagtaagctggaaaacgatacagccgcccggcaaaagctattgttgaaggcctggcagcagcagtgtcaggagaaaaaagcgcaggccaaaggctggcgtcagtggctggtggatgagatggagtggcagattgacgaaggcgatttctggcaggatcgtgcgctgctgcgccgcctggccggccgccttgaccgctgg

SEQ ID NO: 22968 - DNA, 207 bp, Glycine max
  Peptide Sequence Number=SeqID_114653
atggcgaaagcacgtcaaaagggggtacggaaagtaaatgaaaataaaagcttgcaaaacaaatggggaccaccaagggggaggagcttgccacccagctcccccaggcaagccaggttgcttcctccagaagcaacccccttctggagggacatcctggaaggcccaagtgggcctggttgctatttgcacccccttttttactaa

SEQ ID NO: 22969 - DNA, 1032 bp, Glycine max
  Peptide Sequence Number=SeqID_114654
atgaccgaccctctcgatgagtcgatctcttgctttctcataagggtggacccttgggtactagtacctatcgccttaagagggttgcatgtcctcaccatcagagggctgcacgcccttgcctttagaggaccacacgtcctcgccttcagagggccaaacgcccatgcctttagaggactacacgtcctcaccttcagaggactacacgtcctcgccttcagagggctgcacgccttcgccttcagaggactacacgtcctcaccttcagaggactacacatactcaccttcagaggactgcacgtcctcgcctttatatggctgcacgccctcaccttcagaggactacatgtcctcatcttcagaggactacagaggactatacgtcctcacattaagaggactacacgtcctcgccttcagagggatacatgccctcgccttccgaggactacacatcctcgccttcaaagggcaacatgccttcgccttcagaggactacacggccttgccttcagagagctacacgcactcgccttcagatgactacacgtcctcgccttcagagggctagatgccctggccttcagatgactacacgtcctcgccttcatagggctgcacaccctcgcattcagaggactacacgtcctcaccttcagaggactacagatcctcgccttcaaagggctacacgccctcaccatcagagcactacatgtcctcgccttgaggactacacgtcctcgcctttagagggctacatgccatcgccttcagaggactacacgtcctcaccttcagagggccacacgccatcgccttcagcgaatacacgagctcaactcaagagggctacgcgccctcaccttgagaggactacacgtctcgcctttagatggctgcatgccccagacataagaggactacacgtcctcagcttcagagcactacacgtcctcgcatttagagggctgcacgccctcgcacgtcctcgccttcagaggactacacgtcctcgccgttag

SEQ ID NO: 22970 - DNA, 570 bp, Glycine max
  Peptide Sequence Number=SeqID_114655
atgagcctgccagctccgccttggccctatgccttttggccagctcgtctggacttggctttgaccggtctgcccccctcttgcaaggattcggcgcctccacttgatgctttacgcccacgcttcgttcaggcagcgctactcggatatgtcttgccaatcgccaaagcagctctatcccgggacgaagagaaagagagggggaaggccaagtacgagatcacagggatcgggctggtggagcttgacagagcgatacaggaaaccatacaatcgaaggctagcaagagaagcaaaaagatagtcaaagctcaagggattcatcacgaaggcaaggagcagctcatccgtcaggatgggatccctctacttcacgtttttggcttatctttttcttgcgttgacgcttccaaagcggctccgtctccgcctccgccttctgcgctcccagttggagttcgaactggtgcttacaccgaagcccttgcccttgccaacaaacgggaagacataccagcatgcggaagaggtagagggactggcttactaggtcgaagcgacaagccttag

SEQ ID NO: 22971 - DNA, 264 bp, Glycine max
  Peptide Sequence Number=SeqID_114656
atggctggttgtggaaagggttgtacatattgggttctggacgttttctatcagatcccaacgcttggagggattgatggggacccagtgttgagaggaacgaggataagggctacgtgggagtacgtgaactcagttgaaggtgtgcaactggggatggtggatttatgtgtgatttgtggatgtggagagtcgacttgcaccattgcccgatcgccaccttgtaccacatatgacgggtaccccataatcctacaagcttga

SEQ ID NO: 22972 - DNA, 1003 bp, Glycine max
  Peptide Sequence Number=SeqID_114657
atggcagagccatcgaagaagagaaagggatcatcctccaccgctgctgctgctgcccatcgccgccacggcccatccggagcacccacaacacctattcatccttctttgacatctccaagatcatcaacattgtttttatccgatgatcagcctctacggtacctttctcagttttgttctagaataatcttagaccctaagtacctagacatagaattctttaatgatgaaacgtttgattgctatcaagtgtttcaaaattctggtcttgttgatttcatgtcattaaaattgccatattatcctgaacttgtaaaggtcttctactgcaatttaaaaattcaggatggcattattatttctgaggtgcatggtatttctatggtcattgatcagtcactattcttttctttgactcatttacccagtcaaggtgcaccttttgagggcaccattgttgatgactggaaattcgattattcgagtcatgatgctcgtcgcatggtctgcaatgatcaagctgaaatgaccggtagattgctggccgggattttgcttcctcggtcttcaaatttagcacaagcctctgaggaggatttgatttttatgtgggcttttcttaccggtcgtcagatcgactgggcccatttggttcggtaccgaatgcataaggcattacgggccaatgcacctcttccttatccacatttgattactctgtttttgcgtcattttcaaattcctcttgatgatgaaccctttgttcaagtcacgcattcctttgcaattggtgtccccgcagtgacctcctttgggtaccgtaaagatcggaatggtcaatggctgaagaaggatgcactccctcctcaagatgaatgtactccttcacctcctcctcaacgcgaagattccgcactcatgaatgaagtcctctccgaattacggggtcttcgttcttatgttggtgaccgcttcgactcgttagatacacgctttgccg

SEQ ID NO: 22973 - DNA, 171 bp, Glycine max
  Peptide Sequence Number=SeqID_114658
atgcatgatgcgatcaaggaacaagccagaggactgtcagggacaatgccttaccaaaacaggaaaactctagatgaggcttcactatcctcaagcgagtcggagacccaacatgaccacagatcgatctcctctccctatgtctcacacggacccgggtatagggcctaa

SEQ ID NO: 22974 - DNA, 234 bp, Glycine max
  Peptide Sequence Number=SeqID_114659
atgagggacattcagctcttgactcatactgtcacacccagcattctgatcctttgtgaaggttttacattgaatccttctggtattcactacgctgttcctgatgtcgaaagggatgttccggcagtcagtgcctccttcaccatgcactttgttgaactgtttgtccgactaggaagccatcatggactagcatttcagccttcatcagtgatccaggtctactctctttag

SEQ ID NO: 22975 - DNA, 583 bp, Glycine max
  Peptide Sequence Number=SeqID_114660
atgatacaagctgaagcaaaagaaggtttgaggacaaatataactaagggaaaagatcaacaatgtttgcaagaagggacaagtagaggaagatatgaagcaaggacaacagcaagagactttcctatgcaaatagtagactcacttgcaacgacaagaaaggaaacaaaggacaaagagatagatgagccagccaaaagaaagagtgaggaaacagatgttgttgagtctacaattgaggaaaaagttcaagtgcctgagagtggaagaatttccatgactttcaaagtaacagaggataaacatccaaaagtattagagattgaatctcctgaaagtgaattgcaatcaactaaaggcccaactacacgtgcaattagtgtggaatttaaggaggttgaacaaacgagtgcaaaggataagacacagaaaacaaagttgttacctccaaatattcaaagcaaggagactcatgaatcaaacgaaggaggtgtgaaacaagacactataaaaccaaagaaagaaaaggaagtagaaggagaacagtgcacttatacattgaaagctctaaagaggttgcaag

SEQ ID NO: 22976 - DNA, 162 bp, Glycine max
  Peptide Sequence Number=SeqID_114661
tcgatgtcagccaagaaagatgacgaccgatccaggtctaaaaaagaagaatcaccagatgacgctgatcgaacatttcctaatagacatcgtccaaatatcatcgggggattgaaaagaaaaaacattagcggacattggtcgttaaataaccccgattga

SEQ ID NO: 22977 - DNA, 793 bp, Glycine max
  Peptide Sequence Number=SeqID_114662
atgcgtcgtgttcatcaggccatgctcaatcccgaactgctgatgcagcacctgagccgccggtgccagaccgttggtggtgcaactcccgttactcaccacaacgtgccgggcgggatcgtactggtcatgattgacgcccataacaatcgtcaggtcgtcgttctttccgggggcggagataatgacgcgttttgcgccaccgtgggtgatatgtaccgccgctttttcccgttcagtaaagaagccggtggcctcaatcaccacgtccacgccgacatcacgccacgggatattcgccggatcgcgttcgctgaatacggtgatcctctgcccgtcgacctgcagcgcgccgtcggccgcttcaacgggagcgggcagtttccccagcagggagtcatgtttcagcagatgggcgagggtcttgctgtccgtcagatcgttaatggccacaatctgcagatccgggttgcccagcgccgcgcgcaggaaattacgtccgatacggccgaaaccgttaataccgaccttaaccatggtgcactccttatctctgttgtctggagtcactgtaggcgtcaggcgggatggcgtaaacgacaaaaaaggatcagattacgccattttccggcagtgaaatcgctggcgatactcgcccggggtgaggtggagctgtttctcgaacacgcgccgcaaattaatactggtgccaaacccgctttgctcagcaatgcgctcaaggggagcgctggtctgctcaagcggctggcgggccgcagcctcacttgcttcg

SEQ ID NO: 22978 - DNA, 951 bp, Glycine max
  Peptide Sequence Number=SeqID_114663
atgacggaactggcaccacgggaaaaactgacgctgctgggcgccgaggcgctaagcgatgccgaactgctggcgatctttttacgtaccggcacgcgcggcaacagcgtgatggggctggcgcggctgatgctgaatgaattcggttcgctgtatcgcatcatgaccgccagtaaagaggagctcgggcagataaagggcgtcggcagcgccaaaatgacgcaactgcatgccattgcggaactggggcggcgcttttttgccagccagctggcgcgcgaaaatgtcatggagaatccgcaggtcacgcgccactacctgcaaagcgtgctggcacatcaggagcgtgaaatctttatggcgctgtttctggataaccagcaccgcgttttgcaggcgcagaagatgttttccggctccattgccagcgtggaagtgcatccgcgtgaaatcgtgcgtgaggcgctaaagctcaacgcggcggcggtgatactggcgcataatcatccgtccggcatggcggaaccgagccgtgccgatcgcgagattaccagcaaggtggcgcaggcctgcgcgctgctgaatatccgcttattagatcatctggtgattggtcacggcgagtttacctctttcgctgagcgcggctggctcggcgtatactacgccacctttgagaatctcgggtttggcgtttgggccagcttagcggaaatgtcacgagtctgccaggtaactggaaagcgtccggtgaccggtaacaaccgttcccacgcaatgaacgcgacgaaacgccgtttcctgccgaacctgcactctcaccgtttctgggttgagagcgagaagcgcttcgttactctgcgtgtatctgctaaaggtatgcgtgttattgataaaaagggcatcgatacggttctggccgaaatccgcgcccgtggtgagaagtactaa

SEQ ID NO: 22979 - DNA, 405 bp, Glycine max
  Peptide Sequence Number=SeqID_114664
atgactggtacattcttccttttgaaacagcaaaatagtttagagattatgagcggtaagaaagaaatgactccgaatagagttgtgaacaggtcattcaggactctatgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtgttacgcgcagcgtga

SEQ ID NO: 22980 - DNA, 696 bp, Glycine max
  Peptide Sequence Number=SeqID_114665
atggaaaaacgctgtggcattgcgccgggagacgatttctctcagcgtgatgcgacggcacagctgccgaaaaaagggcgctttagcgaaatctgggcaccggcttatcgccagcgtacgctgatgctggtggtgatgaacttcttccaggcgattggcttcttcggcttcggtaactggctgccggcgctgctgtccggcaagggggccaccgtcacccacagcctgctgtacgccttttttcatcacgctggcctatccgctcggctcgctgatttgcagccgctacgccgaccggctggaaaacaaatggcagatcgttttttcatcgctgatgacggtggtgttcggcacgctgttcgcgctgaccagcaacccgctgctgatggtggtgtgcggtttcctgatcacctacagcaacgcctggctgaccttcagctatcacgcttatcagaccgagatcttcccgacgcacattcgagcgcgcgccgtcggcttctgctattcgttcagccggctgtcgaccgctttcagcagtattctgattggcctgattctgcagtatgccggcagtcagggggtgatcgtatttatcgtgctgagtatgctgatggtgatgctgtcggtcgggatttacgggccgaagacgcgggggctggatctggagaacatttaaaccggatgggcgcagggtag

SEQ ID NO: 22981 - DNA, 417 bp, Glycine max
  Peptide Sequence Number=SeqID_114666
gtatgctctcactcgaacccttcacagaagatcagggtcggtcggcggtgcaacccacagggggatcccaccaatcagcttccttgcgagcctgtacgggttagtactcgaccgggcgttgggagactcgcaccagtcagactcctggtcggtttcaagacgggccgaaggggagcccggacagccgacgccaggagcgtgcaggtgctcgagcacttccaagggcgcgcgctggaccctacccaatccggcgatgagaccgtttccaggtggagcaggctgttatcaacagaaaagaaatctttccggggggccaccatcgcaaccgacgtctccggatccctaacgttgcccgtcagtccgccatcggtcggaccggctctcacggaatttaacccattccgactttcggagtag

SEQ ID NO: 22982 - DNA, 477 bp, Glycine max
  Peptide Sequence Number=SeqID_114667
atgaccatgattacgccaagctcgaaattaaccctcactaaagggaacaaaagctggtaccgggccccccctcgaggtcgacgaggcttgaaaaatggaagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 22983 - DNA, 195 bp, Glycine max
  Peptide Sequence Number=SeqID_114668
atggataagagcttgaaggtaggagaagatgagtggagggagagggtgagaaggagcacgaaatttggtgcctcaaatgagctatggttcagcccactaatccaagatcaagtccaagattctccactaagtgtgtgcttaggtatcatgaggcatgtaaagcatgaaggacatgcacaaggtgtgactatatga

SEQ ID NO: 22984 - DNA, 567 bp, Glycine max
  Peptide Sequence Number=SeqID_114669
ggagtgaagattgctgaaaaccctagccttgcaacaagtcctagggaagtagacacggagatggacaagaaaatccgcagtattgtgagtagcattttgaaagacgcctctgttcctgatgctgagaaagatgttccaacatcctccaccccagatgttgttgtccctgaagctgatgaagatgtcccaacatcttcaccccgaatttctgtgcctgatgttgagaaagatgtgtccaacatctaccgccaaatgctgagaatgctcacaagagtacccaatgtcgacacaccagaactgctccatgaccattcatactgtgacaacttgagtgctattaatatttctaaaaatcctgttcaacatgagcagaaccagcacattgccaacaaattagacatcactatcattagagagtgtttgtcagaggaaagtggttatctcacacctggagcatgtgatcaacaaatacctgaggagaccaacatggagcagatattgctgtctctgagcataagattgccagaaatcactgccaaaacgagtccagcattggcaaagaactga

SEQ ID NO: 22985 - DNA, 144 bp, Glycine max
  Peptide Sequence Number=SeqID_114670
atgtgggatcggcacaggcttaaaggagcactcaaaccgggtgtatttactcctaaggtatacactccgaagagtccgtcaaagcctctccctcctaattcaggtcccctcagtggttctcatgataatactcgtcccccttaa

SEQ ID NO: 22986 - DNA, 171 bp, Glycine max
  Peptide Sequence Number=SeqID_114671
atgggtgccaagtacctcgaagtggtcaaacgagggtcgcatcccaacaatggacggtccccggacaaaattaggggcgcaggatttgtctctgcgcgtttatcactcattgagcgtgtgaatgaccgtaattggtctctgcatgtcatcgggcccgccgcctctggatga

SEQ ID NO: 22987 - DNA, 479 bp, Glycine max
  Peptide Sequence Number=SeqID_114672
tgggttacacaccttcgagctttgcggatttggtcttcgttggcgaaatgatcgaagtgggtctgaaaagaggcaaatctgatcatcatgctttgataaatgagaaaactggggcaaatgaagagggtgagaatgaaagagaaacccatgttgcgactgccgttccaacatggccaagtttcccaccaatccaacaatgtcattactcagccaaaaacaaaccctctccttacccaccatccagttatccacaaaggccatccctaaatcaaccacaaagcatgtctaccacacttccaatgacgaacaccacctttagcacaaaccaaaacaccaaccaagaaatgaaatttgcagcgaaaaagcctgtagaattcaccccaattccggtgtcccatgctgacttgcccccatatctacttgatactgcaatggtagccataacccctgctaggtttcctcaacctccatttttctga

SEQ ID NO: 22988 - DNA, 255 bp, Glycine max
  Peptide Sequence Number=SeqID_114673
aggatacctcactcctccccctatttatagcaaaataggggaggagcttgccacccagctcgcccaggcgagcaatgttgcttcctccagaagcaacagccttctggaggaaggatctggaaggcccaagtctcgggacttcatttattgtgcaacaaaggacgccaagtctctcaaagcggctaaccaaagggacaagatcgttttaagcaatagtcaaataccgcgccaagtccaagacagagatgaatcgag

SEQ ID NO: 22989 - DNA, 642 bp, Glycine max
  Peptide Sequence Number=SeqID_114674
atggtgagtcttgcaactccaaaggctctcaaaacccaaggtccgcccttggtgagtcttacaagcttgtcaaacccaaggtccacccttggtaagtctcgaatctccaaaggcttatcaatcccaaggtctgtccttggtgaatcttgcttctccacaagctcttcaaacccaaggttcgcccttggtgagtctcgtttccctaaaggctctcaaaatccaaggtccatccttagtgagtctcgcatctccaaaggctcattaaacccaaggtctgtccttggcttatcaaacccaaggtccgcccttggtgagtctcacttctccaaaggctcacaaaacccaaggtccgcccttggtgagtctcacttccctaaaggctcacaaaatccaaggtctatccttggtgagtctcacttctacaaaggctcacaaaacccaaggtccacccttagtgagtctcgctttcctaaaggcttgcaaaatccaaggtccgcccttggtgagtctctcatctccaaaggctcgtcaaacccaagatttgtccttggtgagtctcacttctccaaaggcttgcaaaacccaaggtccatccttggtgagtctcataggcttgtcaaacctaaggtccatccttggtga

SEQ ID NO: 22990 - DNA, 72 bp, Glycine max
  Peptide Sequence Number=SeqID_114675
atggagaaaaatgaagaaacaacaatggaagagaagggcttttatggaggctggatctttgagcttcaatga

SEQ ID NO: 22991 - DNA, 264 bp, Glycine max
  Peptide Sequence Number=SeqID_114676
atgcccttttgtgggcgagcgaggcaaggctcatgggtgcgcttttcaaaggtggaaagatgcgcggagtcgccaccaatgtttatttgtggaaaacgtcggaaaaatcgaaggaaaccggtcataaagaatattccaagttcgggagttgtatttacgcttgaggaaggtattagcacctctcacgtcgacaaaagcggggctcttgctcctacgtaccctccatcgaagaggaaatcagacctacgtagttcttttttaagg

SEQ ID NO: 22992 - DNA, 393 bp, Glycine max
  Peptide Sequence Number=SeqID_114677
atggcgagaatagccaaggtagtcaaaatctcggtgcaggaattggaccgagtaaaacaaaatagaaatggggtggttggaataccaaggaggtacttggaggagaaagcgaaggctttggcggatcaaggtgaatgggtttcgttcattgatgtcttggcattattgatattgggagtcatcctttttcaaaatgtggatgggctagggaatttagtggcgatcgacgccttccttgcttatcaccatagcaaggaaagtctgctctttatgtatggctggtctctcacctctttcatcatgaaagtagacccatctgtcccctgtaaggtcaccgtatgtgcgccaagaaagggaaggaaaattaggagcaactcttggctagtatggtag

SEQ ID NO: 22993 - DNA, 81 bp, Glycine max
  Peptide Sequence Number=SeqID_114678
atgaagaagaattgccctagattccagaaacgacttgagaagaaagggtatgcaaaatctaaggaaaccagtgggaagtga

SEQ ID NO: 22994 - DNA, 96 bp, Glycine max
  Peptide Sequence Number=SeqID_114679
atgtcggctgaaaaatatcagtcgaggttttacaacgaccgatgtcggctattgaaaatgttcgatcggcgtcatccgatgatgcttccgttttaa

SEQ ID NO: 22995 - DNA, 216 bp, Glycine max
  Peptide Sequence Number=SeqID_114680
atgtgctcgcgactggtccctctcttcccttcgcagcttgagttcattgttgctactccacagagctccgcaaaatttgttacggccatactcttccttgcgagccctcttggtctcttgttcaagggctcgtggtccctctcttccttccggatgtgtgtagcggccaccttgaacttctccttggcaatcttcgcctttcctaactcgctttga

SEQ ID NO: 22996 - DNA, 679 bp, Glycine max
  Peptide Sequence Number=SeqID_114681
tgaagtgaagaagaaaggggaagaatctagtgtagaaatctaccaccaagaagatggacaaccattagtggttaaagagaagtgtaaggaggtaagtgtctcctccaagaggttagctaagaaggaaaatcattttacaataaagacaaacattaaagaaactttccctcttagacaacctccacattttctcttttgtaaaaagacacttgctagcaatgccacacctcttgttgggcttgagtttattcctcaagtaaagaagttgttggatgagggtttggttcgtaagagcttaaatccttgtgctttgttggtgcccaaaataggtattattaggcaccaagtccctaacataggtggtatgatgaatgttttgagtggtgcaaccctcttttgtaaaatcactcgtacacctaacatcttcatggtgtgtgtacatagggacccattaggtagtgatcaaggggttcccatgaaccctaagagaataaaggtcattcctgagtggcccactccaccaagtataagaaaaatttggggcttccatgacttaacaaacttttacaaaggtgttgaggaaaaaagcccagagtttgaagaacctcgggatttgaggtcaaatccttttcaagggggagggaatgatgcaatcctaccccgcaagggcattggatag

SEQ ID NO: 22997 - DNA, 231 bp, Glycine max
  Peptide Sequence Number=SeqID_114682
atgtatcctctctgttctcaatattacaaccaagtagatgtacgctctacttgtaccacaaaggatgtatcctccaatgtgtttagacaaagaattcttaggcgtgtaatcgattacacaacaacagatgtaggactcttcagtttaaatgaagacaaacacaagagttttatattggttcgacaacaacccgtgcctacatccagttcccaagcgacctgcgatccttga

SEQ ID NO: 22998 - DNA, 207 bp, Glycine max
  Peptide Sequence Number=SeqID_114683
atgggggtgcaaatagcacccaggcccacttgggccctccagaatattcctccagaaggctgttgcttctggaggaagcaacctggctcgcctgggcgagctgggcggtgtcacaacctacccttcggcgggagggcgacgcgtgactcgcgggatgcgtgttccacgaaaggaatacgcgcggagtcgccaccaacgtttatttga

SEQ ID NO: 22999 - DNA, 354 bp, Glycine max
  Peptide Sequence Number=SeqID_114684
atgcccttgccttcgccttcttggattttctctctttatgattctttatttgggttatggtgggattttcaggcagcggatgcacttcataatcctcttccacaacatccaacaaatccaaagcctccagggttgcttcacaagaaaaacattacttcaagattaatacaagattgtttcaacaaacaaagctttgtttcaagattcactaaagatcaagccttgcctcaaaacaaagtgtttccaagacatccaaggctctgggtaatgttaaaaagggttttgaatttgaattttgaacctgtaatcgattaccagatatttgtaatcgattaccagcaacggaacttttga

SEQ ID NO: 23000 - DNA, 183 bp, Glycine max
  Peptide Sequence Number=SeqID_114685
tcaattcagacctctttcacgtcgtcacgcaccctctttttttctgtgcaaatcaggcttaaaaagggctttctgacctcggaggcgcacttagtgcgagtaagtgatatttggcttagcgccaatcttgcgcttagtgcagaagagacaaccgcctcgctttgcaagctgcatacgcgctaa

SEQ ID NO: 23001 - DNA, 354 bp, Glycine max
  Peptide Sequence Number=SeqID_114686
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcgggcgcattaagcgcgggcgggtgtggtggttacgcgcagcgtga

SEQ ID NO: 23002 - DNA, 294 bp, Glycine max
  Peptide Sequence Number=SeqID_114687
atgtattattgttcttttgaacaggataatactttctattttctgtacaaagaagggattctgcaggatttagaagtaacagcaattccagaggaagactcaagctttgagcttctagttttcctacaggacaaaattctcattcagatcatatcgaagaccacagaggctgaagagccaagaagagggatcgaggacccgaagattggattcaagttaatcggtctgacaatcgaggttttcaccagttttaggctcaaccagaagttcaacacaagcttagcatgccattga

SEQ ID NO: 23003 - DNA, 718 bp, Glycine max
  Peptide Sequence Number=SeqID_114688
atgaggggagcaccgacggaagaaagcatgtctcctttccttgtgagggatctcggcgcacaaaattccaagactatacaaaaggcatgggaaaccccgttaaggaaagatcaagagcttagaggcattcgtaatggcatcattggtgggtaccacgaatggctgaaagttcatatacgaggtttagattggctcgccaagttaaaagtcgtcagcgaagagagttttgaagcaccggaagaggacgaagaagtccaagctctcaaaagcgagttaggaaaggcaaaacttgcccaaggagaagttcaagttggccgctacacaccccttgaacaagagaccaagagggctcgcaaggaagagtatggccggaacaaatttcgcggagctctatggggtagcaatagtgaactcaagttgcgaagggaagaaagagaccagtcgcgagcacatagcatggttctgaaagaggagttaattgcttgttcgaggtccaaaagaagcttgtctcagcgtttatgcgagacggagaccaacatgctagctatcatcgccaagtaccaagaagagttgggtctagccatggcccacgagcatagaatcgcggacgagtatgctcaagtgtatgcagaaaaagaggctagaggaagggtgatcgactctttacaccaagaggcaaccatgtggatggaccggtttgctcttaccttgaacggga

SEQ ID NO: 23004 - DNA, 318 bp, Glycine max
  Peptide Sequence Number=SeqID_114689
atgttagccatcatcagcaagtaccaagaagaattaaatttagccaccgcccatgagcacaaagtggcgaacgaatacgcccaggtgtacgcagaaaatgaggctataggaagggtgattgactcgttacatcaagaagcaacgatgtggatggaccggtttgctcttactttgaacgagagtcaagaacttcctcgactgctggccaaggccaaagcaatggcagacgcctactccgcccccgaggagatccgcgggctcctcagctattgtcagcatatgatagacttaatggcccatataattaggaaccgctag

SEQ ID NO: 23005 - DNA, 348 bp, Glycine max
  Peptide Sequence Number=SeqID_114690
atggtgaaagttggaacctcttacgtgccgatcaacgtctcattttcgccaaaagttggcccagggcttcccggtatcaacagagacaccaggatttatttattctgcgaagtgatcttccgtcacagctgtccctcctgttcagctactgacggggtgggttttcccagtcacgacgttgtaaaacgacggccagtgaattgtaatacgactcactatagggcgaattggagctccaccgcggtggcggccgctctagaactagtggatcccccgggctgcaggaattcgatacgtgtagtcctctcaacggtgagggtaactagtacccaaggtgagggcgtgtag

SEQ ID NO: 23006 - DNA, 1023 bp, Glycine max
  Peptide Sequence Number=SeqID_114691
atggccaagttcgatccagacatagtcctcgaattttatgccaatgcttggcctacagaggagggcgtgcgagatatgaggtcctgggtgaggggtcagtggatcccgtttgatgcagatgctatcagccagttcctgggataccctttagtgctggaagagggtcaggagtgcgagtatggccagaggaggaactggtccgatgggttcgatgaggaggccatcacccatttgctatgtataccggggcaggattttgcccggactgctgccgggagacgggtgcggatcatgcacaccaacatgaccaccctgactcagatctggatgactttgctgctcaacaacatccagcccagcgatcataattctgacctccccctgccaaagtgtcagctggtgtacaccatcctgacatggatgagcattcacgtggctcagttaatcgctgatgccatctatctatttgcaggtatggcgcctaccaggcaccctctggacccggataagtccaacagggccatgggatttcccgccttgatcacaggactctgccagtcgttcggagtccccgtcgcacctagcaaggtcattcagccgcccatcacccgagcttttattgagaagtattgcacacagagacaggcccagggggatgtttcgcaggccgcagacgcaccgccacctcatcaggctggtccagccggatcgtttgatacggagcagtatttgcggcatttggttcgccagcaggcggccaaccaccgggctcatgtacagacccatgattgtctttaccagatgagcctcagcctgcagagccagggttttacttcttttctgtgccctactccggatcagttcagggcagaggtcgcatggcctggagattggcctgaggcccgggcaggagaggcgccagcagaggcaccagcagaggctcccgacgaggcagatgaggcccgcgaggacgaggagatgaccgatttacttgatttcttaggagggagcggggccacatga

SEQ ID NO: 23007 - DNA, 687 bp, Glycine max
  Peptide Sequence Number=SeqID_114692
atgactcctgctgaagccagaaatttaattgagaagatggcctccaactcccagcagtttagcgccagaaatgatgccatagtcattagaggagtgcatgaggtagctacaaacccatctgcatcatctgaaactaagaagcttgaaggaaaactggatgcattggttaacttggtaacccagctggccttgaatcagaaatttgtacctgtcgcaagggtttgtggtttgtgctcctctgctgaccaccatacaaacctttgcccttccatgcagcaacctggagcaattgagcagcctgaagcttatgctgcaaatatttacaatagacctcctcaacctcagcagcaaaatcaaccacaacagagcaattatgacctttccagcaacagagacaaccctggatggaggaatcaccctaacctcagatggtccagccctcagcaacaacaacagcagcctgctccttccttccaaaatgctgctggcccaagcagaccatacattcctccaccaatccaacaacagcaacaaccccagaaacagccaacagttgaggcccctccacaaccttccctcgaagaacttgtgaggcaaatgactatgcagaacatgcagtttcagcaagagactagagcctccattcagagtttaaccaatcagatgggacaattggctacccaatga

SEQ ID NO: 23008 - DNA, 489 bp, Glycine max
  Peptide Sequence Number=SeqID_114693
atggggatgaccgagcaattgccaacaattctgaattgtgatttcattgagagggatcatgccaaaaagagattggatagtcatcactttgaacctaatggaagtagcggtttgtatggccagcatagtgtgaagaagctgaagccaacaaaacaatcccttgataattttgacaatgttgctccaatagctaattctattccctcccctgctgcttcgcaaatgagtaacatgtccagtccaagtaaatttattagaatcattagtggtggacgagatagggggaggaaagccaaagcacttaaggtttctgtgggacagcctggttctggaagtccttggtcactatttgaagaccaggctgtttgttgttcgatagctcttgttgtcctggtgcatgatatgggtccaaactgggagcttgttagtgatgctatcaacagtactagagaagggtttaggtcgtatgacttgacccgtatgacatga

SEQ ID NO: 23009 - DNA, 450 bp, Glycine max
  Peptide Sequence Number=SeqID_114694
atgactatgcaaaacatgcagtttcaacaagagaccagagcttccattcagagcttgactaatcagatgggacaattagctacacaattgaatcaacaacagtcccagaattctgacaagctaccttctcaagctgtccaaaatcccaaaaatgtcagtgccatttcattgaggtcgggaaagcagtgtcaaggacctcaacccgtagcaccttcctcatctgcaaatgaacctgccaaacttcactctactccagaaaaaggtgatgacaaaaatttacctaacaatttctgtgcagaagcagcacattccccctcttccattccctccaagagcagtttccaacaaaaaatggaagaggcagagaaagagatcttggaaatgtttagaaaagtagaggtaaacatacctctgctggatgcaataaaagcaaattccaagatatgctaa

SEQ ID NO: 23010 - DNA, 224 bp, Glycine max
  Peptide Sequence Number=SeqID_114695
ttgaaaggaaagatattgagctggtaaacgaggaagaagcacaaattggtgctgatcgttctagtgcaacctctaataaatctgagatttataaggaggaagcacggaatgcagtacagaagcataaaccaaagcgggtggagagtgtcaatgttgatgcagaagcctttggtgatgactggaaaattcagactgctctatgcattctgaagctaaaccaatag

SEQ ID NO: 23011 - DNA, 287 bp, Glycine max
  Peptide Sequence Number=SeqID_114696
cggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttccaacagttgcgcagcctgaatggcgaatgggacgcgccctcgtgaccgctacacttgccagcgctgatgtccggcgtgtgcttttgccgttacggcaccaccccc

SEQ ID NO: 23012 - DNA, 535 bp, Glycine max
  Peptide Sequence Number=SeqID_114697
ggtaccccatgaggggagcaccgacggaagaaagcatgtctcctttccttgtaagggatctcggcgcacaaaattccaagactatacaaagaatccataaggcatgggaaaccccgttaaggaaagatcaagagcttagaggcattcgtaatggcatcattggccccccgccaagacttacggaaagatcttcagaagagattttgaccatagcacgaggtgtccatagaagtccaacttgctcaaaagcgagttacggaaagcaatactacgaccaagcctttgagaagcttcaagtgtgccgggtctacggggaagagaatgccatatctaccgcaagagtgtctcccctctttgagcaagaattgaccaactgtggtcgcaaggattcagcaagagaagcttgtctcagcgtggtggttgatcgagacctagcagacaacatcgtagctatcatccttgccaataccacagcaagagtgtggtctagctgcactggccacgagcatattgaacgggatttgagtatgccaag

SEQ ID NO: 23013 - DNA, 522 bp, Glycine max
  Peptide Sequence Number=SeqID_114698
atgggaataggagagaagttatctttcggggggtgctttcatccatgttggggcggtggtgaccgcgtgggtatctccttctttttttcctcgcccaccactggggctcttctgttgttattgggggccgtgttggaggcatattcgaacttgccttttctcagtccagattcaattctttcttccggcgaagacgagatccgcaaagttagctggcgtgtagcctatcagcttttcatagtagaacgtaggcaacgtatctaccatgattgtgatcatctccctctccatcatgggcgggacgacttgggctgcgagatccctccacctttgggcatattccttaatggactcatgttcttgcttggtcattctctgaacccccccccccacaacaggagccatatccgtattgtattggtactgcctctgaaggcagtcgccaagtctttccatgatcggatctgggtagcttccagattggtataccatgccacagccgctccggccaagctatcttga

SEQ ID NO: 23014 - DNA, 513 bp, Glycine max
  Peptide Sequence Number=SeqID_114699
atggattctcaacgctttgaagccatgcttcagagcattcatcagggacagatcattttacttcagagtttacaggtggtggtgcctccagggtccattccttccattgagaagtttctaaaaagggtagcctggattggggcccaaccttctcttcatagggaagatgaaggtcccacaacccaggtaccacagcatgtagaggatgcgtcatctgtggccatcgttccagagccattcattgtagaggaggaggcaggtgagacacaggttatacaggaagctgttgctactcctgagaggtcacgaaagggcacatcagatccacccacaccagtagtggacctatcctcacctcagcatacagcagacccctccactcctatactcgagatatcagaggacccgaccacaccagtcctgactttgaacacttctcctccaactactccagtactttatctaatagataaggaggatgttcagacacaggacacccaggaccagtcatag

SEQ ID NO: 23015 - DNA, 147 bp, Glycine max
  Peptide Sequence Number=SeqID_114700
atgaattcattgcccagcgctgttcgtctatcctccaccgtcctattcggagccccattaattgattgcctagcgttgttcatgtgtcctccgttatcaagcgcggagcctccgaaaaagaagaaggagagacggaagtcgtcatag

SEQ ID NO: 23016 - DNA, 735 bp, Glycine max
  Peptide Sequence Number=SeqID_114701
atgggtcaacttcaacagcaagccttccgcaaagcctatggtaagatttgggacctagctagggtagaagtctccatggaaccgattgcatcccttttccagtattatgaccagcccctaaggtgcttcacattcgaggacttccagctagtgccgactgtgaaagagtttgaagaaatcctgggatgcccactaggaggaaggaagccatatcttttctctgggttctatccctccacgacaagagttgccaagtatcaaggaagtgtttggaggaatgggcaaaggccttggaaaatcaaggcgaatgggctttcttttattgacatcttggcgcttttgatctttggagttgtcctctttccgaatatggaagggttagtggacctagcagtgattgatgctttcctcgcctttcatcatggcaaggaaagcccggtcgtcgccattttggccatgtatgacacgttcgaccggggatgtgaaaagagcgacacaagaattttttgttgtgcactggctctctatgtgtggctggttgcacacccttttctccaagaaggtaggcccatctatccgctacaaggtcaccgctcgtgcgtcgaaaaaggaaaggcgaattgggaccaactcttggctagcatggaggggcgtctgttaattggttccctcgctagaaggaaggaagaatcaggattctatcttcatgcgaaggatgtccaaatgttctcttga

SEQ ID NO: 23017 - DNA, 213 bp, Glycine max
  Peptide Sequence Number=SeqID_114702
atgcccaacaagaacaccaaccactctgttcccattccccataaaggccaccaaccccacttggggcatacaccctttgttcagcctgtaggggaagctcgtgaagagccccggaatcatgctctgggtgggtttgcaccataccctacatatgccgctgaggggccacaatttagtggtatgcctcagcccaatgccgtgggagctccttaa

SEQ ID NO: 23018 - DNA, 291 bp, Glycine max
  Peptide Sequence Number=SeqID_114703
atgtctcctccacctctagaacctcacaatcactcacagactcatctcatgctctcagatggtggccttgttggtgcttgtgcacttagcgcaactctggctcgcttagcgcccattagtgaattttggcttaacgcgattcttttcgctcagtggatggactcaagcggtgcgcttagcgaacatgcacagctcatccttcttctagattcttcctcacgctcagccaaaggagtgttgcgctcagcggatggctcgctaagccagcagattggcttagcgagcagatga

SEQ ID NO: 23019 - DNA, 246 bp, Glycine max
  Peptide Sequence Number=SeqID_114704
ggtcccaccacttctcttgagaaacatattacgggagatgcatcaaagttcactcatatctctcccaagaaaagcggacatgtgacttatgacaacaacaataaaggtagaattcttggagttggaaaaatagatgatgtttcagaatcattagaagaaatgcatattcatgaagaagatcacaaaggcaaaggagatggaaataatgaagattttcaaacaaatgcttatcttccaagagaatag

SEQ ID NO: 23020 - DNA, 768 bp, Glycine max
  Peptide Sequence Number=SeqID_114705
atgctcccaaagggtttgaacgctccccacactcaccctcaaggcactatgatccttatagtccttgagggtactctctatattggatttgtgacttccaatcaagatggaaatcgcctcttcaacaaagtgctgaacatgggtgatgtgtttgtgttcccaattggtctcattcatttccaactcaatgttggatatggcaatgttgccgccattgctggtcttagcagtcaaaatgtaggaggcatcactatttccaatgctttgtttaaagctaatccacctatttcttctgaggttctcaccaaagctttcgaggtggacaagagcataattgattatcttgaaaagaaatcttgcaaggatgtgtacatggcctacttgccccctgctcatgtttttgaaatggcaacagagtttgttatgctagttataggttgtgccatcagttacaactctattatgactttgactaactcatcaattactaatgcaatcctacccccaaggacattggataaaagactccaagaagattgggccaaagatgtaagagaaggccctagggttctcatgagtcttaggtggcgtctccaatcacctttcctccttctctattctgctgccattgatcttcaagaagcaaaggacttcattggtgaagaagatccaaggcctacaagctttacatggagctacatcaattactattgtttagccttatacttcggcaaagaggaagaacacagtctttgttgcagcagctag

SEQ ID NO: 23021 - DNA, 681 bp, Glycine max
  Peptide Sequence Number=SeqID_114706
atggcttcaaggactgagacctcatcgccatggaggtccagtcgcgcaccacgcggcttctcaccatcgcgcgctaatgggagcagaaatttgacgattttagtcgctgatttgctgaccaatgcaatgacaacatttcgccaccgcgctagaatggtatcgtcgtcgccatctcagatcacatcccctggctggacgaattacgcaaactccgtgtcgccgagcttcaccgtgaggtccaacgcagtgacctttccaatctataaatctccacagataaaaaaaactcctcataatattttattcttttcaggttttagatctaattttggtattgtgcataagtggttcttcgcagtcacagtcgtggtattcgccatcggtggtcagttcaccaacttaattgaggcctattacatcgactgcatcttcttcttcattatcacagaggccctcatctcatgttactattcacttcctaattccaaagttggaagatgttttcgtgatgaagatttaagagctgatagacaacctgagttcacccaactagatatggaaatagcctttactccttacaaggatatgttaatgcttaatgaagaatcaattagaaagtcaccagtagatggaaaaccaatgcttctaacacccgaggaatcaattttcaagtccaagtaa

SEQ ID NO: 23022 - DNA, 1083 bp, Glycine max
  Peptide Sequence Number=SeqID_114707
atggcagacccttactccaatttcttctcaccactaggtagtaatttcttccactacccttctccaagcccttcatcccagcaccaccatccctatgcccacaacttcctcaaccaaaatggttccaacatcatcaataacaaccacaacacctttttccacttccacaattttcaaaccactatttgttcttctttttcttcttcttcttcgcccccttcccctcccttgagagtagcccttcctcttctaaccctcagcccaaaaaatgaagaggaacaagaagaggatgatgaccaagaacaagatcaggatcacgagattcttcaggacaatttttgcacagccatggatgtggaagagaactacaataacaacagaacccttcttcatcaccttcaccccaaagaggaggaacaagatcaagaagatggtcctgatgaaactgtcactgttgcacttcacattgggttgccaagccctagtgctgctgagatcgcttctgtgctttcttcagcttgttccacagaccaagaacaacaacaacaacaacaacaacaagatgggttcttgtctaacagactcaacaagggacagtactggatccctacaccttctcagattctcattggtcctactcagttctcttgtcctgtttgttgcaaaaccttcaacagatacaacaacatgcagatgcatatgtgggggcatggatcacagtacagaaaagggcctgaatctctgaggggtacccaaccaacaggttgcaggaacaacattgatcacccaagagcaaagcccctcaaagacttcagaaccctccaaacacactacaagaggaagcatgggattaagcccttcatgtgcagaaaatgtggcaaggcctttgccgtgagaggtgattggagaacacatgagaagaactgtggcaagctttggtattgcatctgtggctctgatttcaagcacaagaggtcccttaaggatcacatcaaagcctttggaagtggccatgcagcttatgggattgatggctttgaagaagaggaagagcctgcatctgaagtagaacaggatcgataa

SEQ ID NO: 23023 - DNA, 309 bp, Glycine max
  Peptide Sequence Number=SeqID_114708
atgaagaagatcctaggcctacaagctccaatggagcttgcatcaaatgttcgaaaaaaagcacaagctgtccaaaaacaaaacactgcccctcacgtgatgtctcgtgggggttatgaatatttagaaaaaaagttgatggatgagaagagaaagaaaaaactagaggaagcaactcaatccggaagcactgacaccatcattgatcctccatctcccatcaaacgacacgtgaagtggaagctagcccgcaccaagaaaactggtgacatgacatctgaagcagcaaaggaaattgctgacaagatt

SEQ ID NO: 23024 - DNA, 429 bp, Glycine max
  Peptide Sequence Number=SeqID_114709
atggactcccaatctgaaccgactgatgtacaaattggagatcgcttagaggatatgattcgtgatcttggacaagaatcttttcagcaagcacatgcccctatgtatgatacattgcaaagtgatttgaagaaggctttgtatccgaggtgcaagaaatatttgaccttgttgtcagtggttttaagtctgcttcacatcacttcttcaggtggtgctaagagctcccttcactcaactcttaatgccaacatcgctttggcaagagacaaatcaaacttcaaggggcgtgtttcaaatcttgagaaaaagatttcaggtttagagatgcataccatagatgctaagcccttggtgaaagtgaatgttgaagaggtgggttggttgtgggttgcatcatcttttgtggtcagcatgtgtcgaccatga

SEQ ID NO: 23025 - DNA, 798 bp, Glycine max
  Peptide Sequence Number=SeqID_114710
atgcattgtcgcggtggtttgttcgcaattcatgattatcgtcatggtgggtgttgcggtgcaacgacaaaggagctagacgaagatcaatggatatatgaaagcataatgtctaaagaagttaatatgaatgaagacaatggagaggaacctagtgtgtttaaaaatattgattgttttgatgccttcaatacttctcaagtgtttgctacccatgaggacgtattgcaattgactcgtactattgcgtatgatattggttttgtagctgtgataacgaggtcagacaatgatactggaaagagagaaaggacctcatttattttaataggttgtgagaggagtggaaaatatagagcatacaagaaagacttggagcacaatgccaacagttgtacaacaatgaagcaagtatgcaatgcaagatatgcataccattcttctataagaggcagtaataatgaaatgcaacaactaatgaaacttcttgaacgggatcagtatattcattggcatagattgaaggatgaagatgtcttgcatttgcctatttggagggagaatgtagaaacaatattgtctgggctcttgaatggttttgagtttcacattgataagaaattgaaggcaaaatgtaaaacccttgtaggtcaaaaaaacgcatgggattatgtgatggaagcatgggggagtctggtggattgtcctactgagctagagtatgatgacggccctatgaagtttgaaattgattgctcatcatggccaatgtttgttgactatgtcaaacaaacatga

SEQ ID NO: 23026 - DNA, 531 bp, Glycine max
  Peptide Sequence Number=SeqID_114711
atgacaagcaatcttaactcaagaacaagctcagggatattaaagaagctactatctgaaggaatattgaaaccttcaggaaaaaattgtatttctcttatgactacatctggagctaagggtagtatggtgaatttccagcagatatcttctcatctaggccagcaagagttggaaggaaaacgagtcccacgcatggtttctggaaagaccttaccctgctttcctccttgggattgttcccctagagcaggagggttcattattgatcggtttcttacagcccttcatcctcaggaatactactttcattgcatggctggtcgtgaaggggtgggttcctcaacggcttggcttgagtgcttatcaattggtatcaaagctgccgccgagatgttggctctcaagggaggtgctatgattgggacatgggaattatgggggacttgggaattatggggtgccgatgtcgcacatcgagtagtatgggatgcttggtggggtattaagtgcttggttcttcccccttaa

SEQ ID NO: 23027 - DNA, 564 bp, Glycine max
  Peptide Sequence Number=SeqID_114712
atgacctctttgctccgcaggctagttgatactgcagtcaaaacatctcggagtggttacctgcaaagatgcctaatgaaaaaccttgagtgccttaaagtttgttatgatcatactgtccgtgatgcggatggttcaattattcagtttcactatggagaagatggtgttgatgtccatcaaactagctttatcaccgaattcggtgcattgtcaactaataaagaattggtttttagcaactattgccgtcaactagacagatccagtccatatattaacaaattgcctgaggctcttgaaggaaaagcagaaaaattctcgaaacagagaaatcttggttctatggagcaagcggatttcttaagattgatggagcataagtatgtctcatgtcttgctcaaccaggtgaaccagttggtgtattagcttctcaatctgttggagaaccggcaacgcagatgactatgtttgtaagggctttcactccttcgaatttcgtctctcaatcgttcccaaactccatcgccgagatgctcgatgattcgaactatctccactga

SEQ ID NO: 23028 - DNA, 1005 bp, Glycine max
  Peptide Sequence Number=SeqID_114713
acttatcaaggtaatccttgtggcgtctaccctgacttatctttcttcaccggaagtggcgtctacccagacttatcttccctcaccagaagtggcgtctaccctgacttatcttccttcaccggaagtggcgtcatccaaaccttcattgcctgtatcaaacgatccgctcctactcaggttcacatcatctggtcaggtaccatgaatgaacctgaacaagctgtcaataaaaatgaaggtgagatgtttttcttatatggatatggaggagcaggaaaaacatttatttggaaaacacttgcagcctcattaagagctgacaataaaatagttattatggttgcttctagcggcatagcttctttattattgcctggaggaaaaacaacacattcaaaattaaaaattcctgttccgatatttgaagactcgacatgcaatattcatcaagaaacacaattggctgaattattgaatgaagcaagtcttatcatctgggatgaagcccccatggctcacaaattctgttttgaagcacttgatcaaagtctaagagatgttattaaggcgaaatcaagttctgataaaatctttggtggtaaagttatggtatttggtggagatttccggcagattctgccagtcattcctaggggtagccggtctgacattcttaatgcaactataaattcatcttatctatggaatcattgccatgttttgacactgtcgaaaaacatgcgtttagaagccaatatagatgcaacagacagagaagaaacttcagcttttgcacagtggatccttgatattggtgatgggattgttaggcagcaaaatgatggttatggttcaattgaaattccaaaagatctgttaatcacggaatataatgacccactctatgcaattaatgtctatgtctccttcacaatccccatggccttttatgcttttgagaagacagttcccaataatgctttcttatgcaatgacaattaa

SEQ ID NO: 23029 - DNA, 360 bp, Glycine max
  Peptide Sequence Number=SeqID_114714
atggaaaaccatagatttataagcaagtctgattcagcaaaagctagaagcaacagaaagtgtattagacaacaaaaggtacatgttaatcctcagaatagtgtcaatccagtttcatcccatactgaagatcattataaccaaccaaagacaccaccgcatagtgtccatgcaactgtcaattgggcatcagacgatgctgaagatcattttaatgtctctggttcatcagagaatgagagttctggatcaacagaagttggatatccaaactgtgaatcgtcacatcatgattctacaatggacacaggagatattcctgtaaaaattaaattatccatggttacggttatggtctaa

SEQ ID NO: 23030 - DNA, 739 bp, Glycine max
  Peptide Sequence Number=SeqID_114715
atggcttcctctggacctgttttctccttctttgggactccaaccatctcgactgctaaactaaactggaaaaattacccctcgtggtctgcttccgtggaactttggtttctcagtcaaggacaccatgaccacttggagaaagcttccgattccattccaaatgacaaaagacctgaatgggagaagcttggctatcaactctgcgatgtgttatggcaatcagttgagccagatattttggatattcttagatcatttaaaacatgtcgttctttttggaagaaggcccatgaaatttttgccaatgatatccaaagcttgtttgatgcaaccatgaaggttacaaccctcaagcaaaccagccatgacatgattgctcatgtgggtaaggctcgggctgccgtggaagagctgagaaagttccttgtggctgattcattggaagaagtgaacagaaaactggacaagttctacatggtcctcatcttgagaagcttacactcagactttgatcatatgcgtgatcaagtactcgctggggatcaggttccatcaatggatttcctcatcactaggtttctccgcgtgcctcatgtatcgaaggatgaaaatcctgctgagggtgtggagacgtcagccatggttgcatctcatggtagagaaggcggccgcaacagtagaggaggccgtagtggaaggggtgaatgtcttcattgcacttactgcaagaggatgg

SEQ ID NO: 23031 - DNA, 129 bp, Glycine max
  Peptide Sequence Number=SeqID_114716
cctgtatcacgtggctttgcgtttggctacaatcatcatcccgttgcggcgattgagttccacgcgacgacgagtgactcagactcttcctcttcctctgttatcgatctgaaccatactgaaagcgag

SEQ ID NO: 23032 - DNA, 180 bp, Glycine max
  Peptide Sequence Number=SeqID_114717
atgacacgtaaaccgaggcaggattttaacatttcaaaagaaaattcagaagcttttctccctctctctctcgttgctattctctcttcttcctccaccattgaagctccatcaaagctccaacctttgcacaccttttctgctccaaatcgcaaaaggaagccatttccggagtcgtga

SEQ ID NO: 23033 - DNA, 374 bp, Glycine max
  Peptide Sequence Number=SeqID_114718
agctctttttgagcacaaaatttcgtgctcttctctccctctcccttcattcatctccttcttcctccaagctcttatccatggcctcctatggtgaagcaaaggaatccattgatgaagaagatcctaggcttacaagctctaatggagcttgcatcagtctccgtgtaccaacggacttgatagtctctggaaggcaaaagggcgtgtggatgaccataatttctctccgcatgccaatagacttgattgtctctggaaggcaaaaggatgcggatgaccagggtgcggatggccataatttgtctctgcgtgccaacggacttgattgtctctggatggcaaaggaagctttaatagtcttcgaaaagtaa

SEQ ID NO: 23034 - DNA, 1002 bp, Glycine max
  Peptide Sequence Number=SeqID_114719
atggctgcctccgaccatgctagaccacaccacccaccagcccacctcttcccattgcattctctccacacagccatccatcagcaactacctctatcggatccatcccttccgtttcagcacacatcttctccttatgtacatccagctcaatctcttgggattgattttgagagtacccggatccgcttgctagccttgtgcggtaccacgactttgcaaactgtgcaaaccatgccgactctgccttccatggattttgcagtgccaacggaaacgctggaacaccaaaatacaagcacttcctccaccatccacctacccgccaacagcaagccccacatgccaatgcctagtaaagaagatgatcctcctagcaatgtcattgtgcgagcgacgtacccttgcatcggcgtttggcaacacgattgtgttgaaagcatggccaacaatcagggtcaccgaactaccccacccgacgtgcctttcctcgacacagaacaactgatcaacgttgcggtgaaggaccaagccgctaagcactcaaccattcttatgaagatgaaggagatcgcagaggcgtatccagaaaccaccataaggaatatggttgtccctgtgcctgtttacttcaatgacccacaacgtcaaaccaccaaggatgttagtgtcatttatgggctcaacgtgatgcgaactattcacgtgtctaccacggctgccattgtttatgggcttgacaagaaggccattaattatgctgagaagaacattttcatttttgatcctggtggtgtgattcatggtttgacatcccttttcgctctatgtcgcagaaatttagctgttgttatggctactggggcccaaaccagcaatttcactcacatacctattttttctacacctaccccctgtatttgcttgtttttattgcccaacattaaagacaaggatattcctttctttggacagctcagcacagtagttatagccaattag

SEQ ID NO: 23035 - DNA, 339 bp, Glycine max
  Peptide Sequence Number=SeqID_114720
atgcatgttggggtagagggtgtcacagttcatgtggatcctaccattgggaaagtcgatggtccccatagaaagaaattaaggacatatttggggatctttgctcaagacagggtggacattacatttgctaactggaaaaaagctcctacaactcaaaaggatttgatttgggaagacattcagtttaagtcaattttgacctccaaatgggctctggctcaaggaaaggagggcgaggatgataaagtatgcgaaaagtacgacataagcaaagagaagtggaaccagttttgtcagagctgcaaagaccctttgttggatttcccctgctgttga

SEQ ID NO: 23036 - DNA, 375 bp, Glycine max
  Peptide Sequence Number=SeqID_114721
atgccttactttggagtcattgaagaaatctgggagcttaattatgccaaatttagtgtatgtgttttcaagtgtaagtgggttgatagcgatatcggtgtgcaaaccgatccttgtgatgaaaaatggtcagtggttctacacgagaaaaccattggtattaatgttgaacatgatgattcaactgttgatacttgtgttagtccattcttcatacaaatgccgtctaaccacatggctacaccacctagttcccctcctcctcctgagttatcaacaccttcaccatctacgcgaagaagacaagaaaagcaacacgactcagatcgttggctaccagacctattagggtggagagaccagtgcttcatgtaa

SEQ ID NO: 23037 - DNA, 189 bp, Glycine max
  Peptide Sequence Number=SeqID_114722
atggagttgtgcatagagttgctacagcttatcatccccaaactaatgggtaagcgaaggaaacttaaattgcaagaacttgaggatatccgtttagaagcctatgagaactccaagatgtacaaggagagagtgaagaggtttcatgaatctaccaacttaagctttttcatgagagcccccaagtag

SEQ ID NO: 23038 - DNA, 255 bp, Glycine max
  Peptide Sequence Number=SeqID_114723
atggcagaattggtaaatagaaggttgtggctcgcgataagcgaggcttgtgtgcttagcgagaatcatccgctaagcgaggcattcagcccgcttagcgagttaggagaatctgggggagaatctgtcaagcatctgcacgctcagtgcgtcatcagctcgctcaacgagtcatttgtcttctcttgcgctaagtgcgcccagctcactcagcggaaaatcactaactcgcgctcagagcgaaaatggcgctag

SEQ ID NO: 23039 - DNA, 618 bp, Glycine max
  Peptide Sequence Number=SeqID_114724
atggttggatcacttcaccctagacctattgcaaccttccattttctgtccccacattctgctgttgtagcattttgtgaggagattttgaagcatggtactgcctgggaggcactaagaggggatcttgcagctcagaaggctgaaatgactcttgaggaagagagagcggctacggaatacaagtacatagattttggaagtaccatcacatacgggtcatacagtgtacatagcttaagggatggcagcgactatcagcaaaagattaaagggagggaatcaaaagtggtgatctggactagacggaatccgagggagatttatttcaggaaatttgcgtcttggattctctctagtcaagatcactcttactccctacttaatcttgttattatgagtccaaatgaggctggaagtcctgtatatgatgatggatacatcccaaaacactcagtcctagaacttcaaaaagcttggccaggttctgaggtgagatgggtcacaggtgggcatgtctcttccttcttcaccatggtgaatttagaagggctattgtcgacagccttaatagattaccgtggaaggagtctccattgtgacagggacattgcacag

SEQ ID NO: 23040 - DNA, 333 bp, Glycine max
  Peptide Sequence Number=SeqID_114725
atgactcttagaagtggcggagagcgtgctctcggcggctaccttgcaattggcgccggtcttgaactcgacaaggtacttgtgttagtctcccttcatcttgaggtagaagaccttggagtcaccggaggcggcggaggggacgaggcgggtgtcgaggagcttgaggattatgtcgcagatgttggagagctcggcctcgatcttggagcagtagtcacggatgacggcgacgtggtcctcattgtcgcgacttcggcatcgtccaagggatccaagtatggaggacaaggagcagtggagggttccgatggagcgtgtgggtttgtgtaa

SEQ ID NO: 23041 - DNA, 420 bp, Glycine max
  Peptide Sequence Number=SeqID_114726
atgtaccaaatggcagaaccatctaagagaaaaggttcaacctccaccaccaccgctataggacaacaccgccacgacactttcgatgacccaccaacaccacctaatccttccctttccttaccacattccttaactctatttgcttctaacgaacagcgtcaaagataccgaaaggatatggattgccaatgggtgccgaaacaagacctaccacctttgatttctgatgaacgaacaccctccccaccgccacaaagggattcctcgtcttcactactgaatgatgttctcactgaacttagggatcttcaggaatttgtcggcaatcatttcgatgctatggattcacaaatcacacatcttgaggatgatatgagattcattcgtcgttgctttgatcctccgtcggatccatag

SEQ ID NO: 23042 - DNA, 660 bp, Glycine max
  Peptide Sequence Number=SeqID_114727
atgggatacacgccgacttggaaaatgccaaaccatattggaaatgaggagtccccaaaatgtaatggaagcttagaggctagccaaatgcgaagaagctttttgatagctgaaggaaacattggcaacaccacttgtctcgtcaaaactgaagaacatcaaaagccgagtacttcaggatccagaaacaagatatcaggtgatggagaaggacccaatggcatagccttggcacaatctttacgcttcggcttcaaagtcacgtgcaatcaagccgagtacgaggctctcctggatggactaaggcttgccaaagaggtcagtggccaaagagttcagtgccagagtgattccaaggaagagtttgaggaagtgcagagccaagcactattggccaactttgaggacgaattgctcaagctttgtaaaaaaatgcatctaatgccaaaagcatggaaatttgatacattggtcaaccaaagaattacatcccatggtctccctatggttgtttgctatttggggaatgttaactctgatgcaaacccaagggtgacactcaagggtgaaacctacccttcggcgaggggcgacgcgagactcaagggtgcgtcttcaaaggaaggaaaatgcgtggagccgccaccaacgtttatttga

SEQ ID NO: 23043 - DNA, 516 bp, Glycine max
  Peptide Sequence Number=SeqID_114728
atgacaccatcattgccaaaaatatttcttcctagtccacctgaagctcttcttgttctcttagatggctctattgttagttgtatagcttccaatgaagtggagaaagttgtggctcacatacgagaattaaaagtgccatctgccatagtgacagcactgagacctagcattgaacccttcagcattgaaccctatagacagccttgtaaccttctattgaacccttcaccattctcgtttgattgttatgaaccctatttgctgtttcagtttcaagcattgaagcctattgacattgaaccccttccattgaaccttattgacaaagaagccctgcacattgaagtggacgaggttcaaagttctcgacttgcactggcagttaagcttcgaagatatggggtggttcgtgaagcaaggtcgcggggaagacgcgtgcagctcaccgagttgttgttgaagaagctggaaccttgtttactgggctgcaaacgggtcagtggccatttctga

SEQ ID NO: 23044 - DNA, 924 bp, Glycine max
  Peptide Sequence Number=SeqID_114729
atgggttctgaaggaaaacctatgcttcctgttctagatttcaccatagaagatttgaagccagggaccaattcctggttatcaacatgcacaagtgtgcgccaagcatttgaggagaatggttactttgttgctgtgtatgataaagcttctattgagctacaaaatggtgtatttggctccatgaaggagctgttcgatctcccaacagaaaccaaacgaagaaacatatttgagggcatgcccttgaaaggctacgttggacagcaccccaagattcccctccacgaaagcatgggcatagatccgggaacaacactagagggaattcaaagtttcgcagaaaaaatgtggcctcatggaaatgatcaattttgtaaatatatatttgaatatgcaaaggtagctgaagtattgaatcggatggtggtgagaatgatatttgaaagttatggtcttttggagcactatgacacattcatagggtctacaaattatctccttaggcttttggcacacaaagcactcgaacagaatgagcctcaactgggttttgtggctcacactgacaaaagcttcacaactattcttcatcaaaatcatgtcaatgcactcatggtggagacaacgaacggtaactggattgatgttgatttctcttcacctacttcttttgttgtaatggctggtgatgcactcatggcttggagcaacgacagaataaagtcccctaatcatatggttatgatgaatgggaatgaaacaaggtactctctaggcctgtttgccttctacagaggaattctgaaagtacctgaagagctaattgatgaagaacatccattgcaatataagccgtttgatcatcttgcattactaaacttcacttacagtgctaatatgaaagcctattgtggcgtgtga

SEQ ID NO: 23045 - DNA, 600 bp, Glycine max
  Peptide Sequence Number=SeqID_114730
atgtggaaattcgtgtatcaacgcagacttgccttggaaagagaactgggaagagctgccttggattgcaaggagatcatggacctcatcaaggctgctggactgctgaaaactgtcaccaagttgggagattgctatgaaagtctagtcagggaatttattgtcaacattccctctgacataacaaacagaaagagtgatgagtatcaaaaattgatgttgctggttctgagcatcaaattgccaaggaagagagaatctcctctatccctgcattacaaactgtttgaggggacacatgtcccagacattgtctcgacatcagggaaagctgctgcttcaggtgctgtgtccaaggatgctctgattgctgaactcaaggacacatgcaaggtgctggaagcaaccatcaaagccaccacagagaagaagatggagctggaacggctgatcaaaaggctctcagaaagtggcattgatgatgaagaagcagctgaggaagaagaagaagcagctgaggaagaagatgatgcagctgaggaagaggaagatgcagcagaggatactgaatcagatgatgattctgaagccaccccatga

SEQ ID NO: 23046 - DNA, 552 bp, Glycine max
  Peptide Sequence Number=SeqID_114731
atggcacaaattatttctaactacgaaggggaagctcgcccaggcaagctggagcttacccttgacgatcttcagttaggaacagagcagatcgtcaatggtagaccttctataccttggattcctatggagatggaacttagtaacagaaagggctcaccaaggatgaacctttggtttgtcgagccttggaccagggacgtgtttgccctgggttttgtcaagcttgtggagttgcgtcgaggcttaccaaggacaggtcttggattttgtgaacttgtgaggatcaccaagtgtggagcttgggactcaccaaggccagaccttgagttttgtgagccctttggaggattgaccagggaatggtccgaccagggttttgggtgtcgtgctcttgcatacatgccactcgccattggtggcacctactggagacgtagtggcatgcttttgcatacatgccactcgtcgtgggtggcatgtactggagtcataatactttgctcgtgcgtacatctcactcactatgggtggcatgtactagagacttag

SEQ ID NO: 23047 - DNA, 366 bp, Glycine max
  Peptide Sequence Number=SeqID_114732
atgtggaccaaggaaagactaatttttcttttgagttgggattttggaatagaacttgcacacacttgtgattgcccaaaaaccgtgaggtttgcacttgcacgtttaagaagaaaacttattcgaccaggagctcgtgggagatgcccaaagacaattgatagtaagggtagccttcgttatataaattctcttggtcatcaagtttcagtgggattgacagactgtcataccctaatttcgtccggggaccatcgtttggtggcatgcaactttcgtttgaccacttcgaggtatttggtacccatcgttagacaatttgtgaagttccgagacatgacagaagccaaaagaaaagcgttgtag

SEQ ID NO: 23048 - DNA, 264 bp, Glycine max
  Peptide Sequence Number=SeqID_114733
atgataagatgcgactattggcgatattccttgaaaatcttctctgaagaagaagaagaagaagaagaagaagaatatgatgatgaagaggacttctctctctttgtgaagaagtttcataaattcatcaaaaatagaagaatggagagaagccataacttcaacaatggaaagagatcccaagaagtttctcctacacttaaatgctataagtgtaatcaacccggtcacataaaggcaaactgcccctcaaatgagtcatga

SEQ ID NO: 23049 - DNA, 879 bp, Glycine max
  Peptide Sequence Number=SeqID_114734
atggagtttgggctgcgacatcaagagacaccgagtagagtgacctttttggaggttgaagtttccaaatggagggcgactgctcccactgtctggagagtggatcaccctaaagtagctagtgccaccattgcttttgctgagatcgtgaggtcgaaccaccaactatcttctaaagttggcagtgtattggccaatttgttgtgcactaggttagatgatgatgaactattcaaatgttgcaaggacttgcaggaagagaaaaaggacttggctggtagggtagaggatattgcgacggaaaaggatgagcttgccaagaaggtggcagatctcaaggcccaacttaaggagtcagagtccaggctggaggagtttgcactgcggactgctagggagagggaggatggcaaggagcttgaggagaaactgctcatttacatgaagaaggccatagaacagcatgaaaagggctttaacaaggccgtcaggcacaccgagttctttgtcaaggaccttgacttgggtctctttgaccctttcaaggatgtgaaggacaatgtactgcttgacaaagaggaaattgttatgaaggaggaggcttttggtgaggagcagggtgctgaggagaagcaagaccttgtcgatgtagaggtaggaccatggtggtcttcttctcccctgatgctcttgaggagtatgtttgacttgcccctagttgaaggtcttgccaaccagtctgaggataggttgcttgacctgctaagtttctcctctgatggttatgaggatatggtggtagttcattttgttgaacttggacctttgacggtggtcgtcgtagttgctgcgaataagcaggccatggggatgccttag

SEQ ID NO: 23050 - DNA, 1113 bp, Glycine max
  Peptide Sequence Number=SeqID_114735
atgacagaaccatcgaagaagcgaaagggggttgcgacttcatccgcagtcactggaacacaaagccacggaacatccaaggtgcagacatctcaaattccttcctccatatcatctcctacgttgttttccatagaagaacatcgtatccggtacaattctcttttctcttctcattccattatcgaccctaagttcgtagacttagctttctttgatgatgaagtgtctgattgctttcaagcatttcaaaattctagtttaattcagtttatctccatgaaacttcctttttaccctgaattggttaaagacttttattctaacttggagattcaagaagattccttgatttccgaagtttatgggattaagatgatcatagaccagtcccttttctttgatctcactcaattatcaagtgatggtgtatcatttgagggttcatttgatgatgagtggaagtttgatttttctatgtctgattccctccaaatgtttaatgtccctcttgactctgagccctttgtcaaagtcaagagatctttctctataggtgcaaatgtagtctcttcctttggataccgcaaagagagggatggctcttgggtaaagaaggatgctccagtacaggccgctaaagaccactctccatcaccatattctcaaagagatgactcttcatctcttatgaacaacattcttgaaaggtttaatggacttcaaacctatgttggtgagaggtttgactccttggaatgtcaagtggacacacgattcgaggagatgaactcaaggattgcaaaggttgaagaagatgattgtcatcataaaaaagagggagattgtggaagcaataacttccaagattattttgatgatgccaaagaatcaagagttaagcaagttccaaagaatcaggagtcaaaaagcttcaagaatcaagtttcaaagaatcaagattcaagaataatcaagtttcaagattcaatcaagtttcaagaatcaagattcaagaataatcaagatcaagattcaagactcaagattcaagaatcaagagaagactctatcaagataagtactaaaaaagcttttcaaaacattgagtag

SEQ ID NO: 23051 - DNA, 351 bp, Glycine max
  Peptide Sequence Number=SeqID_114736
atgaatttcttgttgaagtgtaagacacgtaacatggactctacattaagaagaattaaatgcaccaacaacctcaagaccttagacgaagaacaaatgaagaatccatctgttgagagacaatggatacttgaagatgaagggtctcattctgagcattttgatatatatattgcctactttcgaaaacgggccccaatgggtgtagagaaacgcgaggaactggaaccagagaggcggcatgcaaaccgaggcaggattttagcatccaaaaaggttcaatttttcctccttgtggctgagtatgaagtcacatcaagggaaaaaggtggacccttttgctccacttaa

SEQ ID NO: 23052 - DNA, 201 bp, Glycine max
  Peptide Sequence Number=SeqID_114737
atgcaagtcaacaaacctcccatgaagggactctacgacttggacttgtggccacttttctttgctaataccttacttctcacagacaatgtcatcgtcctcctccttgccttgtgccagagcccatttggagggtattggatagaagactccaagaagattgggccagagatgcaggagaaagccctagggtttttatga

SEQ ID NO: 23053 - DNA, 738 bp, Glycine max
  Peptide Sequence Number=SeqID_114738
gactgtttctttaaggtcctggctgctgacgttgtggctgatggcttgccactgatgatcgacaaggccatcttggagcaactaccgacctcgttgtatgcacgagccattttgtctcttccttcagcggatgatcctttcgctgccttggatggtattatgggtggcttttcttggaggctactagtgaagcaggatggacctgctggtaggactatggcactatttgttgttattcctgttgccgaggttggccctactatagatgttgctaaggtcacccctggcgttccttcctctattttggctaagaggaagcgagataacgacgcttgggtgtcaggcctttctattcctgttgctgctattgttgttccttctcctccacctccttctaccatgctttttcaagaggttgcttctgttgctgaagttagtgcactggccacattggtcggtccagttgtcgctcccacatccatcgtcattgcacccttgttaagtgtcagtgtgacgaccactagtgctcctgagatgtcatatcctccttctttagctcgtcggggatgttattcattgtggggtgtaggttacaagctagatcaaaagaccccagttggctttgtgtcaaccttcaataaaaatcttattcgatcagttcgggttcaaaatgctactaattctgccaagattttcctccaaagaagtttggcaattctgaaggagaatgaacagtag

SEQ ID NO: 23054 - DNA, 993 bp, Glycine max
  Peptide Sequence Number=SeqID_114739
atgatccccgttgaagtcaaggaaccattgacaaggagattgctattccaacaacaacaaaataaagaaaacatgaggatagaactcgagacaacagatgaagtccaagagatggccataatcaaagaagaagttaccaagctccgagcatcaagaagatacaatacaaagaggcttgttaaacccaaggtacgcccttgctccagaggctcatcaaacccaaggttcatccttggtgagtctcacatctctaaaggctcgtcaaacccaaggtctacccttggtgattctcacaagctcgtccaacccaaggcttgtcaaacccaaggtctgcccttggtgagtctcacaggcttatcaaacccaaggtacatccttggtgagtcttgtatctccaaaggctcgtcaaacccaaggtcccctttggtgagtctcgcatctccaaaggctcatcaaacccaaggtccacccttggtgagtcttgcatctccaaaggctcgtcaaacccaaggtccgcccttggtgagtctcacaggctcgtcaaacccaaggtttgtccatggtgagtctcgtatctccaaaggttcgccaaacccaaggtctgtccttggtgagtctcgcatctccaaaggcttgtcaaacccaaggttcgcccttggtgagtcttacaggctcgtcaaacccaaggtctgccctggtgagtctcacatctccaaaggctcgtcaaacccaaggtctgcccttggtgagtctcacttcttcaaaggcgcgtcaaacccaaggttcacccttggtgagtctcgcttctccaaaagctcgtcgaacctaaggtccacccttggtgagtcttgcttctccaaaagctcgtcaaacctaaggtccagccttggtgagcctcgacacaactctacaggcttgttaaactcatggtcatcccttggtgagcctcgccaaaaccctgggcgaacatgtttcttgtccaaggctcgttaa

SEQ ID NO: 23055 - DNA, 300 bp, Glycine max
  Peptide Sequence Number=SeqID_114740
atggaatctgatgatgagtggataacagaagagggagatgatatttttgatgaagacaatctccaagttgagcaagagcaacctttaggggaaaatggtagtggaagtaatattgacttggttggaggaagtttaactgatccaactttggatgcatttgatattgacaatttggtattgaatgaaaatgtggaagatcacttctcaactgaggaagagcttgaagatgatggagatgaagataatggtggtgatggtgatattggagatgattttattagaggattgatggacatttga

SEQ ID NO: 23056 - DNA, 905 bp, Glycine max
  Peptide Sequence Number=SeqID_114741
acaaaggctacatccaaatggaagagatgttcaggttcaagaatgagccggacaagtgccagcctctgccgaaaggtcccatgtacgagcgttacacacccctgacggccaactgcactactattcttgaggaggccttcaatgcggaggagctagacttggaggacatcaaaaggatcgacataggaatcacgacacaaacaaaagaagggatagagcagaagatcgaggaagacagagacaccactaacaaagatgtgatcgacaacctccgcaagaatgagaaaatgagcttgccaagcaaatcagagtccagccagtctcgcaagcatcacctccatgccattcgggacatcgacatcaactacgtcaatacaccatcaccacaaagtcttccttctatcactttcaccgatagagatttcaagggtatcaaccctatcaaccaagacgaccccataatcgccaacttcatggtccatcgtctccacaccgcatctgaagatgaagttccccatcttgatgggaaagatcgtgactatcaaggtagatcaaaagcaggcacgaaagtgctacacagaaagcctgaaagtggaacccatcctcccactagggagcctgccaaatcccaccctatagcgaatgataccactcaagtcaagagtgtggacaaagggtctccagtccgagccttgacagtctaccaagccagcctagacaacgtattcgatgtacatccgcacaacgacacttctaataaaggcccaaaacctattgaagaactcgtcaagttgcaactcaaactcaaacccggttttgatgataacaaaggtgatgacaaaaagctcaaaggtcaagaacacttcatgataacaaagatgatgatctcaagaatcaaagaataa

SEQ ID NO: 23057 - DNA, 291 bp, Glycine max
  Peptide Sequence Number=SeqID_114742
atggggaaaggggttagggttagggctagtggaggttttgaagtgaggggtaaaattgaaatttgggaaaacattgttgtggacgaggtcatagtaaagatgggggttgtaatagggatcaataagggtagggtgagggaagtagaaatcgggggagtggatgagagaagggaagtcgaagcatctgtaacaattatggtggaaactagggtagggctagtttggatggccaaggtagtagagggaagtttggacttaaggttggcaacgaatgtcgtgatggaggcatga

SEQ ID NO: 23058 - DNA, 474 bp, Glycine max
  Peptide Sequence Number=SeqID_114743
atgacagtgtgcccaaacgatgaagggagatgggtaatgaaatccaaggcattgtctaacaagttgtttggtgtctttgtacaacccaggccaaaagaaaaaagcaacaaggtgagccacataagccttgatgccaaagtgtccaattgtaggagtggaatggaactcatggatgagatcatggcgcaccaaggaagagactatgaacaaaagggcaaccaattcagggatgtgagaaaaagcatcattaacttggttatgtttatcagagcaatagcttatgggggtactggatcaatgtgggtgggggagaagttggttgttggggtggagaaggatgaaagatcacatggttgcgagtttaaggccaatgaggttgatagaatgaccttggtgaacaaaaggaatttggggaagggaaagatcagcctatataggactcaagacctaggacaacatcagctccctccatag

SEQ ID NO: 23059 - DNA, 288 bp, Glycine max
  Peptide Sequence Number=SeqID_114744
atggtttggcttatgtcaacatgctacatcaactcaacaacaaaagatttcgcttctaatcctatgagcattaaggatgttgatgtatacaatggaaaggtttcagaagacacattacgttttggtgcaccatggaggcatcggccacaaattgacgaccctaagttgtgcatggaatgggcaaaggtttatgttgaaaataattcaagtcccacattgactgaaagtaatttcacattagaatatataagtgagaggcaatctttatcccttgagttcaagggatga

SEQ ID NO: 23060 - DNA, 423 bp, Glycine max
  Peptide Sequence Number=SeqID_114745
atggcgataggaagagatctcactccaacacttggccacattgtgagaagtgaagagagaagcaacatctatggcggtgaccaagtagtgtctatgttgtggcaacgagaactgttgcaagattcggtattcctcgtcgagcatgcgacagaggtggagagaggagccaccgagggagaagtgtcaatgggagataattcaatttggggaataagggttctagtgaagagggaaagagtttctagcatgcaagagcaaaacaagtcttgcatgtgcaagagctgtgtgcaagagttggagaaaaaggaatcgcatgaagacagtacaagtggaggtttcaatctcttctccgtctctctgacgtttgggaattctatcggagtagtcggaggaataactgaaggaatcttagggaaccgctag

SEQ ID NO: 23061 - DNA, 210 bp, Glycine max
  Peptide Sequence Number=SeqID_114746
atggaggatgattacttcaaccaaatgtttggtgaagttgacatggatatggatgataccgttaaaaatgaagattggggtgtgtatctagctctagcttctcatctcaaggaggtgagcttagctattagagagcttctcaaggaagttttctcaaagaagcttctcaagaaagttttctcaagaaagcttctcaaggaagctacctag

SEQ ID NO: 23062 - DNA, 837 bp, Glycine max
  Peptide Sequence Number=SeqID_114747
atgcaagtggagcctgtcgagcatgttgacaaggtccaggttgttgaagaagtgaagcctgatgagcatgaatgtggtgagcttaaattagtatcatatgggagaaagttgcagtcagagattgcgctacatgagcagatacacaatatggtcaaaggatggcacaaggaggcaaacaccttccatatgcccgttgcagagatgacattgacagtaacacttgatgatgtggcatcgttacttggcattcccattactggcatattttataattatgagcatatggataaagaagtagttattcccatgcttgtggggctacttggagttgaatataaggatgaaaggtgtaaagaagaaagatgggatgaggcaacaagagcctatttgtttcatctagtcggttgcaccttatctagtaataaaagtgcaacctatgtggagttttgctggcacaaagcaaattggtggctatgccacttttcttcaagatggatctgtgagcattttgtaaccattggcgctaggaatgatgtcttgggatatgaagagacgtctacacgcgttagccggtggtcaaataagttgtctttgtcaataatccattacaggaaactcattgatgagttgaccatcaagggagttaggtggactccatatgagatgcataagacttatcgttcatttgagaatatatccttattctctggatatattcatttgggcccagatttgcaccttcattttccaaagagggtgttgtgccagtatgagtatcaccaagatattccccgacacccagctgtgctcactgatgagattcccaccccacaatag

SEQ ID NO: 23063 - DNA, 258 bp, Glycine max
  Peptide Sequence Number=SeqID_114748
atggctgaaacatgtcaacatctgttttttagttgttgtgaaatcaaactagtttgggagaagattctgcgttggattgggtatgttcgcactcctactatgtgggatgatgagcttggttggattgtggaaaatactaaaggcaaaggttgtaaaagaagtttgatgaagctggttgtggctgaaactgtttatagggtttggtttgtgagaaatcggatcatatttcaaggtggtaggaaagaagagcttcattag

SEQ ID NO: 23064 - DNA, 162 bp, Glycine max
  Peptide Sequence Number=SeqID_114749
atgacgggaactgattcacacacaactatgattgatggccatgggtgttgctggatggggagttttgccccaaaaagtatcaattttttagaacaaacacattcacgggttaatttagaataccttggtagagttgtgttcaacacaaatgacgggaactga

SEQ ID NO: 23065 - DNA, 531 bp, Glycine max
  Peptide Sequence Number=SeqID_114750
atggagggaagtattttggctcaaaaagatatattaagagtcatggtaacatctcaagactggacaagctcaacttatggcaaagaagtcaagacaaaaaaatttatggaacaagtcttagaatctgggttttggagtaaatgtgttgatgtagtgaaactgcttgagcgacttgtgcgtgtgttgcgtatggttgatactcaagataaacctgttatgcattttctctgccgagccatgaaaaagagacaacaaaactatgatcctattaatttggaaacacttgatgaccatgttgattgggtaatggaggattcaccactattcttaaccaatgaggaggtggatgcattaggcaaagtccttgcaaatatgaccattcaatcactttcaaataatattggtcctttaaatttggatgatcatgttggtgaaacacaaggcaatcccatggaaaacatgaatttaaatgaaagcaatattgatcatgaagttacaatgggagattcttctgagttctttaatgaataa

SEQ ID NO: 23066 - DNA, 648 bp, Glycine max
  Peptide Sequence Number=SeqID_114751
atgacaatgtttgctatacagatatcaggaacggcattggttctagataaaatcatcaaccatgtgcaatctctacagaatgaagtggagatattatcaatgaaactggcagcagttaacccagtaattgatttcaacctcgacagcttactggctaccgaaggagtgactccaatggactgtaacttccctccgacagttgcacctgtcatgtggccagaaatcccacagaacggaaacagacaacaatatcagcaaccgtggcagtttgatgcattccaccaacccctttgggggagggaagaagacaacactaacatgactccagaaaactcactctggagttatgactcatcggcaaattcagtattagcaattagccatgatttgagcagcctcaacattcatcaggttttccctgtctctattttgtcagagccagttggaaaacctggattttattcagccagcaaggaagaagaattgttacaagcttttcagatgctgcaaatgatgaatttaaagaggatatacatcaagctgaacctattttcaattttcctgttttccaagatgatgcttctttcaagatgctgtctcctttactctctcttcgaaagcattacccttgtcatgggtgatccatga

SEQ ID NO: 23067 - DNA, 246 bp, Glycine max
  Peptide Sequence Number=SeqID_114752
atggagttccacttccatgttagttctctttctcatcttcttcctctcctcaacaacaacaaacaccattgcggcgctctggcagaatgtgacggtggtggaagacgtcaacaacggagtgcaaagatgttgcagtgtgctgtggcggcgagagacgaaaaggtaaagagtggaggcatgagagatagtgaggcgaagaagaaagaaggtggagatggagagcgtgagaagaaggagctgagatga

SEQ ID NO: 23068 - DNA, 701 bp, Glycine max
  Peptide Sequence Number=SeqID_114753
atgaagtccttgagggatagtcatgtagacatcttcgatgagatcaccataaaggaaagcattgttgacatcaagctactgcaagtgccaattttttatggaagcaatggttataacaacatggatggtggtcattttaacaacaagagagaaaatctccagataatcaatgccctcaatctgggagctcgtatctcagcattcatggcctcttgccaacagggttgggtagcagcctcgcgggagtgcatcactagagcaagcatggcattcatagtcagcaagataaacaaggggttgatgggggcgatgagaacgacagagaggttgggtttgttgggaggatggggaactagtgtgagcaagggaaggagatggggagtttcgggatgtaggagtcgatgttggaacaggtgcaggggacgttggagaagtagatgtaggagtggactaaagagaaatgggctaggaattattaggctaaagattggggttggtgaaatcaaaataaggggtgtcaatataattgggttgaggaatagtgggtcgggtattaatgggttgggtacatcctttgtggtacaagtagagggtacatctacttgggttgttgtgactgagaacaagagagggtacatctcttgtggatcagttctagtggagggtacatccactaggttgttcaaagagaacaagggagg

SEQ ID NO: 23069 - DNA, 201 bp, Glycine max
  Peptide Sequence Number=SeqID_114754
atgttgaatccaactcagtttcaagccaaagaagagaaggttcaagtagttgatgactcgcttagcgagtggcattcgcttagcgaggcatacaactcgcttagcaggttgggaaaccctagaagaggatcatccaaggatgtgctcgcccagcacccagccagcctgcccagcaaggtcgttgtctcttctcgtgcttag

SEQ ID NO: 23070 - DNA, 954 bp, Glycine max
  Peptide Sequence Number=SeqID_114755
atgtcaacttcaggccctgttctttctgtttcttggacatcctccattggacttttgaagaaagattgtttctaccatgcttgcaaggtgtttgaggttattccctcctcatttgtctctcttaaccctttgttgtgcagctccattgtctcctggttcgatctggtcaagaaccctattttaggtcatttgttgatcctgttgtccagaaactgcttccttgtctttgtccttgaagcaattgctgttcctagggttcaatctgtactaatcactttgaagtctagccctgcagcaagtgcagcttttgtttctgggaattcgttgtttccttcttcaagtcctgccacatcttttgaacttggcacctctgctccctcttcgccgcccaccaagtctgcatttggttccacatttagtacatcatcgtcatccactgcgtctgttacttctgccagttctccctcaatcatcaactacatcaggagggagccctttccagtttggcagtcaactgagtttcagtcatgggtttcaatcaagcaatcaagcttcaccgcagcatctaacttagaagaagaatctttcttatgcttcagctcatgttccaacggcagcgagggagttctcgatcttgaggcgttcaagggctttttcgtgggcccaggtttcgatggtgagatcgggcttggcgttgaggcccacgccgaggatgacgatggtgaggaagctggtgacgtagcaggggagctcccagtcctcccacttgcgggcctggcccgggggcggaggcgtccggttgaagaggtaacccttgggcctttcttcgtggcccgggctcgtccaccggctcggcccggactccgcgccgccgcgggtgcggagggactgctgcagccgccgacggagcgcggcggaggcgctgctcaggggcgtgggaggcggcatcgatga

SEQ ID NO: 23071 - DNA, 405 bp, Glycine max
  Peptide Sequence Number=SeqID_114756
atgaaggacaagtatattgttcaaagcttgttaaggaacttaggaaaaatcaagaacaagcttgtacgcacatcgttcgcgtcttgtggttacatgagcatgaactactaccaatatatagatgttgtttacacaaatgagcacatcttaaaagcttactccgcacaatggtggccacttgggaatgaagcggctattcctccttctgatgccgcatggaaacttatccctgacccaactacaattcgtgcgaaaggtcggccaaaatcaacaaggataaggaatgagatggattgggtcgaaccatctgagcaccgacaaaaatgtagtagatgtggagccaaagggcataacaggcgtcgctgtccaatgcaatctgagcgtgggagttgttcaaatcattga

SEQ ID NO: 23072 - DNA, 744 bp, Glycine max
  Peptide Sequence Number=SeqID_114757
atgtacctcctagaactagaaggcaacgatagagggagtaggggttgtgttgtggctaggtgcttgatagctgtttgcaactctgaaggacatgtgaagatttatcgtccacctttttgtgattactgtgctgaatggattgaggggaggcaatatattctgatatgggcatggaaaaactatgtggtggacataactaaaaggttgtatgactattttcaatgtactgagtttcgaggtacgaggtttgcttcattggatgtatctgataaaaattcatcagatcaaacggattctatgtatgaagaaaatgggaaactgttaagtgctgatcaatatgcttctcgtagtgcaatgctgtgttcacttgttgtttcatggtctcccttgctgcgtttagcatctgaattgtatccagtttgtgattctgttagtctgcttgctgttggcgggaagtctggtaaaatttctttatggagatttcacccaccagaatgttataccattgaggacagagaagtcccaactactgtgaagtttgttggtcttcttcaggcgcacaattcatgggttacaactataagttggctgttgtttgcttttgattcttcgaatcctcaaattttattagcttctggaagctctgatgggagcaaaaatatatactttgtattagatgagtaccagaggtacaaaattacagttagagatgccaaggtcatggttccagatcagacttggtag

SEQ ID NO: 23073 - DNA, 2211 bp, Glycine max
  Peptide Sequence Number=SeqID_114758
atgagagagagtgagagagagagagagagagagagactgagagagagcaagagagtgggagagaccaagagagctcgagagaaggtgagaatgggtgggcaagggcaaggacagagctatggtagagctaattggaggagcagaaaaaacataacatcgttctactttacccgattccctgacgacacgacggaggaagaactatggtaccacttcaaagtgtttggtgccgtaagggaaatctttattgctaagaacagaaacaagcatggtaggaggttcggttttgttagatttgaaggtgtcgagaacgcacagaagttggagtggacactagataacatcgtgtttggcggtctcaagatgcacgtaaatattccaaaatttggaagaaacaaagttgtgaagccaatctcggtcacgaacaaggtgaggcaggacgtgcacaaagaagaagcaatacctcgctatgtacagcctatatcgaccacacaccatgggtcgtatgcggaggtagtagcgagaaataacactggtccaggattaaggagaatcgcaggtaatgccagcggccataatggtacatcgtggtcttcagtgtacctagatatcccagaaccgttgatgaagagggccaaagaggcgtgggtgggaagattgaaaaatctggctatgtttgacaggatagaagatgacctatactgggatatcagtgccgacatatcgccaaaatacatgggtgccgacatggtcttgttgcagggcctctccgacgaaggtgcagagctgatgatgcaggaggaaacagagggaggatctactcctttccattctttggagaaatggagccctaagctgcgcctaggatacaggctgacatgggtttactgctggggattaccactcacggcttgggacccgcaccagatcagaaagatagtggccgcaataggagacatggtggacgtcgacgacgccgtcgagttggttagaaggatggatagggttcgggttctcgtcaaaacaccgcggcagccatacatacaacatgcagtcaacgtgcatatacatggggaggtgtatactgtgcatgttgtggaagaaaatggtaacagctttgacaattgctatggccggaagggaagtgtctacggctcatctgaagaagtagaatctgacgacagtgaagtcggaacgctaaacgggatcagcaacattgagtggatggccggcaaggaggtggaggtcacggcggtagagccaaacgccgaggggcagaacccatatagctttacctcgacggcgagccctgactttcgcatgcaagggcagggtctccatgaagacatgatggacggagctcccactgcggtcacgacgacggtcggcgatcaagcttcccttcctggaacccagaatcccgtcggagcttctttatccagcagacaaaaaaagaacgttcccccaaaggataaagctattatccgctgtgcaaactctccaacggtcaacgggcagccatcaaacagcggtacttgcccattggattctgtcgttacctaccttgcatgtgagcgacaaggagactttcatgaaaagggcactgcaggcacaactgggattccaacctctgacgcaaaggatgttttggagtctggaagaggaaagcttgaagaggaaaggcagcatgagactttggagactcatatttcaaattcaaatgggtcatgtgatcaggaaggggattttgctgatgggctggatcacgctatccacaccccccatgttactcacccaaaacagaacctaagcccaccagcaaccaaatggcaagtctattcacgtaaaaggagttccaaaaggaaatctatttcgggccttacacatggattgaatttaattgatgaaatggatccagagccaaataatcaaacctcatctcagccagtggagggtgttgaagacaaccatgggcccgaacaacttgtaagcaccaagaacaacgacattagaccaacacaaattcaacatgcagagacagattttcttccctctaacatgcaggaggcagcaaatatgtgggagttggtaaagtcattgggggttaccagtgggtcttcgcaaggggatcctgcaacaaaaataatggacatggagacaagagatcgagaagaagcacacagattgggatgcaggagagtttcacaatga

SEQ ID NO: 23074 - DNA, 234 bp, Glycine max
  Peptide Sequence Number=SeqID_114759
atggagaaagtgaagagatttcatgactctaggattcttaggaaggatttccatattggccaaaaagtgttgttgtttaactcttgccataagcttatttttgttattggcaaagtcttcaaagtgaacggtcaccaactcaagcttttacatgagagcccccaagtggaggaggaatttgtgggagacctttcttacttagtcttaccaattttatgtgatgatgtgccttga

SEQ ID NO: 23075 - DNA, 852 bp, Glycine max
  Peptide Sequence Number=SeqID_114760
atggttagaaccaggggattcagtcgggctttaggcagagttttaggaagagctttagggagacatgatgttgaccatgtcgatcatactgctgacgaggttcatgaggagcctcagaagccagttactgatgatgaaactagtattttccatctaccggtaggagaggtcagtataaccctcgatgatgtggcatccttgttacatctgcccattacaggtgcctcccttaccttcgatgctcttaatgtagaccaagtcgtggacttgttagttgagttgcttgaagtcagtacacaagaagcaaaagatgagacatttcaatacagaggggcatatgttgcacactctttgctaacaagagtgtcacacatgtcagtgtggtattctttgacgcattttgtgacctcaaccaatttggaagttattcatgggggagtggatgaactggtctatatctatgacactttaaattatgcgtcaaagaatacaagaaaacatcttccaggatatgtcactctgttacagcatttccctacaattgcttccattgttactgatgaggattatcatgagaggaaaccacatgcttgtcgatggaagtctgggaagacattaccagtgttgacgtattgtaagcacttagatagattgacatcagatgttaccattcctccacaccctgctgctccatccttatctataaaggagattgatgatagacgacttcaattttcaaaataccatgcaccgcctaggaagcctcctagacatccactcgtggtgcatgatgatacatttattgtaccagatcctcctcaacaggccgtcaacatagtagctatgccatga

SEQ ID NO: 23076 - DNA, 359 bp, Glycine max
  Peptide Sequence Number=SeqID_114761
atggctgtgatggaataccgattcatcggagagcagcgtggtccaggaatacgcgtcggggcaatcgatttcctgaaacgtgagtttgacggaggcgaggtcgcgatgggccttggcgtagagcgagaggagggagttggcgacgtgggagtgggccccgagcccggtccggacggcgagggcgtggagctgggccccgaaggcggcgcggcgcgcgttggcggcggcggttatggccgtggagaggatgtagtggtcgggggtgaaggaggagtgggcgtggacgaagagtttgagggattgggtgtgttggttggagcgagccagggctgcgagcatgtggttcagcttgatgtggg

SEQ ID NO: 23077 - DNA, 423 bp, Glycine max
  Peptide Sequence Number=SeqID_114762
atggacaacatgatgatgctgcaacacactaaaattaagacatcttttgagacaaaaaaggtgaaagcaaaaggtgctcagaagaaaccgatgaccatgcaacaaagatcaacagagcgtgatctgtcttactgggagtatattgatgcattacattctattcagaataccgatggtaactatggatatcgtctaattgttgtcttgttagatatgggtgaagattcatggtcattggtgcgcaatcatttgcttaaagaacttacaaaatggtctgatgagtatatgaacctacttgatggcataaacaaatttgaggaattaaagcggtccctacttgttgatgaattatccatggttaccatgggcaagtggatgaatatcaccgacatgagatatgtcattgcatcaagctatttctaa

SEQ ID NO: 23078 - DNA, 555 bp, Glycine max
  Peptide Sequence Number=SeqID_114763
atggagagtagtggcaagatggaagactatgaagtggttcagcaaattggaagaggagcacttggtgcaacttttcttgttctacacaagattgaaaacaagagttctgacaaaaatggtgatattgtctctctttctctctgtgcgtttcagatggacctaatagcaaaactacattacccatatattgtggagtacaaagatgcttgggtggagaaggatgactacatatgcattataactggctattgtgaaggaggtgacatggctgcgaatataaagaaagctcggggatcttatttttcggaggagcgggttccgtcctccgctggtaaccgtcacttccggccgtcattctctccggcgaacctagggttcgaaccgccttggaacacgcgacccaaccttgcaggttgcgtcaccattggagttgtcacgcgccgtcacgcgccgccacagctcctcgcgttttcaggcgcgtgtgtctcacgcgccgccgtcccgacgtcggaagctcgcccagcttgttccggcagcttcgtcgttcttctctga

SEQ ID NO: 23079 - DNA, 177 bp, Glycine max
  Peptide Sequence Number=SeqID_114764
atgtggtaccatggagaccagtcagggtcacggtgttttgcgagaatgctccaaccatatgggatcaacataggcttaaaggagcactcaaaccgggtgacccccaaggcttacactccaaagagtccgtcaggtcctctccctcctaattcaggtccaacccagaaaatattttaa

SEQ ID NO: 23080 - DNA, 327 bp, Glycine max
  Peptide Sequence Number=SeqID_114765
atggcatttttatcgttacaatcgaaaccaggaggttctagaagttggttgagttcgttcgggagtgagcgtgagaggacgggaaaggagcgcaaaggatggtccataacgcttccatggtcacgccttttaccacttcacccagttcaaactgatgaattcaccgggaagggcacgatcaggcaggtctgccaggtcattggtgtcgtcatcaatgtcagattcgacgagggtttgccttcgatgatgaccacgctagaggttctagatcacttgtcgaggcttgtgttggaggtggcgcatcatttgggtgaaggcattgtctga

SEQ ID NO: 23081 - DNA, 324 bp, Glycine max
  Peptide Sequence Number=SeqID_114766
atgcctctagagaagaaggttcctcgcaccatcgagaacacgagggaacttggcaagatcgtttgcaagtccaacgatgatgaggatgcaaggcttgcgttgtttaggcttgatagtggcgaggttcttgagtatcaagtgtttgctaaagcagacaaggcttctacctttgatcttgcagctagttggagggtttatcaggataatttctgtccatctatgagatggatttcggatgtaggtttgctgccagagtggtactctggttttcgtcttcctctttctctggaacctgaaacccttcagaggaggaaaaaaatataa

SEQ ID NO: 23082 - DNA, 894 bp, Glycine max
  Peptide Sequence Number=SeqID_114767
atgagagtgcttctaaaaattaagattcttagctattgggtcaaatctcaatgtctccacttggaagggatatgtatcaataactattcattctacacaaagtcacaagatgataaaagcagcatgcgaaacagtgagtgggttaatggaaataccggtgtgcaacaagatgaaatgagatttactttggtagaccttgataaggttgtttacaaggacaagtcattcatcatggcagaacaagcaagacaagtgttttatgtccatgatccgtgtgactcaaaacgagtcatggcaacacccccaaggtcccctccctatacatcaaatcattcggagtgtatgtctaggaggagtagacaatccacacgactgagtagcttgattgtaagagacttggatcagcctaagccaatggttaatatcaatccttccactgggagaggttcaggcccatataaagagaagttttataactatttgggggtggtagctcgagaaaagattcctattgtccattccaattggaaagttgtaccgaaatctctaaagaatccaatatgggatgacattttgggaaaatttgatatcccagaagcatccaatgctaagaagatggtgatgccatcggtggtcactggatggaggcaatttaagtcatctttgaccactaaatatgtatatgaaaacaataagggccaagatgatcaagctccttgttttaagtatggtctagatccacaaacttgggaggaatttgttgcaagccgcaaaacccctaattggcaaaacctcatggaggagaaaagacaagaggaagcaatgctgactgaggattcaacaatgattgttgaccctccatctcccattgaaaggcatgtgaaatggagttga

SEQ ID NO: 23083 - DNA, 609 bp, Glycine max
  Peptide Sequence Number=SeqID_114768
atgcaatcacagggactcgcactgcctcctgagcttgaggttggtccttcagttgctcgtgtcagcacaaaggagagttgtgttgatccctcagggaatgacctagacacgagtgacacagagaaatgcaggttgtacatcgaagaaaatcctccccgcctggttactctaggaagactttatgaggggttgacaactgttcacaacatccctttgcgccatgatcaagtcaaggttggtgttgaggaagttacagatgtagatgctctcattcctgtacccactcaagaggttcagttagtggggcaggcacttaacaccttcgttgcttggccaacacatcttgtcaagcgtttatcaaaacagggagctgtggaaccggcgaaacctacagataggtcggatcatgatgtcgatgatcccctatatctgatgacattaaccatcccacaactttttcttaagccgttgcaggttatgtgggatgctaccgtgttttgggtgtttaatgacaacttccccttgtacataaagcatgaagatctgtttgaaatagcacatgatgatcaatgtctcaacatctctgttatacaattatggattctgtaa

SEQ ID NO: 23084 - DNA, 429 bp, Glycine max
  Peptide Sequence Number=SeqID_114769
atgcaaccagatggttgtagtgaaccccaggaagatctaccagtcccccttccctcgatggtacaatcccaatgcaacctgcgcctatcacgggggtggatcttcgcagcactcgaactaccggtgcggtccaaagacccaaaggggaaagcaaagacggatgtgatggagagcgataaggtgggcctgacctcgaatgacgagttcctgattggaagatttgtcgaagaaggtgatgactttagcaaaaagggaatatccactgaggaagcaaccaagttcttgagaatcatccaacagagtgagttcaaggtgattgaacaactaaataaaaccacagctaggatctctctgttggggctccttatgaactccaagcctcatggggcgttattggtcaagattttgaatgaagcccacgtagcataa

SEQ ID NO: 23085 - DNA, 300 bp, Glycine max
  Peptide Sequence Number=SeqID_114770
aaatttgtcaagagaagaagaataaagaggcgtcagaactttaacaatggaagaagatcacaagaagactctcaagttcttagatgttacaaatgcaaccaacttggtcacatcaaagctaattgtccttcaaatgaagaatggcctgagaaaagtggtaagaaaaggtatgatgaaagaagaactaaaaaggcctacattgcatgggatgacaatgattcatccgatggttcagaaaaggagatcaatcttctaaccaaggattatgagagggatgagaacttctctcaagaagtttaa

SEQ ID NO: 23086 - DNA, 1035 bp, Glycine max
  Peptide Sequence Number=SeqID_114771
atggctccaaagaagcttttctctaagaaggcaaggaaggaggccattggagaagggtccagtatggccccacaagcggatatggaatttgacgggcacccgttccgaagtaaggaacaccaacaccggtttgaagcaatcaagagttggtctttcctcaaggagggacaggtccaattgagagaaggagagtatgttgagttccaagaagaaattgctaggaggcgatggactcaactcgtagggcccatggctaagtatgatctagaaatagccatggagttctattccaatgcatgtcccatagaggaaggagtcaaggacaagcgctcctgggtgagaggccaatgggtctccttcgatgaagatgacattaatcagttcttggggcatccgttggtcctggaagaggggcaacgttgtgagttcagcgagaggaggagtcaggccttgggatttcatgaggaggccataggccaactactgtgcgttccaggacatgacttggcacggagtgtaacggggagacggtgccagttggtctatgccatcttgacccaggtgagtgttcatgtggcccagttgatctcagatgccatttatcaatttgcaaggatcacgcctcccagacacccagtagaccaagaaaagtccaacagagtactggggtttatggccttgatcacgagcctctgtcagttctatggggtgccggttactcccacaaagcttatccagcttcccattaacaggaccttcatagaaaagtattgcatgccaaggcaggcacaacagcagggggaggaccagcagcaaccagccatggatgcaccaccgccacctctacaacaaccaccatctctagagtccatctctgctcacatgcggaggatggagctccagatgcacgcatatatgcagcatgtgatcgaccagcaggcgaccaatcatagggttgtatggcctggagataggtcaaattttcaggcagaggcaggacccatagggacccccgaagatgaagatggagcttag

SEQ ID NO: 23087 - DNA, 525 bp, Glycine max
  Peptide Sequence Number=SeqID_114772
atgggaaagttctctcacaatttatggagttgggatttaaagtggagaaggagactatttgaccatgagtatgagatggcagttgctttcatggaagaaatttttgatatctctatccagcaacaagttcaggacaagatgctttggaaaactgactgtagtggtgtctattccactaaatcaacttataggttgttgatgccctccaacagcccttttcctagcaggaggaacttccagatccttttgctattgaaaattcccccaagagctgcgcatgaggaggctgggcaccttttcttccattgcaaaatgactaaggggctatggtgggaatccatgtgctggattcaggctataggagctttctcagctgatcctgctaaccactttatccaattctgtgatggatttggtgcagggagaaatcttagtaggaggggcgggtggtggattgctttatctattacaatctggcagcataggaattccttgctgtttcatggcattccttttgaaccttaa

SEQ ID NO: 23088 - DNA, 911 bp, Glycine max
  Peptide Sequence Number=SeqID_114773
atggctacctcaccaaaagaaactgcagctcctagttcacccgctgtaccatcatctccgcaccaggaacaaccagaattcaacatccaacccatacaaataattcctggtcaagcttcagtccctgcgaaactgattcccagaagaccacagggagtgaagattgctgaaaagcctagccttgcaacaagtcctagggaagtagacacggagatggacaataaaatccgcagtattgtgagtagcattctgaaagatgcttctgttcctgaagctgatgaagatgtcccaacatcgtccaacccgaatgtttctgtgcctgatgtcaagaaagatgttccaacatcctccgctccaaatgctgaagccctcccttcacccagtgaagaggaatcaacagaagaagaggatcaagcctcagaggagactcctgcaccacgggcaccagaacctgctccaggtaacctcattgacttggaagaagtcgaatctgatgaagaacccattgccaacaggttggcacctggcattgcggaaagacttcaaagcagaaagggaaaaccccccttaagagatgtctcaacatctaagagggccaagacatcaggtaagaaggtgcctggaaatgttcctgatgcaccattggacaacatctctttccactccattggcaatgctgaaaggtggaaattcgtgtatcaacggagacttgccttggaaagagaactgggaagagctgtcttggattgcaaggagatcatggacctcatcaaggctgctggactactgaagacagtcaccaagttgggagactgttatgaaggcctagtcagggaatttattgtcaacattccctctgacatatcaaacagaaaaagtgatgattaccaaagagtgtttgtcagaggaaa

SEQ ID NO: 23089 - DNA, 255 bp, Glycine max
  Peptide Sequence Number=SeqID_114774
atggctacagctaggtgggtactcaagcatccagtttatggcattgtgatactaaggcttgggatttacacaggacgacattccttaatgaaaaatctacacggttctgacatttcaacaaacactattgacaataacgaagtaagcactaacgcaatagtccaaacaacatataaaagaggaaacataaaagagaatatgaatctggggatcccctggtcatatggctccactccctcccaagaaactgaataa

SEQ ID NO: 23090 - DNA, 379 bp, Glycine max
  Peptide Sequence Number=SeqID_114775
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagttcgctcccaagctggactgtatgcacgaaccccccgttcagtcccgaccgctgcgccttatccg

SEQ ID NO: 23091 - DNA, 1053 bp, Glycine max
  Peptide Sequence Number=SeqID_114776
atggcaaacaaaccgcaacagacaacgctgacgatgtacggcatcaaaaactgcgacaccatcaaaaaagcccgccgctggctggaagatcagggcgtgacctatcattttcacgactaccgcgccgacggcctgaccgaacagcagttacgcggcttcgtcgcgcaactgggttgggagccgctgctcaatacccgcggcaccacctggcgcaagctggatgaagcgcaacgcaatgcctgtgataacgccgacgccgccatcgcgctgatgctggcgcagccggcaatcattaaacgtccgctgctggacgacggcaacggccacgcgctgctcggtttcaatgccgacgcttaccaacaatttatcgccgaggttgccttgatcaaacgcccttccctcagcccgaatgacgaaggctgccagcagctgatgatcgaacgtttgcaggcgatcggcttcaccgtcgaagccatggacttcgaagacacccaaaacttctgggcctggcgcggcgaagggcaaaccctggcgtttgccgggcacaccgacgtggtgccgaccggcgatgaaaagcgttgggacaacccgccgtttgaaccggcgatccgcgacggcatgctgtatggccgcggcgcggcggacatgaaaggttcattggccgcaatggtggtggccgccgagcgctttgtcgccaccaacccggatcaccggggccgcctggcattcctgatcacctcggatgaagaggccagcgccacccacggcacggttaaggtggtcgaagcgctgatggcgcgcaacgagcggctggattactgcctggtcggcgagccgtccagcaccgagcgcgtcggcgacgtggtgaaaaacggccgacgcggctccatcaccgccaacctgcatatccacggcgtacaggggcacgtcgcctatccgcacctggcggacaacccggtgcaccgcgccatgccggcgctgaatgaactggtggcgatcgaatgggatcgcggcaacgagttcttcccgccgaccagcatgcagatcgccaac

SEQ ID NO: 23092 - DNA, 213 bp, Glycine max
  Peptide Sequence Number=SeqID_114777
gggcaggatcatcttgagctaccttctggggtggggacaaaatgtggacagcagaaaccaatcaaggtacttagggacggatgcaagtggggatggggtcacgaccgaccgatcgttgccccttctctgcgcgaaacaagcagagaacgtcgctgcaaggcagccccgtatcctttgtattcgcagttttcttttactatttgtttgttttaa

SEQ ID NO: 23093 - DNA, 961 bp, Glycine max
  Peptide Sequence Number=SeqID_114778
aatggcgatcatgcagaaagccggaatgccctgcacaaacagcaggaacagcgtggcgaggctgcgataatcctcgcgatccatcacctgcgggatagccatcagggagatctggctgctgagaccggccacatgcatgctgataaacggaaacagattggccagcagcagcataaacagcgccgccagcgcatagccggtgggacgtttacgcggttcgtgccagttagccaccagcgtggtgtgacagcgcggacagcgcgcacggctgcccaccggtacggcgggcagttttacgcgcttccagctcttcccaccgttcaaagaagtccggatggctcatctgcgcctgcagctcaccgatacgcgtctccagctgctccagcttttgcggcagctgttccagttcacgcctttggtctgcttgtaagcggcgcgctgctgctgcgcatcatggtagccaccgacgaaggtaccgatctcgccgttgccttcaaagatccagcattcggtcacggtgttatccacaaactgacgatcgtggctcaccagcagtacggttccctgatagccatccaccagctcttccagcagctcgagcgtttcgacgtcgaggtcgttggtcggttcgtcaaggatcagcaggttgctgggcttgaggaacagacgcgccagcagcaggcggttacgctcgccgccggacagcgcacgcaccggcgtcatggcgcgtttcgggtggaacaggaagtcctgcagatagccgagcacgtggcgcggcttgccgttgaccatcacttcctgtttgccttccgccaggttgtccatcacggttttatccggatcgagctccgcgcggtgctgatcgaagtaggcgatttccagtttggtgccacagtgcacgcgaccggcatctgccttcaactggccgagcatcagcgcagcagcgtggtttaccacagcc

SEQ ID NO: 23094 - DNA, 663 bp, Glycine max
  Peptide Sequence Number=SeqID_114779
atggtgaaagttgaaccttcttacgtgccgatcaacgtctcattttcgccaaaagttggcccagggcttccccggtatcaacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggagatacttaa

SEQ ID NO: 23095 - DNA, 367 bp, Glycine max
  Peptide Sequence Number=SeqID_114780
ggatcgcgcccacaagacactcagtggacccggaggagtccaacagggccctggggtttctagctttggtcacgggcctctatcagtcctacatggtgcccgcccccccagcaagggatcaggcctgcaagacacccagtggacctttatcagttctaaggagtgcccgtcgcccccaacaaggcaggcgcagggcgagacaccacaacagcctgaggatgcccaacagctggcagtagacgcaccgccaccacctccagaatcctccttagctcattttcaaaggctagagcattgcctacgatacatggccaaccagcaggcacccaaccatcgaaacagtaggacacacctagttgcttcatga

SEQ ID NO: 23096 - DNA, 66 bp, Glycine max
  Peptide Sequence Number=SeqID_114781
atgacccgcaccaagaaaattgggcagatgacgtctaaggcaataaaggaaattgctgagaagatt

SEQ ID NO: 23097 - DNA, 396 bp, Glycine max
  Peptide Sequence Number=SeqID_114782
atggtacttcgaacttggaacgagtatgagaaaattaacgatacttctttaccttttgagttgtctgccggatcggtcgctcaagacctttggtctctacccggacctgatgaaaaaaatgggatcacatcttatggactcgttgagaataattctgatctagttcatggcctattagaagtagaaggcgctctggtgggatcctcacgtacagaaaaagattgcagcccaatgaattgggatttccctattgggccaggtcatttcgggacaagcggatcatttatgatgaagaggatgagcttcaagagaatgattcagagttcttgcagggtggaaccatgcagtaccagacacgagatagatcttccaaagaacagggcttttttcgaataa

SEQ ID NO: 23098 - DNA, 187 bp, Glycine max
  Peptide Sequence Number=SeqID_114783
gggaggagcttgccacccagctcgcccaggcgagcaaggttgcttcctccatgtcatacactgatttcgtccggggacctttgcttgatgacatgcaacttttgtttggtccttgtgagaaggctgttgcttctggaggaagcaaccctgctcgcctaggcgagatgagctcgcctgggcgagctgg

SEQ ID NO: 23099 - DNA, 513 bp, Glycine max
  Peptide Sequence Number=SeqID_114784
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtacaagagccagatgcagaaaaatcagttcggaagtggcgaaaaaggcgggaacaggttctagaatccaaggaagcatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 23100 - DNA, 234 bp, Glycine max
  Peptide Sequence Number=SeqID_114785
atgaaagactgtgacaactgcgaaaggctcattaaatccaagacgatcagataccgtctgttcaaccataaaccccgactcagggacagcggatgttgctttaataaggagctcgcgctgtgcacctttgatgatgaaatcaaagtctttgggttccggggggagtatgtcgcaaggctgaaacttaaaggaattgacggaagggcaccaccaggagtggagcctgcggcttaa

SEQ ID NO: 23101 - DNA, 324 bp, Glycine max
  Peptide Sequence Number=SeqID_114786
atgtctgctgatgttaccttttttgaggacatatctttcttctcgtcctccatagactattcttcttcccttcagcaagttcttttagttccatcttttggtccaatgagtaatttcaaccaaagtgttagtggaaccccatctgatccaccaagttcaactgaagttgctcctccacatctcatcacatatcaacgtaggacacggcaagttagttctatagtgcttgagtcttcttctcgtgattctgatcctcctctaacagatcctcaaaccatggatccttcctcctccattccttctcataactctgattcaaactga

SEQ ID NO: 23102 - DNA, 600 bp, Glycine max
  Peptide Sequence Number=SeqID_114787
atgacatcagcaggaaaagtggtccagtttgcagactgtagagaccttcttgggaggatgtgcacaagaaggcacaggccatccaaaagcaaaatactgccccccacgttttgtctcgtggggacgaagaagaagctggaggaagctatacagtcaggaagcgttgatggcgtcatcgaccctccatccccggtcagacgccacgtgaagtggaagatggcctgcacgaagaaaataggggagatgacggctgaggctgcaaaggaaatcgttgagaagattgattcctttgaggagaaggccacacagggatccttcgtcccccgtggacgtcaggatgttctcgctgctgctattggacgtccagagcaccctgggcgtgtccgtgctgctggagctggtgtcaccatcaagaaatactttggatcggctccacggacgtcccgtagcgcttcctccctacctcttgacgaaatgcagcagctgacccagcaaatcagggaccagctagaggagtccatcacagagaaagtgacgaggcaggtcatggcatccttcagccacatgcagtcccaacttcaatcgcaaatgcaatcttaa

SEQ ID NO: 23103 - DNA, 297 bp, Glycine max
  Peptide Sequence Number=SeqID_114788
atgaaaaagattcaacaaaagacagaaacaaatccactatctgttttacgtcaagcaatacgtggagtaactcccgatatagcagtaaaagcaagacgcgtaggcggatcaactcatcaattgttcgccagttgtcggaaaaggatctcaacaagggcgttcttgcgttgtagattcttggggcatcccgaagacttgtcatcatttgaaaatgccatgatttccaaaacagagaaaaaattcgggggggaacaattgggattctttcaaggagatggagcagttactaattcatag

SEQ ID NO: 23104 - DNA, 432 bp, Glycine max
  Peptide Sequence Number=SeqID_114789
atggcggcgcagataatccatgatcgagtggagatggagtgcctagagggagcttgggagaccctcgaaggcaacatgaggtgccgatttcggggcactattcgattcacggctacttctttggtgcatccaaatgaacctgcacggacgcttcagcgcacggtggagtggatactatccacgcccacaccataccgtctagtggagccagtccaagtgattgaggtaacgtcgtccgaggaagaccctgaggaggatcttgaggagctacctctcgagcctgctggggatgctcttgactttctagagggtgatgaggacccactccctgaggtggattctcccgaggaagtcatgtcagcatctgaggcagactctacggaggatagtggcccgagagagatggcgaccagtggaggctcttcatcatag

SEQ ID NO: 23105 - DNA, 351 bp, Glycine max
  Peptide Sequence Number=SeqID_114790
atgtgtgctgatgtgctttaccttccactttacatcccagttaactcccccaaatttggggcaaattgccttgaaccatcttctctcctagaatctaagcaaggtttctttgttcgtgcttgcacacttagcgcaactctaaaccgcttagcacgcattagtgaatttcggcttagcgcgtgccttctcgctcagtggatggactcaagcggtgcgcttagcagaatgaaccctcactcagcgaacatgcacaactcatccttcttccatgatagaagaatgaagcaaaatgccctcatcacttgtctttctcaaagcatgcaattattcaaggagaagaataaaatgtaa

SEQ ID NO: 23106 - DNA, 533 bp, Glycine max
  Peptide Sequence Number=SeqID_114791
ttatccagaactacgtaggtctgagttcctcattggaggatacgtaggagcaagagcctcgcttttgtcgaccacaccgccttttgttgccatgacccaagagctggccaatgtggtcatctgcgccctttccggagatgagcaagagcctgcttttgtcggccgccccataatctttggcatactgaccctgaggtcatgtgacatgcacccttgtgtcatcccagaggcggcaggcccgatgatacgcggagataccttacggttatccgcacccttttgtcatccagaggcggcgggcccgatgacaagcagagacaaaatttggtcattctgcacccttgtgtcatccagaggcggcgggcctgatgatacgcggagataccttacggttatccgcacccttgtgtcatccagaggcggcgggcccgatgatacgcggagataccttacggttatccgcacccttttgtcatccagaggcgtcgaacccgatgacaagcagagacaaaatttggtcattctgcaccctt

SEQ ID NO: 23107 - DNA, 306 bp, Glycine max
  Peptide Sequence Number=SeqID_114792
atgccgatctccccctgcggaagtatcagttggtctgtgccgtcccgacataggggtcgcgcccacaagacacctagtggacccggagaagtccaacagggtcctggggtttccaactttggttacgagcctctatcagtcctacaaggtgcccgtactccccgcaaggtcatgccagcgcgacatagttctacagagtgcccgtcacccccaacaaagtcatcaggccctctattaatcgagctctcatcaagaggtactgcgcccccaggcaggcacaaggcgaaacaccgtgggatcctctag

SEQ ID NO: 23108 - DNA, 360 bp, Glycine max
  Peptide Sequence Number=SeqID_114793
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcggcggcgggtgtggtggttacgcgcagcgtgaccgctaa

SEQ ID NO: 23109 - DNA, 57 bp, Glycine max
  Peptide Sequence Number=SeqID_114794
atgtcgtggacatggattcaagcatctctccagcagaattccaagataaactattaa

SEQ ID NO: 23110 - DNA, 586 bp, Glycine max
  Peptide Sequence Number=SeqID_114795
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgttcctgcctttcggtttaccgggtgtcattccgctgttatgggccgcgtttgtctcattccacgcctgacactcagttccggggtaggcagttcgctccaagctggactgtatgcacgaaccccccgttcagtccgaccgctgcgccttatccgggtaactatcgtcttgaagtccaacccggaaagacatgcaaaagcaccactggcagcagccactg

SEQ ID NO: 23111 - DNA, 443 bp, Glycine max
  Peptide Sequence Number=SeqID_114796
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctcctcgagcgctctcctgttcctgccttcggtttaccggtgtcattccgctgtatggccgcgttgtctcattccacgcctgacactcagttccgg

SEQ ID NO: 23112 - DNA, 321 bp, Glycine max
  Peptide Sequence Number=SeqID_114797
atggagacaaaggatagtccaaaagtgctatctatgaaggaggttgttgcgcgagagactgcacagctgttggaccagcagaaacgtctgtcggttcgcgatcttgccagtaaatttgagaagggtttggcagctgcaggggagggaagagcaacagtgaaagggaaaatggtcactggtgttagagacatggtaggtcttgataaatctcgcatttcttttttcatcgcaagtttttcactcatttggaacccagagaaaaatcactctttgtctctctcccactttcggggttgttcaacttgggaaagtggcgcatga

SEQ ID NO: 23113 - DNA, 321 bp, Glycine max
  Peptide Sequence Number=SeqID_114798
atgggaaggaaaaagagaaaaaaggattcatccaagaagattgttatgaaggaaaatcattttgtaacaaaaggtgatatccaaatagcaccccttcttaaacaatccttctaccttctcctatcaagggaaacctcctttagcattaccatacctcttaagcttaaggttattcgtcaagtaaagaaggtattagatgagggtttggttcgtaagagcttaaatccttgtgctttgttggtgcccaaaataggtattgtgaggcaccaaatccctatgataggtgtgatcaaagggtttcctcaaaccctaagagaataa

SEQ ID NO: 23114 - DNA, 363 bp, Glycine max
  Peptide Sequence Number=SeqID_114799
atgcctcaaaatgttctttacgatgccattggatatatcaacggtggtatatccagtgattttttctccattttagcttccttagctcctgaaaatctcgataactcaaaaaatacgcccggtagtgatccttatttcattatggtgaaagttggaacctcttacgtgccgatcaacgtctcattttcgcccaaaagttggcccagggcttccccggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 23115 - DNA, 603 bp, Glycine max
  Peptide Sequence Number=SeqID_114800
atggccccaaggaagcttgcttcaaagagatccaggaaggataaagcggcagaaggaaccagttccgctcccgaatatgatagtcattgttttaggagcgctgagcaccagcagcgcttcgaggccatcaagggatgggacgacgagtatatcaacttccaggaggagatagttcgccggcggtgggcatcgctggttacccccatagccaagttcgacccagacatagtcctcgagttttatgccaatgcttggcctacagaggagggtgtacgagatatgcgatcctgggtgaggggtcagtggatcccattcgatgcggatgctctcaaccagttcctgggatatcctttagtgctggaggagggccaggagtgcgagtatggccagaggaggaaccgggccgatgggtttgatgaggaggccatcgcccaattgctgtgtatactggggcaggattttgcccggactgttgctggaagacgggcgaggatcatgcgcaccaacatgaccaccctgacccagatctggatgactttgctgctcagcaacatccagcccagcgatcataattccgacctccccctgccgaagtgtcagctg

SEQ ID NO: 23116 - DNA, 162 bp, Glycine max
  Peptide Sequence Number=SeqID_114801
atgggtggtgcaaatactgttttgggtgaaaaaaattgtttccgtgaagaaaatcaaagccgaggtgcttccgtaacgcttccgagaggttttcgtaagcaaattcgtgaaggttttcctccgttattcatcgttcttcattcgttcttcgttcttcaatgg

SEQ ID NO: 23117 - DNA, 297 bp, Glycine max
  Peptide Sequence Number=SeqID_114802
atgggtaaagcgaaggaggtacaagagcagatggaggccgacatggaggccatgaaagagcaaatggccgcaatgatggaggccatgatgagcatgaagaagataatggaagccaatgcggttgcagttgccactaccagcgctgttgctaaggtgaacccgacgtccccatccggcatcaacccaatgaatcatccaacctcagatatgataggcaaagattttggaagtatggcggcccccattatgcgcaaatttaaacaagcatgcctcccaactatacaccacccaatgtag

SEQ ID NO: 23118 - DNA, 108 bp, Glycine max
  Peptide Sequence Number=SeqID_114803
atggctgcttcagagcgcaatagcatggtgcactctaacaaattgaaggtccttgatttcttacgagctgaaagagctttcaaaggtccacgattattgccaaagtag

SEQ ID NO: 23119 - DNA, 711 bp, Glycine max
  Peptide Sequence Number=SeqID_114804
atggaagaatcatcaaagaaacgtaagggttcatccacctccgcttcggcttcaagagctcattgtttcggagccaccagcacatcaacaacaccaattccaccctccttatcctcttccacactgttttcttccgaagaacagcagacacagtactcaaaccttttctcatctcgttccattatcgaccctaagttcatagatatggatttcttttctgccgaaagttttgattgcattcaagcatttcagaacttaggtctcatacctttcatgtcattacaattgcctgtttattctgaattggttaaagctttttattgtaaccttgaaattcaggaaagcactttgatttctgaggtttttgggataaaaatggtcattgaccaatccctttttcataacttagcccaattgtctaatgacggtgtaccatttgaagagcatgatggctcttgggtcaaaaagggtgatcaacccgctgatgatgaaggcaacctaccagttgaagataattcctctcttcttcgaaggcttttggacaagttcgatggtcttcagacttttgttggtaacaagtttgatgccatggaattgcaagtcgacatgcggttcgatgccatggattcaaggatcaccaaggttgaagaagatgtctcctttatccgtacttgctttgatccaccaccaccgcctccatcatcatcttag

SEQ ID NO: 23120 - DNA, 102 bp, Glycine max
  Peptide Sequence Number=SeqID_114805
atggcgtatgtcaggatgaatggcagtggaatagagaaggaagagagagacgagatgccacttcaaggagaagatgagtttagaagaagctcaccaccatag

SEQ ID NO: 23121 - DNA, 116 bp, Glycine max
  Peptide Sequence Number=SeqID_114806
atgaagaagatccaaggcctacaacttctacatggagctacatccctaagtcatggtggaggaagagtagggtggagtaaggaagtctcttccaccactacgtccactaaagaagg

SEQ ID NO: 23122 - DNA, 186 bp, Glycine max
  Peptide Sequence Number=SeqID_114807
atgtcgctgcatgttctttatctttacgtgttttctggatttcccccaggggggcaggatcatcttgagctaccttctggggtggggacaaaacatgaacagcagaaaccaaccaaggtacttaggaacggatgcaaatggggatggggtcacgaccgactaatcgtcaccctttctctgcgctaa

SEQ ID NO: 23123 - DNA, 273 bp, Glycine max
  Peptide Sequence Number=SeqID_114808
atgaattcagattccgactccgaagtccggatatttggttgctttgtactcgacccatgtggttcggcttgttgggccacctcacttaaccaaacatctccgagaagaagttctaccagatctacagcacttgctgcttcatgcccggttgcatcttactctgctggttcaccttcgaaacagcgagctggagctcctactgttcccgcgccagcttccactctagctcccttcggcctcgaagatcatcaggttccatccaactcactctag

SEQ ID NO: 23124 - DNA, 393 bp, Glycine max
  Peptide Sequence Number=SeqID_114809
atgaagcacttcactgacaccctcatcagtgccaacataacaactggcctcaattatctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcgggcgcattaagcgcggcgggtgtggtggttacgcgcagcgtgaccgctacacttgccagcgctga

SEQ ID NO: 23125 - DNA, 713 bp, Glycine max
  Peptide Sequence Number=SeqID_114810
ggcggttgatggaacccctccaaatgcaaaccttccgcaagacttacggaaagatcttagagttgaccatagcagaggtgtccatagaagccattgtatcacttacccatactacgaccagcctttgagatgcttcacgttcggagacttccaattagtaccaaccattgaagaattgaggaattctaggatgtcctctcgggggaagaaaccatatctttcctccgggtacctagaagacaaggcgaggggtatggccaatcaaggagattgggtcccgtttatggatgtgttagctttgctaatttttggggtcgtcctctttccaaacgtggatggtttggtggacctagcagcaatcgacgctttccttgcataccaccatagcaaggaaagtccggtggtagctgttctggcagatttatttgacacatttgaccgaaggtgcgaaaagagtagcgcacggatcatctgttgcttgcccgccctctgtgtttggttggtttcgcacttgttccagcaagacacaaggcatccatgtccgctcctgagccatcgctcgtgtactgaaaagaggagaatagattgggaccagcttttggccgggataggaggtagaacaatcaattggttcccccgatggaaagaaggaaaggagggagttcttttctcatgtggagggtacccaaacattccgctgataggaacgaggg

SEQ ID NO: 23126 - DNA, 324 bp, Glycine max
  Peptide Sequence Number=SeqID_114811
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtcctcattccacgcctgacaactcagttccgggtaggcagttccgcttccaagctggactg

SEQ ID NO: 23127 - DNA, 198 bp, Glycine max
  Peptide Sequence Number=SeqID_114812
atgtggtaccatccccaaggaaatagcctaagcgtgtctacacgacactcttacttaggaaaactagacaggacatccgacaaggtcaatgcaccccctacgaacatacacaacatgcataatcttaatgcgtttccaacatcatcaacatttcatttcaatatcactctcaacatcaacatcttctcatctcaatga

SEQ ID NO: 23128 - DNA, 195 bp, Glycine max
  Peptide Sequence Number=SeqID_114813
atgtctcgggcttcatcctcctcagcttttgttttaccggggaacactcaggatttagagcaggccatcaattcttcacggatgggtgcggtcatacctgtgcctatcttcacttcctttttcccgctgccagttcctaagtctactagtttcatctcttctgatgaggccccatctcttggtcctcatgggtga

SEQ ID NO: 23129 - DNA, 679 bp, Glycine max
  Peptide Sequence Number=SeqID_114814
atggttcgtcgcctcctgcacgccaatgtgaataacgacgccagcgccatcgaagaggtggaaacattgctgcgcaatatcgctgacgggtggaaggaggttgccggtaccccacaactgatgcaggacgccgggctatgggatgatctgatcatctgtgaaaccgactatgttaatgcggtgcactcactggctcgtctcactcaggaaagtgaaccttcgatgcagattcaggagcagcttcgcccgacgctgcgggtgatcctggacaacgaaggccaggtaaaaacattgctgcaagccagaatggatgagctggcgaagctggttgggcaatcctccatccagaaaaccgttctctccacctacgcattaaccgtttcgtacgccagcatttctgccaaacctgcgccatacttgagtctcgcgacctcatggagatggtgcatgcgcaacccaacacttttacaatgttttcactggtattaccctgctggcggtgaattgtggcgcgaagtcacggcgttagcccctaatcttaatgaaatcggcatcaatatgatctggcttccccccgcgtataaaggtgcgtccggcgggtattcggttggctatgactcatacgatctgttcgatctcggcgaatttgaccagaaaggcagtattgccacgaaatacg

SEQ ID NO: 23130 - DNA, 405 bp, Glycine max
  Peptide Sequence Number=SeqID_114815
ggggagactgctgctgctgataaagatgacctgatggtcagaccaactgaggatgagcatggccaagacagggggactttctgcaggaaagctgatagtcacgtgaagtatgcatcctgcacacggaaacgacttgcaacttgcagaatttgctggtacccaccaatcacttccgctgtgcccgggacacatgtcccagacattgtctcgacatcagggaaagctgctgcttcaggtgctgtgtccaaggatgctttgattgctgaactcaaggacacatgcaaggtgctggaagcaaccatcaaagccaccacagagaagaagatggagctggaacgcctgatcaaaagactctcagacagtggcattgatgatgtgaagcagctgagagagagaagcagctga

SEQ ID NO: 23131 - DNA, 259 bp, Glycine max
  Peptide Sequence Number=SeqID_114816
atggtgcttagtttcagtgtgcaacacaacaccatcaacatcatcatcaacaacaacaacaacagcaacatgtctcagacagagaaggatccgggtatcaggctatttggaaggaagattccggtgccggaatgtcagattccggccaactctggacccaaggatgcttgcagcagcataatgaaaacagaactgggaatacccagtgaatgtggagaaaaccctgagcaacaagaaaattcttctgattcaagggata

SEQ ID NO: 23132 - DNA, 201 bp, Glycine max
  Peptide Sequence Number=SeqID_114817
atggagagccatcaggtgaagctacaatttggaatacatcaagatatccctgtagatctcatgaatcttgatcgacttcaccagattgacatgcaagggtggattaatatatggaaaaacaaacacaatgatgttttaattggacaatgggttgaagggtcagtgacacgtacaccagagtatatggaatggtataggtaa

SEQ ID NO: 23133 - DNA, 273 bp, Glycine max
  Peptide Sequence Number=SeqID_114818
atgatgagagatgcatcaaagtttactcatatttctcccaagaatagtggacatgtgacttatggagacaataacaaagataaaaagccaaatcatgctcaatgctttctaagcaaagacgatgaaccatggttgtggcatatgagaatttcatctgttaatattgcatactatatgtcacaacctacccttcggcgagagggcgacgcgcggctcacgggtgcgtcttccaagaaaggaatacgtgcggagtcgccaccaacgtttatttga

SEQ ID NO: 23134 - DNA, 603 bp, Glycine max
  Peptide Sequence Number=SeqID_114819
atggatgctcatccgtgtcaggatggcgtacaccagctggcacttaggcatggggagatcggaattatgatcggtgggcaggatgttgctgaggagcaacgtcatccatatctgggtcagggtggtcatattggtgcgcatgattcgcactcgcctccctgcagcagtccgggcaaaatcttgccccgaccggttcctcctctggccatactcgcattcctggccctcttccaacaccatcggatatcccaggagctggctgatagcgtcggcatcgaacgggatccactgacccctaacccaggatctcatgtcacgcacgccctcctctgttggccaagcattggcataaaattcaaggactatttctggatcaaacttggccataggagtaaccagtggtgcccaccgccggcgccctatttcctcctgaaaatcagtatactcgtcgtccctgagctggacgcgtcgctcccggagaaacgaccatcccttgatggcttcgaagcgctgctggtgtacaacgctcctaaagcggtgactgtcgtactccggggcggaactagttccttcggccgccttgtccttcctggacctctttga

SEQ ID NO: 23135 - DNA, 828 bp, Glycine max
  Peptide Sequence Number=SeqID_114820
atggtaaaaataaatctagatgagagggaacaaataagggaagaagaaagaaggaaaatactaaaagagttaagaaaagaaaaacatgtctcctatagtagtcataactcttgcaagagcctaagtgaagaacttcgtgactattatgaaggaagacataggtcacatcttagacctcactcctataggagagaaaaggaaagaaagcctcaagaggctaacttagattgggaaataagggttgagcaacaacttaaaaggaagtcgacttcaaaatcttttgactctcactcttatccaaagaaagatcaaggtcaatgcatcttaggggtgacaccttctaagtccaaagatgataaggggaagacaatagaaaagcaaccccttaaggctagtatgcaagagaagactagctccatgaagtgctttaaatgtcttggaggaggacacattacttctcagtgccccaccaagaaaaccatgattatgacgggccaagacatttatagtagcctagatgaggctattacttcaccttactctagtgaaagtgaagaagcaaaaggggaagaatctagtgaagagatctaccctcaagaagaaggacaacctttaatggttaaagaggagtgtaaggaggtaagtgtctcctccaagaggttagctaagaaggaatggcattttgaaataaagacaaatattaaagaaatttcccctcttagacaacctccacattttctcctttgtaaaaagacacttgttagcattgccacacctcttaggcttgagtttattcctcaagtaaaggagttgttggatgagggtttg

SEQ ID NO: 23136 - DNA, 174 bp, Glycine max
  Peptide Sequence Number=SeqID_114821
atgaggtgtacaaggggagatacttggtattgcaaggacagaaaaataaagaagtgttgggagatacttccgttggaggaggattttgttcactttcaaattgatcgaaggatatttctcttttggcttgagggggagaattgtagtgtttcaagcgaaaaagataaggtgtga

SEQ ID NO: 23137 - DNA, 281 bp, Glycine max
  Peptide Sequence Number=SeqID_114822
atggatgagcgttcacgtggcccaggaatggcgcctactaggcaccctttggacccggagaagtccaatagggccctggggtttccggctttgatcacgggcctctgccagttctacgaagtgcatgttacccccagcaaggtgattcggccaccgatcacccgagccttcatcgagaagtactgcacacctatgcaggtgcggggtgacgcacatcaggccgtgggcgcaccgccaccacctcagcaggccgattcggctggaccactgagcgtggagca

SEQ ID NO: 23138 - DNA, 399 bp, Glycine max
  Peptide Sequence Number=SeqID_114823
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgcagttcgctccaagctggactgtatgcacgaaccccccgttcagtccgaccgctgcgccttatccggtaactatcgtcttgagtccaacccggaaagacatgcaaaagcaccactggcagcagccactggtaattgatttagaggagttagtcttgaagtcatgcgccgttaggctaactgaaggacagttttggtga

SEQ ID NO: 23139 - DNA, 223 bp, Glycine max
  Peptide Sequence Number=SeqID_114824
atgggtgcgcttttccaaaggaggaaaagatgcgcggagtcgccacccaacttttatttgtggaaaaacgtcgggaaaacccgaaggaaaattggtcaaaaaggaaaaattctaagttcgggagttatatttccgcttgaggaaggtattagctcctctcacgtcgacaaaagcgggacttttgctcctacgtaccctcctttggagaggaaatcagacctac

SEQ ID NO: 23140 - DNA, 1134 bp, Glycine max
  Peptide Sequence Number=SeqID_114825
atgcatggttatcagacggggggaagtaatggtaaaggaaacggccacaccgaataccggccttacaccacgctggcaccgaaacttagtacggcggttcgcaagtttctcgtaagttctaccaccgtcacggccagcgcgactgacggtgcagggcgaatcgctgctaaccggaatctggtagtgacagccgatgccctcgacaatcaagccagtaatttactcgccggtcaggatatcgtgctcaccggcaacaatctgaataatcagtcctgggaaaacagtattcaaagccagtatctggtctacaaatatggcaatcctaatacgggacggattgatactaacctttacggcgaagaagatactgcaccttcgatcattgctgatttacgtaacgggaattcacatggtgtgaaatacgagagtggcctgggctccgaggtggtttataccctgcagggcgcacccgtttatgaaaccagccagacgggggaaggtctgcgtgccgtgattcaggctggtggcaacgtcagcgcgcgttttacgaataacctgagcaatacggataccgtggctaacgctggcagcatggtgcatgccattagcaaaccgggtatcgctggaactgcgccactgcaatccgtgggtggtgtgcagaaccagcagcttgccgccgggcaaactatcgccgtcgggtctccgcagtggaaggatgcgctgacaggcgcactacaacagataggtaatcagggcgcggcgttaactgattatccactgcctgccggtaacaacggcctgtttgtcgccagtaaagatcctgccagtccctacctgattaccactaacccacagctggcagaggtcggtaaaaccgacggcagcctgtttgatggcctcaatacgtttctcaggaacccgacttcaggggcagttcaacaatcggctcaggcggtaacgcaaccggcgctgagcagcagcccacgagtcgaaacggcggcaatctataccgacaaagataaattcctcggttctgcctatctgctgaatcgtctgcagcttacacccgataaggattataaattcctcggtgatgccgcgttcgatacccgctacgtaagtaacgccatatga

SEQ ID NO: 23141 - DNA, 492 bp, Glycine max
  Peptide Sequence Number=SeqID_114826
atgtatgaatatcctaggagaacccgcacattaacgtgtaagcattcctttcaaaattcatatggatattcatgctttgttggaaaaagggaaatggctccgaagaaactctccatgaagagtgccgagcaccagcaacgcttcgaggccatcaaaggatggtcgttccacagggagaggcgtgttcagctcagagaggatgagtatacagactttcaggaggagatagctcgcagacgttggacgccactagtgactcccatggccaagtttgaccctaagataatcctagagttctatgctaatgcttggcccacagaggagggagtgcgagacatgcgttcatgggtgaggggtcagtggattccctttgatgcagatgccctcagccagttcctgggtgacctgctagttttggaggaaggccagcagtgtgagtttagccagaggaggaacaaggccgacgggttcgacgaggaggccattgcctaa

SEQ ID NO: 23142 - DNA, 671 bp, Glycine max
  Peptide Sequence Number=SeqID_114827
tcctgatcgtcgagggagccgggcccccgagggggtcctccgtgaggtcgggcagctccgcggtctccaccgggacggcgtcctgcggcgtcgacgactcctccgcggggccgcgccgcgcggagtccgagctgcgctccaggtcttccatgcctccggtcacgtgccgtgctcctcctgctcgatgcctgtcgcatcgcgagtcgtggaccggacgggatcgcccggtcgcagatgccgcacatcaccgacgtccacggccacctgttcgcctccgccgaggtcgacgaccagccggccgcgcgcgtcgatcgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagtga

SEQ ID NO: 23143 - DNA, 535 bp, Glycine max
  Peptide Sequence Number=SeqID_114828
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaggaaatttaacaaaacatgacatcaacatcaagcctatgactgtgagcaaccatctacatgccaattttagagtaggggaccgacccaccacctccaaggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 23144 - DNA, 185 bp, Glycine max
  Peptide Sequence Number=SeqID_114829
atgcggctccgcatgccaccggtctcttgggacacggtaacaaaaagtggggtggtcggaattatggtcgctgggctggatgttgttgagcagcaaagtcatccagatctgagtcagggtggtcatgttggtgcgcatgatccgcacccgtctcccggtagcagtccgggcaaaatcctgccacg

SEQ ID NO: 23145 - DNA, 412 bp, Glycine max
  Peptide Sequence Number=SeqID_114830
ttggaacctctacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgataaatgatcccccgctccgcagacacccaacggcacaacgcctccgcgcccagaatggcgcgggtgttaatatcaacgatcggttgatagacgaggaatag

SEQ ID NO: 23146 - DNA, 231 bp, Glycine max
  Peptide Sequence Number=SeqID_114831
atggcccttcctagtggaggctgtgtctaccgcttccttgaagcggaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctcaaaaagagctctgaaatctgaagttaatatttaa

SEQ ID NO: 23147 - DNA, 618 bp, Glycine max
  Peptide Sequence Number=SeqID_114832
atggaatcgagagctccaagtgggccatttttgtcgatcctaagggacgggggaagcccgtctgatagcgctctgtgcgcgtactccgaaagggaatcggggttaaaattcctgaaccgggacgtggcggctgacggcaacgttagggagtccggagacgtcggcgggggccccggaaaagagttatcttttctgtttaacagcctgcccaccctggaaacggctcagccggaggtagggtccagcggctggaagagcaccgcacgtcgcgtggtgtccggtgcgcccccggcggcccttgaaaatccggaggaccgagtgcctcccacgcccggcaagggaagtcggcaaaatggatccgtaacctcgggaaaaggattggctctgagggctgggcacgggggtcccagtcccgaacccgtcggctgtcggtggactgctcgagctgcttccgcggcgagagcgggtcgtcgcgtgccggtcgggggacggattgggaacgggcccttcggggcctcttccccgggcgtcgaacagtcaactcagaactggtacggacaaggggaatccgactgtttaattaaaacaaagcattgcgatggaccctgcggatgttga

SEQ ID NO: 23148 - DNA, 240 bp, Glycine max
  Peptide Sequence Number=SeqID_114833
atgacgtgcgaccattctttggtcctcgtgaggtgcttggcacccatcattaggcaatttgtgaaatttcaggacatgccggaaaaccaaaaaatattgatgcacaatccgcccatttgggccctccagaaggttcctccagaaggcggttgcttctggaggaagcaaccctgctcgcctgggcgaactgagctcgcctgggcgagctgggcggcaagcatctcccctattttgctataa

SEQ ID NO: 23149 - DNA, 291 bp, Glycine max
  Peptide Sequence Number=SeqID_114834
atggccttctcaataccaccacctttgctcccaatcttgactactacaggttctggccttgtttctaaacagtgcagttttgtggcatcggctaatgggaaagaaggaaataccaacttctcatcatcacaggttggaggatatgtggttaagtacaaaggagtgacatttgttacagtaagaggagcaggacatctagttccaagctggcaaccatcacgggctctgactttgatcttctcattcctctatggaagcctgcctcctgcctcaccatggaagggtttctag

SEQ ID NO: 23150 - DNA, 183 bp, Glycine max
  Peptide Sequence Number=SeqID_114835
atgatacaagtagaagttcaagtggagggtacatccacttgggttttcaaagagaacaagggagggtacatcccttgtggatctttggcttgtaaaggattttacaaggttgaaagaaatctcaagaaccgtaggttgcttggggactggatgtatgcacggtttgtggccgaaccagtataa

SEQ ID NO: 23151 - DNA, 315 bp, Glycine max
  Peptide Sequence Number=SeqID_114836
atgataactagaagcagaatagcgattcaagctgaggaaagtagagctgatcagaagatggagggaaacaaagttgcgcataactcttccttccaccagtttccaaatgaatcgttgagtgaggcacttgaaagattcaaaggtttattacggaagactcccactcacggtttttcagaaccaatacagctcaacatattcatagatgggttgagaccacaatctaagaagctcttggatgcttcagttgggggtaaaatcaaaatgaagacccccgaggaagcaatggacttaattgaaaagcatggctgctag

SEQ ID NO: 23152 - DNA, 630 bp, Glycine max
  Peptide Sequence Number=SeqID_114837
atgtcatcttctataaatactcacgaaatcagagctgctgctcagccaaagcctcctccacgttttcctccatacctagaacttcaaaccttcgattctcactcaattcttcaccaaatcatagccatcgaagaagagaaagggatcatctccaccgctgctgctgctgcccatcgccgccatggcccatccggagcacccacagcacctattcctccttctttgtcatctccaagatcatcaacattgttttcatctgatgatcagcgtctacggtacctttctcagttttcttctagaataatcttagaccctaagtacctagatgtagaattctttaatgatgaaacgtttgattgttatcaagtgtttcaaaattctggtcttgttgatttcatgtcattaaaattgtcatattatcctgaacttgtaaaggtcttttactgcaatttaaaaattcaggatggtattattatgtctgaggtgcatggtacttctatggtcatcgatcagtcactattcttttctttgactccttaccttttgagggcaccattgttgatgactggaaattcgattattcgagtcatgatgctcgtcgcatggtatgcaatgatcaagctgaaatga

SEQ ID NO: 23153 - DNA, 195 bp, Glycine max
  Peptide Sequence Number=SeqID_114838
atggttctcttgaccagacatgaagagtctataaaagcaagaggatacatctacttgggtttgactgagaacaagagaaggtacatctcttgtggatcagttctagtggagggtacatccactaggttcaaagagaacaagggagggtacatcccttgtggatctttgcttgaaaaaggatttttacaaggttga

SEQ ID NO: 23154 - DNA, 680 bp, Glycine max
  Peptide Sequence Number=SeqID_114839
taacaatgggcccatcggtggctaccgtaagtggttgaaagcccacgtgcaaggtttggattggctcccgagattgagaaccgctaaaagggaggaagtggaggcaccggaggaagacgaagaggtgcaggcccttagggcagaactcgagcaagcccaaacagtcaaagaaagattcaaatcagcagctctgatgatccgaaaggagaatgccaaactgagagatataaatgtagctaccaccaaagccttggaacaagaaactaagagggcttgtagggaagagcacggccggaacaagttccgaggggctctgtggggcagcaacagcgagcttaagctctggagagaggaaagggaccaatcacgagtagacagtttgatcttgaaagatgagttgaagaccaacatgttagccatcatcagcaagtgccgagaagaactaaatcttgccacggcccacgagcatagagtggcagacgagtatgcccatgtgtatgcggaaaaggaggctagaggaagggtgatcgactcgttacatcaagaggcaacgatgtggatggaccgatttgctcttaccttgaacgggagtcaagaacttccccgattgctagccaaggccaaagtgatggcggacacctactccgcccccgaggagatccacgaacttctcggctatt

SEQ ID NO: 23155 - DNA, 679 bp, Glycine max
  Peptide Sequence Number=SeqID_114840
atgaagaaaaccgggcagttctgttccaaacttttgcatccccgctactggtttacctggttcgggctggcagtgctctggctgctggtgcagctcccctatcctttattaatccggctgggtgcgacggcgggccggttatcacgccacttcctgaagcggcgcgaacgcatcacgcggcgtaacatcgaactctgcttcccgcacattaatgaagacgagaaagaggtgatgattgccggcaattttgagtcgctgggcatggcactggcggaaaccggcatcgcctggttctggtccgatgcgcgcgtgcgacagctgtttcaggtgcacggcatcgccaatcttcagctggcgcagagccagcagcgcggcgtgatggtgattggcgtgcactttatgtcgctggagctgggtggccgtatcaccggactgtgccagccgatgatggcgatgtatcgcccgcacaataatcaggcgatggagtgggcgcagaccaaagggcgcatgcgatccaataaagcaatgattgatcgacgcgatctgcgcggcatggttcaggcgctgaaacagggcgaagccgtctggttcgcgccggatcaggactacggcccgaaaggcagcgtgtttgctccgctgttcgcagtcgagaaaggcggccaccaccaatggcacctta

SEQ ID NO: 23156 - DNA, 529 bp, Glycine max
  Peptide Sequence Number=SeqID_114841
atggaggccatgaaagagcaaatggccacaatgatggaggccatgatgagcgtgaagaagataatggaagccaatgcggttgcaactgccgctaccagcactgttgctaaggtgaacccgatgcccccatcgggcctcaaccaaatgcatcatcaaacctcaactatggtaggcaaagatttgagaagtacgggcggcccccattatgcgcaaagtcaaaacaagcacgccttcccgccacatggctttcctcccaactgtacaccacccaatgtagcgtacactcccagtgagaatgtcaataactccactcccatactcattgagagccgacaaccccaaactgatcatgcacatgtctctcaacccatgggtgagacacatgaaatgccccaccacaatctagccgacttcgagccttgcctcggatatgccactgaagggcaggaaattagtggtatacccctacaaaaccctttggagggccctcagtatcacccccagctacacctcttgcattccacaacaa

SEQ ID NO: 23157 - DNA, 518 bp, Glycine max
  Peptide Sequence Number=SeqID_114842
gcacccagagacgaggaagggcgtagtaagcgacgaaatgcttcggggagttgaaaataagcgtagatccggggattcccgatatagaggaaaagaaagcaaaagcgattcccgtagtagcggcgagcgaaatgggagcagcctaaaccgtgaaaacggggttgtgggagagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctg

SEQ ID NO: 23158 - DNA, 689 bp, Glycine max
  Peptide Sequence Number=SeqID_114843
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatccttgaggtcaatcgagagtcgatccaggatcaaaggggtggatggggaatcaaatactttctgggagctttgaataagagatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 23159 - DNA, 276 bp, Glycine max
  Peptide Sequence Number=SeqID_114844
atggaccttccagggtgttccaacagaaggcgttgccttctggtggaagcaacccagctcgcctgggcgagctgggggaaagagggcagagcaaattcattcaaccctcttgatattaaggattcacttgaaattagtgagaaaaattgtttccgtgaagaaaatccaagccgaggcgcttccgtaacgcttccaagacgtttccgtgagcgatttcgtgaagattttccaccgttcttcatcgttcttcgtcgctcttcggtcttcaaccggtaa

SEQ ID NO: 23160 - DNA, 449 bp, Glycine max
  Peptide Sequence Number=SeqID_114845
tcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagactataaagataccaggcgtttccccctggcggctccctcgtgcgctctcctgttcctgcctttcggtttaccggtgtcattccgctgttatgggccgcgtttgtctcattccacgcctgaacactcagttccgg

SEQ ID NO: 23161 - DNA, 1065 bp, Glycine max
  Peptide Sequence Number=SeqID_114846
atgagtcttcaatcttcatctagtgttaatggtgagggttctactcctatggaccccttgtataagatattagatgagttgagatcccttaagttgtggaaagaaaaacaagagagaaaagaaaaagggaaaaaaagagaggaagaaataagtcaagatgaaaaagagaaaataagggaagaagaaagaagaaaaataatgaaagaaatgaaaagaaaaaaacatacctcctatagtagtcataactcttgcaagagtctaagtgaagaacttcgtgactattatgaaggaaggcataagtcacatgttagacctcactcccataggagagaaaatgaaaggaagcctcaagaggctaacattaacctcccatacttccatgggaaggacaataaagaccaaggtctaggcatcttaggggcaacaccttctaagcccaaagatgataagggaaagacaatagaaaaacaaccccctaaggctagtatgcaagagaaaactagctctataaagtgctttaaatgtcttagaagaggacacattacttctcaatgccccaccacaaaaaccatgattatgaggggccaagaaatttatagtagccaagataaggctactacttcaccttcctctagtgaaagtgaaaaagcgaaaggggaagaatctagtgaagaaatctacccccaagaagaaggacaaccattagtggttaaagagaagtgtaaggaggtaagtgtctcctccaagaggttagctaagaaggaaactcattttacaataaagacaaacattaaagaaactttccctcttagacaacctccacattttctcttttgtaaaaagacacttgctagcattgccacacctcttgggcttgagtttattcctcaagtaaagaagttgttggatgagggtttggttcgcaagagcttaaatccttgtgttttgttggtgctcaaaataggtattattaggcaccaagtccataaaataggtggtatgatgaatgttttgagtggtgcaacactcttttgtaaaatcactcgtgcacctaacatcttcatg

SEQ ID NO: 23162 - DNA, 324 bp, Glycine max
  Peptide Sequence Number=SeqID_114847
atggagcagttccttgagcaagtagcatggcctggagctctaccttcaatggtgagacccaacaaggctgctcctcttgagcccacacctgcacgggttgaactagtgccagctgatacacaatcttcagtggtgaatccaccttctcctaagcttgaagtagtccccgcatctccaccttttattatcatctctgattccccatctggagaagttgttgctccccctgattccccagttggagaagctgctgatcttttggattccttatctagagaagctgttgatctctctgattcccctatttttccatctgatagatga

SEQ ID NO: 23163 - DNA, 237 bp, Glycine max
  Peptide Sequence Number=SeqID_114848
atgacttcctcctcatcaagtcggtccttccacctcctctattggctcaaccctgacactgtgcaccactgtctcttcctccgatggatgcctctacatcgacaaccagatttgcgagggtgtagggtggaggctttgcgagggtggacttgcaatttaatcaaattggataatgggtcgaatatcttgctcctttgttttctcaatgaggcccataccaaagggtgtggcaaatga

SEQ ID NO: 23164 - DNA, 264 bp, Glycine max
  Peptide Sequence Number=SeqID_114849
atgccactgcactccagcatgatcgaattcctgcagcccgggggatccactagttctagagcggccgccaccggggtgggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 23165 - DNA, 567 bp, Glycine max
  Peptide Sequence Number=SeqID_114850
atggccccgaggaagcttgcctcaaagaggtccaggaaggataaagcggccgaaggaaccagttccgctcccgagtatgacagccaccgctttaggagtgctgaacaccagcagcgcttcgaggccatcaggggttggtcatttctccgggagcgacgcatccagctcagggacgatgagtatgccgatttccagggggagatagttcgccggcggtgggcatcactggttacccccatggccaaattcgacccagacatagtcctcgaattttatgccaatgcttggcctacggaggagggcgtgcgagatatgagatcctgggtgaggggtcagtggatcccattcgatgcggatgctatcagccagttcctaggatatcctttagtgctggaagagggccaggagtgcgagtatggccagaggaggaatcggtccgatggttttgatgaggaggccatcgcccagttgctgtgtataccggggcaggattttgcccggactgctgcagggaggcgagtggattatgcgcaccaacatgaccaccctgacccagatatggatgac

SEQ ID NO: 23166 - DNA, 234 bp, Glycine max
  Peptide Sequence Number=SeqID_114851
atggaagaggcagagaaggagatcttggaaacatttaggaaagtagagaagcttaaaggaagtgaaagaattagtatgggcagaaatgtctccgcattgattggtaaatctgttccccaaatccctgaaaaatgtaaagatccaggtcctttgcagtcaactgatgtggtaattcatttagctaatagaagtgttgcctatcctgctggtttcatacaacgatgtcttagttag

SEQ ID NO: 23167 - DNA, 156 bp, Glycine max
  Peptide Sequence Number=SeqID_114852
atgattgaggatgagtgggagaaggtgcagttggcagtagcagagaaaccagaaggaacagatggagctgaaagggaattagaggaaggtatttgggaaagtgaaggtgtagaggctgaaacaggaggggataggtcaggattgagactgaaatag

SEQ ID NO: 23168 - DNA, 804 bp, Glycine max
  Peptide Sequence Number=SeqID_114853
atggggacaaatcaaaacggaaaaagattttatcaagtcaaggttaagggtctagatgtcaccagccttaaggaattgggacggttgatgggacccctccaaaggcaagccttccgcaaagtatacggaaagatcttggatttgaccgcagtggaggtatttacggaagctgttgtatcccttgcccaatactatgaccagccgttgagatgcttcacgtttggggacttccaaatggtaccgagtgttgaagagtttgaggagatattagaatgccctcttgggggaaggaaaccatatcttttctccgggtttcttccctccttgagtaagattgcagctgtggtcggagattcggcaaaagagttggaccgcatgaagcaaactcggaacggtgtagtgggcctgccgcggaaatacttggaaggcaaggcaagggatatggcgagccaagagaaatgggtcccgtttgcggatatactagctttgctgatctttggggttgtcctccttccaaacgtggacggtttggtggacctagccgcaattgatgctttccttgcatatcaccatggcaaggagagtccagtggtggctatcttggcagacttatttgatacctttgaccgaaggtgcgagaagaacagcgcacggattgtctgttgcttactcgctctctgtgtgtggttggtttcgcacctattccaacaagacgtaagacacccgtgtccgcttcaaagttatcgctcgtgcatcgaaaaaagagagtcgattggaccgacacttggctgggataggaggtag

SEQ ID NO: 23169 - DNA, 186 bp, Glycine max
  Peptide Sequence Number=SeqID_114854
atgaaaggaaaccaacaaagggtggagtcgccaactgtcgcaacctacccttcggtgggagggcgatgcgagactcgcgggatgcgtgttccacgaaaggaatacgcgcggagtcgccaccaacgtttatttgaggaaaacgtcggaaaaaccggaaaagacgcgatctacgaactttttaagtga

SEQ ID NO: 23170 - DNA, 189 bp, Glycine max
  Peptide Sequence Number=SeqID_114855
atggtgaaaccttctgaagctgaaaagaaccttgttcaatctaatgcttctggtggagcagccagtgtaactggcccctatggagctgtggaccgaaaattgtatgtggggaatcttcacttcaacatgactgagagtcagctgtgggagagttttggcatgtttcttggtctttgctacatttattag

SEQ ID NO: 23171 - DNA, 303 bp, Glycine max
  Peptide Sequence Number=SeqID_114856
atgctgacaaagaagaccggtacagtccacagtgacagacattggggaaggcaacttcgtagtgttgtgaatcaacgcattcttccacctaagcacaaagtcctggttgcaacatgtaccatctgtgggggagctcatgaatttggatgttgtattcctattgaagaacaccttactcgtgaagtcaattacataggaaatcagcctagaaacaattttaatgcaggaggattttctggattccaacatggccagcaatataatcaacaacagggtcaatggaggaaccaccctggcaattag

SEQ ID NO: 23172 - DNA, 183 bp, Glycine max
  Peptide Sequence Number=SeqID_114857
atggacctcaacatcgggcaaagccgtactcgaaccctcctaagcaatatgagagattgtccacatcccaaaaaggagcagaatggtggaggtctgaatgaccaagctggacatccgaaggccatgggaagagtctttacccttaatggtactgaagcttcgaaatccaaggatctgatctaa

SEQ ID NO: 23173 - DNA, 396 bp, Glycine max
  Peptide Sequence Number=SeqID_114858
atggagctcaacacggctacagtcgttgctgcaagtaccgccactgaggtggacacgactcacccatctagcctcaatcaagtaaattgtccagtctcggatatggtaggtcagggaggcaaagcgttgggaagtatgggcggcccccattttgtgcatgtccagggaaagcattcttttccaccatatagcttgcctcccaactatacaccactcaatgttgcacacactcccgatgagaatgtcgataactctgctcccatacccattgagagccaacatccccaatctggtcatgcacaggcccctcaacctatgagggagacacatgaagtaccccgagaccacactctagtcgatttcgagcctcacctcgaatatgccactaaggggtag

SEQ ID NO: 23174 - DNA, 1089 bp, Glycine max
  Peptide Sequence Number=SeqID_114859
atggaagccgttgtatcactcacccaatactatgaccagcctttgagatgcttcacatttggagacttccaattagtaccgactgttgaagaatttgaggagattctaggatgtcctcttgggggaaaaaaaccgtatcttttctccaggtttcttccctccttgagcaagattgcaattgtgccgcaattgatgcgttcccatagcaaagaaagcccggtggtagctatcttggcagacttatttgatacatttgaccgaaggtgcgagaagagtagcgcacggatcatctgctgcttgcccgctctttgtgtaaggttggtttcgcacctattccaacaagacataaggcatccatgtccgctccgaagccatcgctcgtgtgtcgaaaagagaagagtagattgggaccaacacttggctgggataggaggtagaacaatcagctggtttccccgatggaaggaaggaaatgagggagtccccttctcatgtggggactacccaaacgtcccgttgatagggacgaggggttgtattaactacaatcccgcacttgttataagacagttagggtaccccatgaggggagccccgacggaaaagagcctctcgcctttccttgtgagagatttcggcgcgcaaagtttcaatattgtacaaagagtccacaaggtgtgggaaagcccgttaaggaaagataaagaacttaggggcatccgtaatggcatcatcggtggttatcatgaatggctgaaagttcatacgcgagggttagattggctctccaagttgaaaattatcaacgaagagaacttcgaagctccggaagaggatgaagaagtccgagctctaaaaacagagctaggaaaggcaagactcgccaaagaaaaattcaagttagtcattacagacgtccgaaaagagtgtgtcgagttacgagaagaaaatgtagctaccgcaagagcccttgaacaagaaaccaagagggctcgcaaggaaaagcatggccgggataaattccgaggagctttgtggggcagcaacaatgagctcaagcttcgaagggaagagagagaccaatcacga

SEQ ID NO: 23175 - DNA, 93 bp, Glycine max
  Peptide Sequence Number=SeqID_114860
aagttgaagaagtcagagaccttaatatgcctggacttggtggagtatcccaaggttcaagatgaaaaaatggaggatcttgacatgacttga

SEQ ID NO: 23176 - DNA, 451 bp, Glycine max
  Peptide Sequence Number=SeqID_114861
ggtcacacgtcctcgcttatcagaggactgcatgtcctcaccttcgagggctgacacgccctcacctgtcagaggactacactgtcctcgccttgagagggctacacgccctcaccttggaggactaattaccctcaccgttgagaggctacacgtccttgccttgagaggactacacgtcctcaccatcagagggctgcacgccctcacctccagaggactacatgtcctcgccttgagagggctacacgccctcaccttgggactacacgtcctcaccatcagagggctgcacgcccttacctccggaggactacatgtcctcgccttgagagggctacacgccctcaccttgggtactagttaccctcaccgtcagaggactacacgtcctcgccttgagaggactacacgtcttcaccaccagagggctgcacgccctcacctctag

SEQ ID NO: 23177 - DNA, 328 bp, Glycine max
  Peptide Sequence Number=SeqID_114862
atgaaagatccggaaaccgagcttcattgtccttccaatattgcaaaacatcaagattgggatgatatttatttgaaagatttgcctcttccaaatatgtatccagatgagatttacccacttgtgactgtaaatcatgcagaagaatcaaacaaggttgattcaaaggtcaagtattgcttcaagattaagacaaggttgcttcaacaaacaagcattgcttcaagattcattcaagatcatcttttgtctcaaaacacattgtttccaacatgtcaaggctctagtaatcaattaccagacaatgtgatcgattacacgaagacaa

SEQ ID NO: 23178 - DNA, 134 bp, Glycine max
  Peptide Sequence Number=SeqID_114863
atgactgactctaaacctatcagcactctcctttcagaaaaagagaagttgtctactatgataaaggttcaagatcaagttgatcaggactatatgtcaaaggttccatactcaagtgttgttggcagtctcat

SEQ ID NO: 23179 - DNA, 437 bp, Glycine max
  Peptide Sequence Number=SeqID_114864
atgggcagccctcacctgggatacaaccgagcggcttacccttatggattgccgcccaactattcaccacccatcttgcaagaagatgcgggccacattgcttctcccgtccatgaaaaagagcctcctcagcagcccgacgaagtccataaagaccctcaagattatgcccggagggatgtcgagttttatcccccgatccccgaagggccggtaccaggcacgttgccccaacccaacatcgcagcatcgccaatagttttgtctatggaagggccgcccccggtaactgaagaaaggaggaagctcgatctccttgaggaaagattgagggctgtggaaggatttggggactatccgtttgcagacatgacggatctttgcttagtacccgatgttgttattcccccgaagttcaaagtgccggacttcgacaa

SEQ ID NO: 23180 - DNA, 357 bp, Glycine max
  Peptide Sequence Number=SeqID_114865
atgaatggagccgtggaagcggccaataagaatatcaaaaagattatccaaaagatgaccgtgtcatacaatggcacggatgctcccattgctacacgttggcatctatgttcagctacgaaccgcaacggggcctaccctacattgaatttcgagtgttccgtgaggcagaacccgcacattgttgccaagtggaggaaatccatgcgaggaaccatgggcccctggaactacgcaagggcatgcttttgtcggaagagggctttttccggaggagctttggtgcttaccaacatggatggcgaagagctaccttcacccgtgaactctgatgtcgtcaaacaatattatgcttag

SEQ ID NO: 23181 - DNA, 888 bp, Glycine max
  Peptide Sequence Number=SeqID_114866
atggttgcttctagcggcatagcttctctgttattgccaggaggcaggactgctcattccaaatttaagatacctgtgccaatttttgaagactcaacatgcaacatacttcaaggaagtcaactagcagaattgttaaatcagacaaatctgataatttgggatgaagcacccatggcacacaaattttgcttccaagcacttgatcaatgtttaagagacattattaaagaaaaaaaatcgaatcaaatttttggaggcaaagttattgtatttggtggagatttccgacaaattctgtcagtcattccaagaggaagtcgttcagacattataaatgcaacaatcaattcatcatatttgtggccttcctgtgaagtcttaacaatcagcaaaaacatgcgtttacaaggcaatgcccaatcaattgatgatcaagaaactactaaatttgcaaagtggattctagatattggagatgaagttattgggaatcaaaatgatggatatgctaccgttgaaattcctgagtacctattgattactgaatataatgaccccattgatgctatagtcaaatcaacatttccagatttatatgaacatcacagtaatcctgaattcttcaaatgtagagcaatattagcttccaccaatgaaacagttgaagaggtcaatgattatatactttccttgattccaggtgaacagatggaatacttaagctctgattatatagagaagtcagaaaccattgacagttggcatttccaatcaattacaactgaatttctcaattcactaaacacatctggtctgccaaatcatcgtatcaagctaaaaatcggtagtcctataatgttgctaagaagcttagaccaaacataa

SEQ ID NO: 23182 - DNA, 642 bp, Glycine max
  Peptide Sequence Number=SeqID_114867
atgcaaatcgacgaacacatcaccgggcgagagccgcagcaggaaagagggcggcaacgcgtacaaaccattctggattcggcggcggcgatcgtggcgcaggacgggctggcggcgctcagcatgcagcggctcgccaagcacgccaaaacctccatcggctcgatgtatcacttctttcccgatcgtcacgcagtgatcaaggcgctggcggatcggcataccgagtcggtcgaggcgctgatccgcgacatggcgttggccagtgacgacgagtggcggcgcctctccgctgaagaggtaatccagcggctgttttcaccctatgcgcagtacctgcgcgagcacaccgactacctgccgcttcctggcgctgatcgccagagtgctgcagctgcgccgccccgaaaccgccgaagcggagatcctgcagcaaacccggctgttgcaaagcctggtggccggcacgctgcaccatatcttcaagacagcgccgcagagcgtggcgttcacgctggcggagctgcccggcgtgctgagcctgtatctggcgggaaaagaggggaacatcgcttaggcgcgagccaatttattcgcttgtttgtccgcgccgccgctggcatgatcccctgcagggattaa

SEQ ID NO: 23183 - DNA, 309 bp, Glycine max
  Peptide Sequence Number=SeqID_114868
atgaatctggtgcaaagatttctgcctccactctatttttccttgtttaagcttggcgacgtcaggtggggtgttattgcccaaaaccaagcttggccaatcccgacccaacccgggcatagtcagtcagtgacaacctgtgacgtacctaagcaggcgagctcttggcagtcaaccaataaaagaacaaaagtccacaaagcaaggaggcttgtgtggcggttggccagctatctattttgtgttatatctgaaaaatcccctatggtaatcgattaccattcgtgggtaatcaattatagggtctaa

SEQ ID NO: 23184 - DNA, 541 bp, Glycine max
  Peptide Sequence Number=SeqID_114869
gttaaaggtctagatgtcactagcctcaaggaattgggacgattgatgggacccctccaaaggcaagccttccgcaaagtgtacgggaaagattctagatttggccgcagcggagatattttagctttgctgatttttggggttgtcctctttccgaatgttgacggcttggtagacttagccgccattgattctttcctcgcatatcaccatagcaaggaaagtccagtggtagctatcttggcggatttgttcgacacctttgaccagaggtgtgagaaaaacagtgcacggattgtctgttgtttgcccgccctctgtgtatggttgatttcacacctattccgacaagacacgagacacccgtgtccgcttcaaagctatcgctcatgcgccgaaaaaggaagagtcgtttgggaccaacatttggctgggatagggggcagtacaatcaattggtttcctcgttggaaggaaggcaaggaaggagttcttttctcgtgtggggactatcctaatgttccactgatagggactacgg

SEQ ID NO: 23185 - DNA, 435 bp, Glycine max
  Peptide Sequence Number=SeqID_114870
atgtgcacgtgtgcaatttttggtagccaagatgctttgagtatgcatgtatgtaaatttagccaaggaagtgcatgtgatgtaggtagcaaatacaccttggaagtacacataaataatctaggtaacaaaggtgccttgattgcgcatgggaggttgtatgccatttttgttttaagagtagcatttcttggtaaaactaactttccaaatgtttgccttctcatgacatggccccgaggaagcttgcctcatagaggtccaggaaggataaggcggatgaaggaactagttccgctcctgagtatgacagtcaccgctttaggaacgctatacaccagcagcgcttcgaggccatcaaaggatggtcgtatctccgggagcgacgcgtcctgctctcggacgacgagtatactgatttccaggaggagatag

SEQ ID NO: 23186 - DNA, 183 bp, Glycine max
  Peptide Sequence Number=SeqID_114871
gggagatgcttgccgcccagctcgcccaggcgagccaggttgcttcctccagaagcaatagccttctggaggaatattctggagggcccaagaaatggccccaaggaagcttgcctcaaagagattctaggaaggataaagcggctgaaggaaccagttctgctcccgaatatgatagcaccg

SEQ ID NO: 23187 - DNA, 357 bp, Glycine max
  Peptide Sequence Number=SeqID_114872
atgcagtcagataataaaaacccaagcaagcccaagcctttggtgatccacttcactagggatgttgccactcaaaagccccgaggtttccagcccatcacagttaagaagcctacgcctttcccttacaaaagtgataaggcgttgccatggaagtacgctgcacaagggcccgacggaaggaatgatgcgttcatcataaatgttaagaatgatctatcctttgctaaagtcataaacatattcagtatgagtggcatgactcgtagtgggcggttcttcgtagcacccaaactatcgatgtggtccaaagacccaaaagggaaaagcaaaggcagatgtgggcgagagcgataa

SEQ ID NO: 23188 - DNA, 462 bp, Glycine max
  Peptide Sequence Number=SeqID_114873
atgctgccaactactgatttagtgtatgatggtgtttttgaggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagtgttttccccagtcacgacgttgtaaaacgacggccagtgaattgtaatacgactcactatagggcgaattggagctccaccgcggtggcggccgctctagaactagtggatcccccgggctgcaggaattcgattgatagaattttccttagaaaatggaaatttggatga

SEQ ID NO: 23189 - DNA, 147 bp, Glycine max
  Peptide Sequence Number=SeqID_114874
atgcctgtctcaggttggatgtctgaaactgcgatcgcagtcagcagatgctaccgcaggacacggtatttcttcctgccctgcagtctcaccttccagaagcaaaccgctcacaccggcctcgtcagggaaaattatgggttctga

SEQ ID NO: 23190 - DNA, 114 bp, Glycine max
  Peptide Sequence Number=SeqID_114875
atggagaaaaatgaagaaacaacaatggaagagaagcggaatggagaaggaatagagagagaggagatgccacttcaggagaagatgagtctagaagaagctccaccaccatag

SEQ ID NO: 23191 - DNA, 660 bp, Glycine max
  Peptide Sequence Number=SeqID_114876
atgggtgaagcagaggaggtgcaagagaagatgaaggccgaaatggaggccatgaaagagcaaatggccacaatgatggaggccatgatgagcatgaagaagataatggaagccaatgcggttgtagttgccgctactagcgttgtcgctaaggtgaacccgatgctcccatctggcctcaagcaaatgaatcatccaacctcaaatatggtaggcaaagatttgggaagtacggatgaccccatgatgtgcaaattcaaaacaagcacaacttcctgccatatggcttgcctcccaaactatacaccacccaatgtggcatacattcccaatgaggatgtcaataactccacacccatactcattaagagccaacaacctcaatctgatcatgcacatgtctctcgacccatgggggagacacatggaatgccccaccacaatctagccgacttcgagccttgcctcggatatgccactgaagggcaagcagttggtggtatacccctgcaaaacactttggagggccctcagtgtcacccacaaccacaaccctcacattccacagcgattaaaaaccctcatgctatggcagaaatgggaaagaggaaaggctcagggccattgaaggaggtaaagattatgcctttgctaacctag

SEQ ID NO: 23192 - DNA, 249 bp, Glycine max
  Peptide Sequence Number=SeqID_114877
atgattggtacctcaaagccttacactggggcaatgaggggcaccgtgcatgagcctcaaccttacactggggcaatgaggggcatcgtgcatgagcctcaagtgaacataggggcagatcaaaagttctcacctgtcgatgtttttaaacaagaaaaagaaaaggggggacaaaccctaggatttcaatggattgatcaaacatcaaatggctcaattgccgtcactccaaaatggtcaagtgactaa

SEQ ID NO: 23193 - DNA, 441 bp, Glycine max
  Peptide Sequence Number=SeqID_114878
tgatcaagggcttcccatggaccctaagagaataaaggtcattcctgagtggcctactccaccaacaccactcattgagttggtgagaaactatattctctcatgggaagatggccacgaaaggggtgttgaggaaagaatccacgagtttcaagaacctctggatttgaggcaagccttccgcaaggcatacgaaaagattttagatttgaccatagcggaggtattcatggaagccgttgtatccctcacccaatactatgaccagccattgagatgcttcacgtttggggacttccaaatagtaccgactgttgaagaatttgaggagattctaggatgtcctcttgggggaagaaaatcgtatctttttctccgggtttcttctctcctcgagcaagattgcagctgtggtcggggattcggcgagagagttggatc

SEQ ID NO: 23194 - DNA, 486 bp, Glycine max
  Peptide Sequence Number=SeqID_114879
atggcagttgatactcctttgactgtgactgaaggcattaaacaagggtcaagccagggagtgaatccggacaaaatagtggttgaagatctaacagccatcctgtttaccttctgttcacctaagcactaccctgttgaattttctctcctaaggagcacaactgcattagtcatgagaccctctcactcagtccaggtcatcactcatcttcttcccgttcaatcaattggacacgaacgccagagatcttgctcttcttttcagccctatccgagagtcctagctcaaaggtttgaagggaacaatgagttcatcactctcatgttgcaaatgtcttgggcctcctctattgcagtgactttcatgtcaaatctcttaggcaaggatctgaggatctttctcaccagcttttcatctgtcatcctttctcccaaggcagtgcaagcattggcaatttcaagaatgttcatgtggaagtcatga

SEQ ID NO: 23195 - DNA, 778 bp, Glycine max
  Peptide Sequence Number=SeqID_114880
atggcaaaggtatcactggaaaaagacaagattaagttcctgctggtggaaggcgttcaccagagtgcgctggataatctgcgcgccgcaggttacaccaacatcgagttccacaaaggcgcactggatgctgagacgctgaagtcctccatccgcgatgcccacttcattggtatccgttcccgtacccaactgactgaagagatcttcgcggcggctgaaaagctggtggcggttggctgcttctgtattggtactaaccaggttgatctcagcgcggcagcgaaacgcggcgtgccggtgttcaacgccccgttctccaatacccgttcggtcgcggaactggtgatcggcgaaatgctgctgatgctgcgcggcattccggaagccaacgccaaagcacaccgcggcatctggaataaaatcgccaccggttcgtacgaagcgcgtggtaagaagctgggtatcattggctacggccatatcgggatgcagctcggcgtgctggcggaaagcctcggcatgcacgtatttttctacgatatcgaaaacaagctgccgctgggcaatgccacccaggtgcgccatctctctgacctgctgaacatgagtgatgtggtcagcctgcacgtgccggaaacgccgtccacgcagaacatgattggcagcgaagagctggcgctgatgaagcctggtgcgctgctgatcaacgccgcgcgcggtaccgtgatcgacatcccggcgctgtgtaatgcgctggccagcaaacacctcgccg

SEQ ID NO: 23196 - DNA, 228 bp, Glycine max
  Peptide Sequence Number=SeqID_114881
atgtgtaagaaaattttgttgtcaggccaggccgggttccgtgtccattattgcgaaacgcatcgcaccatagagctggagattggtgccatgagcctgcgcctggatgaggatgcgttagagctcatgagtgacgcactggacgaatcagtcaccaagttacaggccctgcatgcgaccaaagggtctttccgggcctttatgcggcaattgaatatgcctgattaa

SEQ ID NO: 23197 - DNA, 426 bp, Glycine max
  Peptide Sequence Number=SeqID_114882
atggaaatctttattcaaccatttgatcctggtgcatggaacactattgttaaaggaccttttataccaactaaagaagtgaatggtgaattggtgcctaaagaatgggatcagatgaaagatgatgagaaaagaaaaaatggagaaaccattttagaacttcaaacaagattcacccatattgtgaatcaccttcttggtcttggaaaaatgtttgaaggcgatgagctaagcatcaaaatcctaaactatcttacaagaaattgggaaccaaagatcacaatgatcaaggaatccagggacttagcatcaatgtcgatggaagctctcttcgaaaaattgcttgcatatgaatacgagttgattcaacaatctcatgcagaagaaataaaaaatgaaaagaaaaggaattgcactcaaatttag

SEQ ID NO: 23198 - DNA, 591 bp, Glycine max
  Peptide Sequence Number=SeqID_114883
atgcttggggatggaaatgaaggaatgtctacactacctggattgaatcagatacaatttgaagggttttgtaggttcattgatcggggcttaccagaagggctttttaagtttccaaaaattgaggatacagatcaagaaattgaatttcaattatttgtagaaacatatcaattattagaacccttgataaacgaaaaagatgctgtatatgaatcgcttacatattctgctgaattatatgtatctgcgggattaatttggaaaagtagtagggacatacaagaacaaactatttttgttggaaacattcctttaatgaattctctgggaacttctatagtaaatggaatatacagaattgtaatcaatcaaatattgcaaagccctggtatttattaccgttcagaattggaccctagcggaatttcggtctatactggcaccataatatcagactgggggggtagattagaattagagattgatagaaaagcaaggatatgggctcgtgtgagtaggaaacagaaaatatctattctagttttatcatcagctatgggttcgaatttaagcgaaattctagagaat

SEQ ID NO: 23199 - DNA, 337 bp, Glycine max
  Peptide Sequence Number=SeqID_114884
atggctgcctccaacatgagccagtcaagggggactggggtacaatgctttcagtgtggaggaccacatcttaagaggaattgcccacagctccagcagacacaggagaaccgttgttatgtgtgtggcaaggtgggccattatgctcgagaatgtagggtgaccgggagaccgacggtaactgccaattccaacaccgtcaatcgtggacccactaattccacaaggagcggtaatgttagcaacaacaacattagtggtggaagaccaaaagtaccctctcgggtatttgctatgagtggctcagaagcggctgcctccgacgatttgatacggg

SEQ ID NO: 23200 - DNA, 174 bp, Glycine max
  Peptide Sequence Number=SeqID_114885
atgcatcccgcgagtcatgcgtcgccctcccgccgaaggtgtatgcttgaggtgatgcaatcctaccccgcaagggcattggatagaaaactccaagtagattgggccagatatgcaagagaaggccctagggttcttatgagacttagggtagatttcgggtccatgggctaa

SEQ ID NO: 23201 - DNA, 474 bp, Glycine max
  Peptide Sequence Number=SeqID_114886
atggctaagttagacccagatatagtcctagagttttacgttaatgcttggcccacggaggagggcgtgcgggacatgcggtcatgggtgaggggccagtggattccttttgatgcagacgccctcagccagttcctgggtgacccgctagtgttagaggagggccaggagtgcgagtttagtcagagaaggaaccgggcggatggatttgacgaggaggccatcacccagctgttatgcataccaggtcaggattttgcccaaaccactaccaggaggctggtgcagatcatacgcaccaatatgtcacctaccaggcaccctctagacccagataagtctaacagggccctgggttttccagcattaatcacgggtctctgccagtcattcggggttcccgtcacacctagtaaggtgattcgaccgtcgatcacccgggccttcattgagaagtattgcatgcctagatag

SEQ ID NO: 23202 - DNA, 543 bp, Glycine max
  Peptide Sequence Number=SeqID_114887
atgagtctagtgtatgaaaagcagatcaaggtaacagaagaaaatatagatcagaataagcacgtcaataatgtacaatatgtgagttgggtagaggaaattgcaaccgaacattgggattctgtaaagcatttaactgaataccccgaagatatctggatgctgcttgatcatcatatccaatacaaaaagcaagtctatctgaatgatgttattactgtaaaaacatatcctaaaaatcctgaaggaatcaggcaacccaggaaagttgaattttattgtaatggagagcttgtggtagattcattaacactttgggttcttattgattctaaaacacaaagaattcaaaggctgaaaatgaaaggaaagcctattaatgatttggaaaaccctaaaaatgggatggtagtggattttggtgatattaaaagtatcgtaaaatctgaaattgtagatgtttgggatcatgcagtattgatcaacggattatcgccgcataaggaactggtgaagatcttgaagaaagagggcataaagtaa

SEQ ID NO: 23203 - DNA, 489 bp, Glycine max
  Peptide Sequence Number=SeqID_114888
atgatacgcggagataccttacggttattcgcacccttttgtcatccagaggcggcgggcccgatgacaagcagagaccaagtttggtcattctgcacccttgtatcatccagaggcggtccgaggggcgggcccgatgatacgcggagataccttacggttattcgcacccttttgtcatccagaggcggcgggcccgatgacaagcagagaccaaaggcggcgggcccgatgatacgcggagataccttacggttattcacacccttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccttgtatcatccagaggcggcgggcccgatga

SEQ ID NO: 23204 - DNA, 216 bp, Glycine max
  Peptide Sequence Number=SeqID_114889
atgggggttaagtaccttgaggcggtcaagcgaaggttgcatgccaccaaacaatggtccccggacaaaattagggcaatcaattcatggggctccggacttgatggtggaggatgcatgaacaacgctaggcaatcaattcatggggctccggacttgatgatggaggatgcacgaacagcgctaggcaatcaatttgtgaggctccggacttga

SEQ ID NO: 23205 - DNA, 466 bp, Glycine max
  Peptide Sequence Number=SeqID_114890
atgacaagcagaagaccaagtttggtcattctgcaccctgtatcatccagaggcggcgggcccgatgatacgcggagataccttacggttatccgcacccttttgtcatccagaggcggcgggcccgatgacaagcagagaccaaatttggcggcgggcccgatgacaagcagagaccaaatttggtcattctgcacccttgtatcatccagaggcggcgggcccgatgatacgcggagataccttacggttatccgcacccttttgtcatccagaggcggcgggcccgatgacaagcagagaccaaaggcggcgggcccgatgacaagcagagaccaaatttggtcattctgcacccttgtatcatccagaggcggcgggcccgatgatacgcggagataccttacggttatccgcacccttttgtcatccagaggcggcgggcccgatgacaagcagagaccaa

SEQ ID NO: 23206 - DNA, 1160 bp, Glycine max
  Peptide Sequence Number=SeqID_114891
acggcggcatgaccggcgccacgctggcactggcgatttcgcatctgacgcagggccagttgccggtgacgctgattgaacgtcatcagccggacagccgcgcgcacccgggctttgacgggcgcgccatcgcgctggcggcgggcacctgtcagcagctggcggaaattgacctgtggcgttcgctggcggattgcgccacgcccattacccacatccacgtttccgatcgcgggcacagcgggtttgttcagctgcaggctgaggattatcagctgtcggcgttgggcaacgtggtcgagctgtatgacgtgggacagcgcctgtttaaacgtctgcgtgaggcacccggcgtgacgctgtgctgcccggatcacgttacctcagtaacccgcagcgccgatagcgtgcagacgacgctcagcagcggcgcaacgttacagggcgcgctgctggtggccgctgacggcgcacgctcgccgctggcggcatcctgcggcattcgctggcagcgcgacgactaccagcagctggcggtgattgccaacgtcgcgacgcagttgccgcatcagggccgcgcgtttgagcgcttcacccggcatggcccgctggcgctgctgccaatgtccggcaaccgtctgtcgctggtgtggtgccatccggcggctgccgaagccacggttaagcagtgggacgatgccaccttcctgcatgaattacagcgcgcctttggctggcggctggggcgctttactcacgccggccagcgcgaaatctatccgctggcgctgcagaccgcagagcgtcaggtgacgcaccggctggcgctggtcggcaatgcggcgcagacgctgcatccgatcgccgggcagggctttaacctcggtctgcgcgatgtgatgtcgctggcggaaacccttgcggctgcgcatcgtcaccagcaggatccgggcagccacgcggtgttgcaccattttgctgcgcgccgccagccggatcgcgcggcgaccattggcgtcaccgacggtctggtgcggctgttcgccaaccgttatgccccgctggtggcaggacgaaatcttgggctggtggcaatggaccacctgccatggctgcgaaacccacttgccgtgcgcacgctcggctgggttaagcgttaa

SEQ ID NO: 23207 - DNA, 561 bp, Glycine max
  Peptide Sequence Number=SeqID_114892
atggcgaccattctgcgcacgatgggcagaatggcgaggagaaccggaaaggcgaccacccacgaaagggcccatgccgtcatccagctggatgcgagattgggatgggcaatgccaagggtcttggcggttgcaatcaacgacacaatgaacggaaggcgcaacgaaacatcaatgcgaattgccgttcccggcgagattgatgcgttgcctaacgatgacgacacaaacgagatttactggaccagcgttgcctgcacgctgctcaacccggacagctgccagtgccgtgattatccgaaccgcaagaagacggtgccggactgcgtttttctgacgccggaaatcgttgacgaggtggactggctgcctgtgacgtgcgcctaccgtctggttgcagaaggttcggatctctattggtggcatccgcttatttcgggttcacccgaaacggtgcacgaggcaggtatttccgttcgcggcaaggtgacggctttcgatcacgatctggaagatgacgacgattatctcgatcatatggtgatgccgagccaccgctga

SEQ ID NO: 23208 - DNA, 693 bp, Glycine max
  Peptide Sequence Number=SeqID_114893
atgtgggcatgggaacactgcacgactttggctccaaagagaactcctcctataatagaaaacaaaccactgggacacatgtggctgcgacgtggaaaccaacatattggcaatgatgatctaatagttttccgttgcaaattggatatcatgaaacgacatgagtttttgtgggagccttacacagcaactgttatgtcgatgttgcctcccatttatttggttggcagtatggcatggcgcaaaacaaaaatgtttatcgacccaaacaatgcaagcacgactacattgggtgaagttaccgagacattgcagtatatggtgtcaccccaagggcgaaacacatggacagttgatgatctcgtgccatatgtggaaaagttagcgattttatcccaagagcaagagaggatcactgagcctgtggcacatggtccagcatcagagcgtcgatttcccccacaagagtttcacatgcttcagtcaagtgttgaaactcgaggttttgacagacgaagggagattgttcaagcggaagatttttcccaacatatggagcagcgtggtcatggaatgtattacacgccaccaacatttgctcagtatccttcgcagatgtatcagtatcctttcgagggccatgacactgatatgtctgcaactgatagcagaaataatttcattattttctaa

SEQ ID NO: 23209 - DNA, 498 bp, Glycine max
  Peptide Sequence Number=SeqID_114894
atgagaaaaaatgcaaccaccgttgcgctggcactggcggggttggtggcgagttctctcgcggcttcagcgaagacgagttatctgggtgaattcagggattggggtgtttatcagaacaccgaacttgcaggaaacaagtgctatgctttgaccgttccggttaatttccatccagccggtgtgcggcacggcgataatttcgtgattatttccaaagcggacggacaatacagcccgcaactggtgatgggatatcaattgaaggccgatagttcggtcaatgtgatggtggacggcgcacggttcccgtttttcagcgagggtaatcgcgcctgggcggaaaatgtcgccgatgaagccaagctgatacgcgcgatgcgcgcaggcaagacgctcaatgtccaggccacatcggcccgtggcacacagacccgctatacattttccttgatggggctctcagcctcgttgcagcgggtggatagctgccggtag

SEQ ID NO: 23210 - DNA, 795 bp, Glycine max
  Peptide Sequence Number=SeqID_114895
tgctggatttacgagcactttccctcggtcgcggagtccaccactgatcaggactacgacgaggcttccccgcgtgcgtgcaggtggattgcgacgaagaagaccgtgaagagcattcgcacgccggcatacacggagcgcctggaccgactccggattctggatgtctgttggatcccttatggggagcatcgggaggtccaggacttccacgtcagatcatgctattccggtctcttgcgctgggggcctgttgctgtttattaccgatcggagagggtcgtgcgacagtttggctacacgcagaccattcctgcttctcctgtcgattcatgggtctcgtatgatgatatacacgacaggtggatgcactacgaggatcatatcgtaccagcagatgaggtgtgcgttgtgccaggggcgtgttccagtgacttcctggactggttcttccgcatctcccatcctttcatgacaccaggccacacattagatcctctgcctcatggtcacgccctgcagccccgagtcgtccctcaggccccgcagacagatatccctcacgtgccggagccaggagcattgtccacatctacggaggagcctagacatgcagtggaagtttgtgatgacattgctgagaggttggagcgccatctgagtctaggggtggtcacgcctggctcatcgacacatgaggtgatcgaagaatgcctcagattggccaggagtgtgacacaggaccatctagtatacgttaggtgtagacgcaggcggcgcactgatcaggcgtag

SEQ ID NO: 23211 - DNA, 408 bp, Glycine max
  Peptide Sequence Number=SeqID_114896
atggtccctatcatcggtctaccactgcttaggacctttgaggttgaccgccagcacccatcagaggttatacggtatgatcccgcaaagggattctctgaggccatccacttagcgaactctttagctaagcgcttctgtgtctctttactggtcaacgcatttaaaaatacggagggcttaggcttatatgtagccttgcggcgcttaccttcacaggtcttacaggcacctcggaccctatgggggccattaggactaaaggactcaataggtttaacgatcagacatttattacaagttttcattgctgtatttccttatggtgtaactctatgtcgcatccctacgccagacccaaacgggcacagcaagccctaccagcgagggcatagagatacatcataa

SEQ ID NO: 23212 - DNA, 529 bp, Glycine max
  Peptide Sequence Number=SeqID_114897
gctttttcgtcttacagacagcaaaaaagtttatacggataaccactcgggtatttccgcccgtcagcgtgactcaaaagtcagtatcacagatcttgtgagcgcggaggatgacgtcgcagaagacgaagttagtctctacgtgctatcagggttttcgtcttaccgacaacaaaaagtttatacggataaccactcgggtatttccgcccgtcatcgtgactcaaaagtcagtatgacagatcttgtgagcgcggaagaagacggcgccgaacatgacattagtctctgcgtgctatcaggcttttcatcttacagacagcaaaaagtttatacggataaccactcgggtttttccgcccgtcagcgtgactcaaaaggcgccgaagacgacgttagtctctgcgtgctatctggctttttgtcttacagacagcaaaaagtttatacggataactactcgggtatttccgcccgtcagcgtgactcaaaagtcagtatgacagatcttgtgagcgcggaagatgac

SEQ ID NO: 23213 - DNA, 102 bp, Glycine max
  Peptide Sequence Number=SeqID_114898
tcgaagtacttctgtaacgcttccgtaagcgattctgtggaaattcttcatcgttcttcgtcgttcttcaccgttcttcatccgttcttcgttcttcaacgg

SEQ ID NO: 23214 - DNA, 117 bp, Glycine max
  Peptide Sequence Number=SeqID_114899
atggctaagcgcatggaaaattctggaagaaggatgagttgtatagaggtgctgagcaaaggccaacttgctaagtgcaccgtcttcaccttcaggctgagcctgagagacaactga

SEQ ID NO: 23215 - DNA, 462 bp, Glycine max
  Peptide Sequence Number=SeqID_114900
atgtgtattgtcaatggtgtagagatgattattagcgttgtagtttggaaagcaattgaagggatagacatgggtggagtccgcaagtttgaggatccaatggatggctacagcaagatggagacatacagaggtatgcttcttgacccaacaaggattttgagaaaccaacaaggtgttggtggtctgacaatgttagtatatatcattacatacattttggcaccaagggccaccaacgatgctcaagttactgacaacgacttgcagatcaaatatgggccaaaattagccttcaccaaagcctctaatgagataaccgaaaggcatctcaagaagcttggcatgacatatgttgattatgaatggatcatggcaggagagcaaccgacaacagcaaacgtcaatcagatggaagaaaaagctaaagaagaagctcgacaaaagctagctcaacaatga

SEQ ID NO: 23216 - DNA, 252 bp, Glycine max
  Peptide Sequence Number=SeqID_114901
atgtcgtttgtggctagaaacccagaagtgacaagtcagccaattcaggctagatcaatcccattggtcaagctaaatatggcttttatgtctacatggcaagcaacttcgtcgaatatggtgtcgataggaatgtttaactctagattggtggccaaatggggtttattcctagacccttggtatccaatgcgagttatatgcccgctaatattagtaatccatttgctattacccttgggggttaagtag

SEQ ID NO: 23217 - DNA, 267 bp, Glycine max
  Peptide Sequence Number=SeqID_114902
atggggggtgcaaatagaaattatcaaatctgggcatttccttgcttaaggtggaagcaacctagctcgcctgggcaagctgagatcacctggagggtgaacttatcaagatggggtgcaaatagaaattttcaaattttcgaatttgggccttccggaacattttggaagctgggttacttaaggaggaagcaacccagctcccctgggcgagctgagctggcctgggcgagctgggcggcaacctcctcccccattttcctataa

SEQ ID NO: 23218 - DNA, 260 bp, Glycine max
  Peptide Sequence Number=SeqID_114903
ataagcccagtcatgtcttcaaattgaaaaaggctttatatggcttaaagaaagctcctagggcttggtatgagcatctgagtaagttctttttagagaagtgtggaagcaatgccttccaaggttattttgatgatgccaaagaatcaacagttaagcaaattccaaagattcaagaatcaagtttcaagaatcaagattcaaggataatcaagatcaagattcaagactcaagattcaagaatcaagagaagacttaa

SEQ ID NO: 23219 - DNA, 753 bp, Glycine max
  Peptide Sequence Number=SeqID_114904
atgagtcatcattcatctagtgttaatggcgagggtactagtcataaagaccctttatctagaatcttagatgagttgagttccctcaagttatggaaagaaaaacaagagagaaaagaaaaagaaaaacaagagagaaaagaaaaaggaaaaaaaagagtggaagaaataagtcaagatgaaagaaagaaaataagagaggaagaaagaagaaaaataatgaaagaaatgaaaagagaaaaacatgcctcctatagtagtcataactcttgcaagagcctaagtgaagaacttcgtgactattatgaaggaaggcataggccacatcttagaactcactcccatagaagagaaaaggaaagaaagcctcaagaggctaacattaacctcccatacttccatgggaaggacaatgtagaggctaacttagtttgggaaataagggtagagcaacaacttaaaaagaagtctacaccaaaatcttatggctctcactcttatccaaagaaagaccaaggtcaaggcatcttagaggtgacaccttctaagcccaaagatgataaggggaagacaatagaaaagctagcccctaaggctagtatgcaagagaaaactagctctataaaccaagatgaggctactacatcaccttcctctagtgaaagtgaagaagcaaaatgggaagaatctagtgaagaaatctacccccaagaagaaggacaaccattagttgttaaagagaagtgtaaggag

SEQ ID NO: 23220 - DNA, 246 bp, Glycine max
  Peptide Sequence Number=SeqID_114905
atgactaccatcagagttattctgagcatagtagctgcagagaatcttcacttggagcagaaatgtcaacaggtttctgaaaagcagcagttgaagaaaactttcgaaagtgaaggatcttgtccagaaacaagtacggctaagaagaatgaagaaaaatcgtggtctttaactaaattgccagaaggaaagaaggcgttacagaataggtgggtctataggctgaaggaagaatctgacgggtag

SEQ ID NO: 23221 - DNA, 105 bp, Glycine max
  Peptide Sequence Number=SeqID_114906
atggcacatcaggtacatatcttgtggatcagttcaagtggagggtacatccacttggttgttcaagagaacaagggagggtacatgccatgtggatctttgctt

SEQ ID NO: 23222 - DNA, 189 bp, Glycine max
  Peptide Sequence Number=SeqID_114907
atggattatgcagatgacgaggtccatgaacagcctgaagaagtagttgttgatgatgtggcgaccgatgccgagggattttcaggcggaccccacgacatatcagtgttgcaagactatgaacgtcctgagctaaaattttcctcccatggaagaaaggttgagaaatttggcaagtctgccccatag

SEQ ID NO: 23223 - DNA, 617 bp, Glycine max
  Peptide Sequence Number=SeqID_114908
attgctatggaagtctagtaagggaattcattgtcaacattccctctgacataactaacagaaaaagtgatgagtatcagaaagtgtttgtcagaggaaaatgtgttagattctcccctgctgtaatcaacaagtacctgggcagaccaactgatggagtggtagatattgctgtttctgagcatcaaattgccaaggaaatcactgccaaacgagtccagcattggccaaagaaagggaagctttctgcagggaagctaagtgtgaagtatgcaatcctgcataggattggcgctgcaaactgggtacccaccaatcatacttccactgttgccacagaatcctttgctgtcaaattacccattgccttcccaactgtattgtgtggtattatgttgagtcaacatcccaatatcttaaacaacattgactctgggaaagctgctgcttcaggtgctgtgtccaaggatgccttgattgctgaactcaaggacacatgcaagaaaagtggcattgatggtgaagcagctgaggaagatggtgaagcagctgaagtagaagaagaagctgctgaagaagaggaagaagcagccgaggaagaagaaagaagctgctga

SEQ ID NO: 23224 - DNA, 383 bp, Glycine max
  Peptide Sequence Number=SeqID_114909
tattgcacgcagagacaggtccagggggatgctccgtaggccgcagacgcgccgccacctcatcaggccggtccaaccggatcgttgatacggagcattatttgtggcatttggttcgccagcaggcggccaaccaccgggcacatgtacagacccatgattgtctttatcatatgagccttagcctgcagagccaggactttacttcttttccgtgccctactccggaccagttcagagcagaggtcgcatggcctggagattggcctgaggcccgggcaggagaggcacctgcagaggctcccgacgaggcagatgaggcccgcgaggacgaggagatggccgatttacttgatttcttaggaggaagcggggccacatga

SEQ ID NO: 23225 - DNA, 468 bp, Glycine max
  Peptide Sequence Number=SeqID_114910
atggcacacagagacaaattatggtcattctgcgccttttgtcatccagaggcggcgagcccaatgacatgcaaagaccaattatggtcatttctcacactttttcgccatccagaggcgattgtgtccgatggtgcacagagacaaattatggtcattatgcacctttccatccaggctcgatcgtgttcgatggcgcgcacaaattatggtcattctgcgcctttccatccaggctcaatcgtgtccgatggcacgcagagacaaattatggtcattctgcgcccttttgtcatccagaggcaatcgtgcccgatgacatgtgaagacaaattatggtcatccagacaaattatggtcattctgcgccctttgtcattcaggagcagcgagtcgagtgataaacgcgcagagacaaattatggtcattctgcgccctttgtcattcaggagcagcgagtcgagtga

SEQ ID NO: 23226 - DNA, 201 bp, Glycine max
  Peptide Sequence Number=SeqID_114911
atggctctagtgattggtcccttcctagggaggattgcatcaacaaaggctcaaaaggagaagaaaatgaagttcattttttgtgttttttctggaaaacgcgatgaactcgctaagcgcgactatcgcgctaagcgagttcatcttttgaggatgaacagtcatcctcttgctgaaatgcctatggctaagcgaggctga

SEQ ID NO: 23227 - DNA, 280 bp, Glycine max
  Peptide Sequence Number=SeqID_114912
atggcctctaggaaacacaagagtatcagttcaagacccacaactcaatatgatacaaggagatttcacttcttagatgcatggaactggtacacggataatgtattaggcagaaacatcttgccagagaggaaggtgaagctctaccacattgagtttgatgattttaagactaagttggagaggcgtaatctccataaacacctcaccaatttggttgatgggagcatagatgtggctttggtgaaagagttctatgcaaacctatacaactttgaag

SEQ ID NO: 23228 - DNA, 246 bp, Glycine max
  Peptide Sequence Number=SeqID_114913
atgcccaaatgccctaggtgtgaggtatcacagtacaaagtgaaggatgacgatgagtatagtagtgatgaaaactcaaagaagggccccccagcgaagatgatgcaaaagaccttacatgacatgcaaatgggaaaaactgcgatggaatgctctgtcatccaattgattcctcccagtggaaaaagattgatcgtttgtatccagattttggcaaagaggcaagaaatcttaggcttggactag

SEQ ID NO: 23229 - DNA, 300 bp, Glycine max
  Peptide Sequence Number=SeqID_114914
atggggaccgcacccacaagacacccagtggacccgaaaaagtccaacaaggccctggggtttccagctctgggatcgcgcctgcaagacaccccagtggacccgaagaagtccaatagggtcttggagttgtcaagctctaaatacgggtctctatcagttcaagggagtgcctgtttgcccccagcagggtcatcaggccccctaccaatcgagttttcatctagaagtgttgcgcccccaggcaggggcagggcgagacaccacagcagcattgggatggacggtagcgggcaatag

SEQ ID NO: 23230 - DNA, 492 bp, Glycine max
  Peptide Sequence Number=SeqID_114915
atgaagcacttcactgacaacctcatcagtgccaacatagaaacagctatgaccatgattacgccaagctcgaaattaaccctcactaaagggaacaaaagctggtaccgggccccccctcgaggtcgacgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 23231 - DNA, 366 bp, Glycine max
  Peptide Sequence Number=SeqID_114916
atggtgaaagtggaacctctacgtgccgatcaacgtctcatttcgccaaaagttggcccagggcttcccggtatcaacagggacaccaggatttatttattctgcgaacaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 23232 - DNA, 563 bp, Glycine max
  Peptide Sequence Number=SeqID_114917
gcttacattggctcgccaagttaaagattgtcaacgaaaagaacttcgaagctcatgaagaggatgaagaagtccgagctctgaaagccgaactaggaaaagcgagacttgccaaagaaaagttcaagttggtcgctacagacgtccaaaaagagtgtgccgggttacaagaagaaaatgcagctaccgcaaaagcccttgaacaagaaaccaagagggctcgcaaggaagaacatggccatgacaaattccgtggagcgttgtggggcagtaacagtgagttcaagcttcgaagggaggagagagaccgatcacgagcacatagcatggttttaaaagaagagttagccgtttgctcaaggtccaaaagaaacttgtctcagcgtttatgcgagacagagaccaagttagctatcatcaccaagtaccaagaagaactaagtctagccacggcccacgagcatagggtggcggacgaatatgcccaagtgtacgcggaaaaggaggctagaggaagggtgatcgactcgttacaccaagaggcaaccatgtggatggactga

SEQ ID NO: 23233 - DNA, 204 bp, Glycine max
  Peptide Sequence Number=SeqID_114918
atggatcgcgcccacaagacacccagtggacccagaaaagtccaacagggtcctgggttttacggagagcccgtcgcccccaacaaggtcatcaggccccttattaactgggctttcatcaagaagtactacgcccccccccccccagtcaggcgcatggcgagacaccacagcagcctggagatggccagcagcgggcaatag

SEQ ID NO: 23234 - DNA, 462 bp, Glycine max
  Peptide Sequence Number=SeqID_114919
atgccctcaacgcacgttttaaggaaaggagacacggctttcttccgttggtttgctcccctcatgtgggatcgacgaacccatatgcaatcttatagcagagcagcgggaattgtccagttaatacaacccctcgttcctaccagcggaatgtttgggtatcttccacatgagaaaaggactcattcttttccttccttccatcgagggaaccaactgattgttctacctcctatcccggccaagagctggtcccaatctattctcctcttttcagtacacgagcgatggctcaggagcggacatggatgtcttgtgtcttgttggaacaagtgcgaaaccaaccaaacacagagggcgggtaagcaacagatgatccgtgcgctactcttttcgcaccttcggtcaaatgtgtcaaatagatctgccaagacagctaccaccggactttccttgctatag

SEQ ID NO: 23235 - DNA, 573 bp, Glycine max
  Peptide Sequence Number=SeqID_114920
atgcggagacaaaatttggtcattccgcacccctttgccattcagacaaagtcgtgtccgatggcacgcagagacaaattatggtcattctgcacccttttgtcatccagaggcggcgggcccgatgacatgcggagacaaaatttggtcattccgcacccctttgccattcagacacagtcgtgttcgatggcacgcagagacaaattatggtcattctgcacccttttgtcatccagaggcggcgggcccgatgacatgcggagacaaaatttggtcattccgcacccctttgccattcagacacagtcgtgtccgatggcacgcagagacaaattatggtcattctgcacccttttgtcatccagaggcggcgggcccgatgacatgcggagacaaattatggtcattccgcacccttttgccattcagacacagttgtgtccgatggcacgcagagacaaattatggtcattctgcacccttcgtcaatcgcggccgacaagcccgttgacacgcggagatttacatcataagatctgtcatactgactcacaagatctgtcatactga

SEQ ID NO: 23236 - DNA, 555 bp, Glycine max
  Peptide Sequence Number=SeqID_114921
atgaaggcgtgggcgtgtagccctctaaaggcaaggacttgtagtcctctaaaggtgaggatgtgtagtcatctgaaggagaagacgtgtagtcgtctgaaggtaaggacgtgtagtcctctgaaggcgaggacatgtagtcctcggaaggtgaggacgtgtagtcctatgaaggcgagggcgtgtagccctctgaaggtgaggacgtgtagtcctctgaaggtgagggcgtgtagccctctgaaggtgaggatgtgtagtcctctgaaggcgaggacgtgtagtcctctaaaggcgagggcgtgtagtcctctgaaggggaggacatgtagtcctttaaaggctagggcgtgtagccctcttaaggtgaggacgtgtagtcctctaaaggcgagggcgtgcagccctctgaaggcgaaggcgtgtagccctctgaaggcaaggacgtgtggccctctgaaggcgaggacatgtagccctttgaaggtgaggacgtgtagtcctctgaagttaagggtactagtactcatggtccacccttatgagaaaacatga

SEQ ID NO: 23237 - DNA, 627 bp, Glycine max
  Peptide Sequence Number=SeqID_114922
atgacgaaagatgcggataaccataaggtgcgtccgcgtgctactggaccctcgggtcacgatagcagaattgagactttttcgcggtctcggccggaagacgctgacatctctgggaagggtgcagatgactacattggtctctataaccataaggtgtcaccgcatgctaccggacccttgggtcacgatagcgaaattgagactttttcacggtctcggccgaaagacgctgacatctccgggaagggtaccgatgaccacattggtgcggataaccataacgtgtgtccgcgtgctactggaccctttggtcacgatagcgaaattgagacttttttgtggtctcggtcggaagacgctgacatctccgggaagggtgcggataaccataaggtgtctctgcatgctactggactcactggtcacaatagcaggatggggtggtcaacaaaagcgcacgttggctacttaacagtgaatgactcttctttcttgggagatcccactgttccttcttctgagggcaaggtttatggtggtttgaggttttggctcaaaaggcttgtagaacgactggtcatgatatatgtcagggtgttggtttggtcagcgattcagggataa

SEQ ID NO: 23238 - DNA, 216 bp, Glycine max
  Peptide Sequence Number=SeqID_114923
atgtcacagaacttcacgtattgtgcaacaaagggtgctcagtacctcgaagcggtcaaacaaaggttgcatgccatcaaacaatgtgttgttctaggcgtaatatcttttaacgacatccgagtttactggcgaaggcagttcctcgtcgtccatgctagcgagtatcaaggcccccccagagaaaccttcttaacaacgaacgacccttcataa

SEQ ID NO: 23239 - DNA, 131 bp, Glycine max
  Peptide Sequence Number=SeqID_114924
attattcaatctgatggtcttgctgcagctctgttctccgctgttgaagtgagcgactccgctcttgttgaagaagctggagtggatgatgattcgacgttctctagagtcagtatccgtagcggggacag

SEQ ID NO: 23240 - DNA, 183 bp, Glycine max
  Peptide Sequence Number=SeqID_114925
aaagagatggtttctcagcctgtacctcataaagaaagtcagaggtatatgatgcaagctccattggagcttgtaggcctagaatcttcttcatcaatggattcctttgcttcttggaagatgaatggcagcggaatggagaaagggaaagagagaggagatgccacttcaaggagaagatga

SEQ ID NO: 23241 - DNA, 359 bp, Glycine max
  Peptide Sequence Number=SeqID_114926
gagcaaacaagcctgtgacgcgcagaggctacatcgtctctgcacatttgtcatcccgaggcggcaagcccgatgacatgcgggggtgtcgtacggttatccgcaccttttgtcaatcagggccaacgaacccgttgacacgcggagacacccaagttgttatccgtaaaaacggtttctgtcatcttgacccacgaagtcaggtgacatgcgggggtaccgtgtggtttttactctcttcgtccggagacattcaagcccgacgacgcacgagattcttctctgctgggcaggggcgatcgagtgcgatagcgtggggaagtgtcgtggttccgctggttgggatattaaccggctga

SEQ ID NO: 23242 - DNA, 279 bp, Glycine max
  Peptide Sequence Number=SeqID_114927
atgaaccagcaagaagccttccggtcatatctgcttggttggtgcaaaccaaccggcgggcatcatgcacagagaattcatatttccaatcatcaatcagtgtaccttcaaatgagaagagatttgtgtaccgtatccgctgttcttcatatgagaacaatgagaaaaaggaaatggaggaaggaatctgagtttcttgagtctcggaatgtcattgacttcgactcaaagaaccctttcgcttctttgatggttccgccatatgaagggattatttga

SEQ ID NO: 23243 - DNA, 135 bp, Glycine max
  Peptide Sequence Number=SeqID_114928
atgacctctatttatagcctaagtgatgcaatcctccctaggaaaggaccagttaccagagccatgagcaagaggctccaagaggattgggctagagttgataaagaaggccttagggttctcatgaaccttagg

SEQ ID NO: 23244 - DNA, 545 bp, Glycine max
  Peptide Sequence Number=SeqID_114929
ttgggcaccgtaacccagcttccggttcatcccgcatcgccagttctgcttaccaaaaatggcccacttggagctctcgattccatggcgcggctcaacagagcagccgcaccgtcctaccatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 23245 - DNA, 745 bp, Glycine max
  Peptide Sequence Number=SeqID_114930
atgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcgtcacagaaaagcatctacggatggcatgacagtagagatatgcagtgctgccataccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagatag

SEQ ID NO: 23246 - DNA, 453 bp, Glycine max
  Peptide Sequence Number=SeqID_114931
atgatacgcggagataccttacggttatccgcacccttttgtcatccagaggcggcgggcccgatgacaagcagagaccaagtttggtcattctgcacccttgtatcatccagaggcggcgggcccgatgatacgcggagataccttacggttatccgcacccttttgtcatccagaggcgaggcggcgggcccgatgatacgcggagataccttacggttatccgcacccttttgtcatccagaggcggcgggcccgatgacaagcagagaccaagtttggtcattctgcacccttgtatcatccagaggcggcggacccgatgatacgcggagataccttacggttatccgcacccttttgtcatccagaggcggcgggcccgatgacaagcagagaccaagtttggtcattctgcacccttgtatcatccagaggcggcgggcccgatga

SEQ ID NO: 23247 - DNA, 327 bp, Glycine max
  Peptide Sequence Number=SeqID_114932
atggaacttatgagactaaaccaacatgatgaaaatgacaagaaaaagaaaagaattgcacttaaagcctcatcttctattcaagaagaaagtgacaaagaggacaaaggaaatcaaagaaaagaaaacttcaattcaaagaaaagaagagaagattcatgttctgttccaaagtgctatgaatgtaatcaaccaggacatctgagagttgattaccctagtttcaagaaaagaatggaaaaatatgacaggaaaaccgacaaagataagaaagcaaagaaagcttacattgtagaagcaagcttcatgatgttgaatcaagattga

SEQ ID NO: 23248 - DNA, 515 bp, Glycine max
  Peptide Sequence Number=SeqID_114933
atgggaacaaatcaaaccggcaagaggttctgccaagtcaaggtcaaaagcctagataccaccagcatcaaggaattagggcggttgatggaacccctccaaatgcaagccttccgcaagacttacggaaagatcttagagttgaccatagcagaggatgtcctctcgggggaagaaaccatatctttcctccgggtgtctcccctctttgagcagaattgcaactgtggtcaaggattcagcaagaggtttggaccgcataaaacagactcggaacggcatagcgggcctaccacagaagtacctagaagacaaggcgaggggttggccaatcaaggagactgggtcccgtttatggatgtgttagctttgctaatttttggggtcgtcctctttccaaacgtggatggtttgatagacctagtagcaatcgacgctttccttgcctaccaccatagcaaggaaagtccggtggtagctgtcttggcagatctatttgacacatttgaccaaag

SEQ ID NO: 23249 - DNA, 199 bp, Glycine max
  Peptide Sequence Number=SeqID_114934
atggaggggacacatgaaataccccaccataatctagccaacttcaagccttgcctcgaatatgccactgacgggcaagtagttggtgcctctcctactatggctgaaatgggaaagttggatcagatagaggaaatactaagggttgttgaaggaggcgaagattatacccttgctgacatggaagatttgtggccta

SEQ ID NO: 23250 - DNA, 333 bp, Glycine max
  Peptide Sequence Number=SeqID_114935
atgccattccgagtctgtgttgtgcggtccaaacctcttgctgaatccttgaccacagttgcgattctgctcaaagaggggagacacccggaggaaaggtatgggtttcttcccccgagaggacaccctagaatttcctcaaattcttcaatggttggtaccaatttggaagtctccgaatgtgaagcatctcaagctggtcgtagtattggtgaggatgcaatggcttctatggatacctctgctaaggtcaactctagatctttccgtaagtctgcggaaggcttgcatttgagaggtcccatcaaccgccctaattccttgatgctggtg

SEQ ID NO: 23251 - DNA, 276 bp, Glycine max
  Peptide Sequence Number=SeqID_114936
atgtcgaactcggatagcaatacctaccaccgagcgatccgccctgtgagagtaggcttctcaaagatgtacttgaccggatccatcttggataccagccaggtggtatggctcaagaaagaggggtctcctggccaccggtggcataagtaccagggggttcatgaggcactatttgattcttccaactgcctcttgacagtcatcgttccagcgaatggactgatccttgtgaaagagcttgaagaacggctcgtaggtagctgtgagctgtga

SEQ ID NO: 23252 - DNA, 577 bp, Glycine max
  Peptide Sequence Number=SeqID_114937
atggaaccaattgcctccctcgcccagtattatgatcagccgttgaggtgcttcatctttggggacttccagctatcaccaatggtggaagaatttgaagagatcctaggatgtcctctagggggaaggaaaccatacctcttctcagggttctacccctcattggccagaatttctaaaaaagtccaaatctcggcgcaggaattagaccgccaaaggcaagtcgaaaatggggtggtcggaataccgagaaaatatttggaggtaaaagcaagaatcttggcagataaaggcgagtggaccccattcatagatattctcacactgttgattttcgagggagtcctctttccaaatgtggatgggttggtggacctggcagcgatcgacgtttttctcgcctatcataaccacaaggaaagtccggttgtcgctatgctagccgacctatatgacaccttcgaccgaagatgtgaagaaagcaatgcaaggattgtttgctgtactccagctctctatgtggggctggtttcacacctttttctccaagaaggtaggcccgtctatccgctacaag

SEQ ID NO: 23253 - DNA, 402 bp, Glycine max
  Peptide Sequence Number=SeqID_114938
atgaagcacttcactgacaccctcatcagtgcccaacatagtaagccagtatacactccgctagcgcccaatacgcaaaccgcctctccccgcgcgttggccgattcattaatgcagctggcacgacaggtttcccgactggaaagcgggcacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcaggctgatggcgaatgggcgcgccctgtag

SEQ ID NO: 23254 - DNA, 150 bp, Glycine max
  Peptide Sequence Number=SeqID_114939
atgtgggtgccaatagcaattttcaaatttttggatttggacctttctagaacagttttgaagcagggttgcttatggaggaagcaacccagctcgcccagaaaatccaagttgaggtgcttccgtaacgctttcgagacattttcgtaa

SEQ ID NO: 23255 - DNA, 231 bp, Glycine max
  Peptide Sequence Number=SeqID_114940
atggcagtggaatggagaaggaagagagaaaggagacgccatttcaaggagaagatgagtctagaaaaagctcaccgccataggaggccatggataagagcttggaggaagaaggagatgaatgaagggagaggaagagaagagcacgaaattttgtgctctaaaagagctctgaaatctgaacccactaatccaagatcaattccaagattctccactaagtgtgcctag

SEQ ID NO: 23256 - DNA, 239 bp, Glycine max
  Peptide Sequence Number=SeqID_114941
atgaagatgctcttgataccacatgatgtaagctccattggagcttgtaggcctagtgtcgcaacctacccttcggcgggagggcgacgcgtgactcgcgggatgcgtgttccacgaaaggaatacgcgcggagtcgccaccaacctttatttgaggaaaacgtcggaaaaaccggaaaagacgcgatctacgaacttttaagtgaaaggttcgggagttgtatttacgcgcggggaag

SEQ ID NO: 23257 - DNA, 333 bp, Glycine max
  Peptide Sequence Number=SeqID_114942
atgtaccctctcttgttctcagttagaacaacccaagtggatgtaccctctacttgtaccacaaaggatgtaccctccaatgtgttaagacaaagttctcaggcgattgttcaggagaatgatagatctcatccagcgcaagttgttgcagcccagatacgcacactgctatataaacatgaaggctgcacgagttttccaccaagtccgagattgaagagttattttagagggttttcggacatgggaggaagcgtgttgcacgtccacacatacatgaccgaagaagcttggacagcaagacacgtgggagaggcacaacaggggaattaa

SEQ ID NO: 23258 - DNA, 684 bp, Glycine max
  Peptide Sequence Number=SeqID_114943
atgattatgaggggccaagacatttatagtagccaagataaggctactacttcaccttgctctagtaaaagtgaagaagcaaaaggggaagaatctagtgaagagatctacccccaagaagaaggacaacctttaatggttaaggaggagtgtaaggaggtaagtgtctcctccaagaggttagctaagaaggaaagacattttgtaataaagacaaatattaaagaaatttcccttcttagacaacctccacattttctcctttgtaaaaagacacttgttagcattgccacatctcttaggcttgagtttattcctcaagtaaaggagttgttggatgagggtttggttcgcaagagattaaatccttgtgctttgttggtgcccaaaataggtattattaggcaccaaatccctaaaataggtggtgtgatgaatgctttgggtggtgcaacactcttttgtagaatcactcgtgcacccaacatcttcatgatttgtgtacatagggactcattaggggttcccatgaaccctaagagaataaaggtcattcctgagtggctcgctccaccaagtgttgaggaaaaaagcctagagtttcaagaacctcaggatttgaggtcaaatccttttcaagggggagggaatgatgcaatcctaccccacaagggcattggatag

SEQ ID NO: 23259 - DNA, 674 bp, Glycine max
  Peptide Sequence Number=SeqID_114944
atggtgaaagttggaacctcttacgtgccgatcaacgtctcattttcgccaaaagttggccagggcttcccggtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggggcctctcctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 23260 - DNA, 366 bp, Glycine max
  Peptide Sequence Number=SeqID_114945
atgggatcaagtcaaaagccttcgcttaaaaagaggttctatcaagtcaaaatcaagagcttagaggtcaccagtttacgaaagttggggcaattaatgggtcaacttcaacggcaagccttccgcaaagcctatggtctccgaactttgcttgattacttgaccttggcgcttttgcatcttgagtttttcctctttcgaatatggaagggtgtagtggacctagcagcgattgacgctttcctcgcctttcatcatggcaaggaaagcccggtcgtcgccattttggccatgtatgttacacgttcgaccggggatgtgaaaagagcagaattgtttgttgtgaccaactcttgggaatactag

SEQ ID NO: 23261 - DNA, 133 bp, Glycine max
  Peptide Sequence Number=SeqID_114946
atgggggtgcaaatagcacccaggcccacttgggccctccagaagattcctccagaaggcggaatcccgcaaaggtttgaaccgttcttcgacgttcttcattcgttcttcatcgttcttcgatcttcaacgg

SEQ ID NO: 23262 - DNA, 285 bp, Glycine max
  Peptide Sequence Number=SeqID_114947
atgaaaaagaagaagattacaagttatgggagtcgttttgatgaagaaatgagtaagataggaaggtttgaaggtttgggaatggagggacgtcgcaaagaggaagagactgcgcaggggtttctgaaaaacgtggtatttatagaccaggacgcattgtggaggcagcctactggtaatcgattacatgaatactgtaatcgattacaagccatctgttctagtgtaatcgattacagtattcatgtaatcgattaccagaacaaaacaatagccttttcctaa

SEQ ID NO: 23263 - DNA, 93 bp, Glycine max
  Peptide Sequence Number=SeqID_114948
atggcgagtggactaaagcgtcggatttatcgttgtacaaatttttgtaccgagttgaaagattcagcagttccaaaagtaaagaaaacctaa

SEQ ID NO: 23264 - DNA, 417 bp, Glycine max
  Peptide Sequence Number=SeqID_114949
atgacatcgaccatcacaaagcttttcctgaggccttaccaggttacatgggatgccatcatgtttagggtctttagtcctgacttcccgctctacagaaagcacgaagaccactccgaaattgcacacggtggtcaatatctaagcatatcagtgttacagttgcatctaactgaaacaagtatgcgagcggggaattctgataaatatggattcctcgagccacagtccattcagaggtctgggcaatcgcagtttgagactgaaagttacataaagagttggatgcaaagttcaaaatgtgatgtctatattggagcctacctaaatgggccaaacaactactttaagggaataattaacagtgctttaaaaggtcttgatgatgctccacacctaagtcaaggctcctactag

SEQ ID NO: 23265 - DNA, 399 bp, Glycine max
  Peptide Sequence Number=SeqID_114950
atgtcgatctccccctgtggaagtatcagttggtctgtgtcgttccgacatagggatcgcgcccgcaagacacccagtggacccgaagaagtccaacagggccctggggtttccaactctgggatcacgcccacaagacaccctgtggacccggagaagtccaacagagtcttggagttgccagctctgattacgggcctctgtcggttctacggggtgcctgttgcccccagcaaggtcatcaggccccctactaatcgagctttcatcaagaagtattgcgccctcaagcaggcgcagggcgaaacaccccagcagtttgaggatggcctccagcgggcaacagacgcaccgccactacctctagagttcacctcagctcatccacaaaaaggttag

SEQ ID NO: 23266 - DNA, 429 bp, Glycine max
  Peptide Sequence Number=SeqID_114951
atgaagctcgttcttaggtgcgatgcgttgaaagacagtttgtccaaagtagccttgggcatgacattgagggaagagccattgtcaataagcattttggccacgatgtggtccaaacatttgatagatacgtgtaaggctctattctgtccccggccctcgacgggtatatgttcatcggcgaaagaactcggttgctttttcagcgaatattctccttttgctgaagtcatcctcttccttggcaaaccttccaacaaggacctcgttattctgaatcgggcccaccctatcgctcgcttccacgcccacctttgctttccccttcaggtctttggatcacatcggtggtttgggtgctgcgaagatccgctcgctacgagtcatgccacttgtaccagatatgtttgtgatcttacaggaggatag

SEQ ID NO: 23267 - DNA, 578 bp, Glycine max
  Peptide Sequence Number=SeqID_114952
aattctatgcaaacctctatgaccccgaggacaaatcacctaagcaagtgaggggggaaacactttgtgcatattctagatttgcactcccgaggcctgatcctcaggagttggctgctaagctttgtatcccagggaggggattcgagcttaacgctgatgggcaggatttgaagattccgaggaagaacatgaccactcttgctcatacttggagtgttctttccttttctaacctcatccccacttctcacacttctaatcatgacacatccagactaggattccctgccttgatcacaaccttatgtaaggctaggggagttcagtcagattggaggtccctggagagcctgagtcctgccattaatttggcatatattaagaagaattgttggaatcttgatgatccaatagtaactttcagaggacccaagaaggccaggggtaagagatctgaggcccctgccacttcagcatcagaggcaccaacaccttcttcttctacggtgtcatgccctaatttcgtccggggacctttgcttgatgacatgcgacctttctttggtccttgtgag

SEQ ID NO: 23268 - DNA, 273 bp, Glycine max
  Peptide Sequence Number=SeqID_114953
atgaccggccctctcgatgagtcgatctcttgctttctcataagggtggaccttggaggactacacgtcctcgccttcaaagggtcatgtaccttcaacttcagaggactacacgtcctcgccgtcaaagggtcatgtgccttcacctttgtagggctacacaccctcaccttcagaggactacacgtcctcacctttagaggactacacgtcctcgccatcagaggactacatgttccccattttcaaagggggacatgcgctcacctttag

SEQ ID NO: 23269 - DNA, 386 bp, Glycine max
  Peptide Sequence Number=SeqID_114954
tcgataagcagaaattaagaacatattcggggattgcggcacgtgataaggtggacaccacctacgagaactggaaggaggtccctactgctcagaaggacctgatttgggaggatattcaggatgtgcgcatcaaggcacatgccatccaaaagcagaatactgccccccacgttttgtctcgtgggggttatgattatttggagcagaagctcctggctgagaagaccaagaagaagatgcaggaagttgcacagtcaggaagcgttgatggcgtcatcgaccctccatccccggtcagacgccacgtgaagtggaagatggcccacacgaagaagacaggggagatgacgactgaggccgcaaaggaaatcgctgagaagatt

SEQ ID NO: 23270 - DNA, 209 bp, Glycine max
  Peptide Sequence Number=SeqID_114955
ggtttcccggtatcacagggacaccaggattatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 23271 - DNA, 264 bp, Glycine max
  Peptide Sequence Number=SeqID_114956
atgcaactcatcaagcaaatcatcaagtctaggaatggggtgcctatactttatcgtgatgttgttgatggccctgcaatctatacacattctccatgtaccatcctttttgggcaccaacaacaccggcacaacacatgggctcaggctctcttggacccagcccttctccaacaattctttaacttgagactctatctctttagtctcctgacggttagtcctataggctggcctattaggaaggcttgctcctgggactaa

SEQ ID NO: 23272 - DNA, 384 bp, Glycine max
  Peptide Sequence Number=SeqID_114957
atgtaccctccactagaactgatccacaagagatgtaccctctcttgttctcagtcaaaccaagtagatgtaccctctacttgtaccacaaaggatgtaccctccaatgtgttaagacaaagatctcaggctgttacacctttgatactttgtgaatggggatacaaaagaattctcaagcgggaatgggaagaatcaaaagaattctcagactgtgtcgttttgaattctttgacaagggagaagggagacacaaaagaattcaggcggttagtccttccttcttttggaaaagggagaagagagacacaaaaagaattcaggcgattagtccttcgtgaattctttttggcaaagggagaagagaatggaaaggatgaatag

SEQ ID NO: 23273 - DNA, 687 bp, Glycine max
  Peptide Sequence Number=SeqID_114958
atggcttctccacctgcctcgcctcattctcctcctcctcctcctcctcctcttcctttcgacgcatcagctttgtcaccacctggtgctgagagaccagtggtccatattgatcctactaacggcaaggccgacgatccccacaggaagaaattaagaacatatttggggattgtggcacatgataaggtggacgtgacgtacaagaattggaaggaggtccctactgctcaaaaggacttgatttgggaggatattcaggacggtgtggacgacactgtctatgagaaatacagcataagaaaggaaaaatggtcccagttttgccagactcgtagagacccttcttgggaggatgtgcgaaaaaaggcacaggctatccagaaacagaactctgccccccacgttttgtctcatggggcaaatctcctggctgagaagaccaagaagaagctggaggaagctgcacagtcaggaagcgttgatgacatcatcgaccctctgtccctcgtcagacgccacgtgaagtggaagatggtccgcaccaagaaaataagggagatgacgactgaggccgcaaaggaaatcgctgagaagattggatccttcgtcccccatggatgtcaggatgttttctccactgctattagatgtccagagcaccttggacgtgtccatgctgctgga

SEQ ID NO: 23274 - DNA, 258 bp, Glycine max
  Peptide Sequence Number=SeqID_114959
atgaccaaacttggtctctgcgtgccatcggacacgactgtgtctgaatggcaaaggggtgcggataaccgtaaggtatctccgcgtatctccgcgtatcatgggtgcagaatgaccaaacttggtctctgcgtgccatcggacacgattgtgtctgagcaaaggggtgcggataaccgtaagattgaccaaacttggtctctgcttccatcggacccgactgtgtctgaatggcaaaggggtgcggataaccttaag

SEQ ID NO: 23275 - DNA, 624 bp, Glycine max
  Peptide Sequence Number=SeqID_114960
atgactacggagggacgtgatatggctgaggacgtcgctgacatgactgatgatgtccctgagcagcctacggaggcacctgatatgcgtgcggacgcacagggtgctgatagtggtggaggggaacgtcctgatttgaagttagtgtcacatgggaggaaggtgacactgattgggaggccagtgtctgagattgaaggcctggtggctgccacaggattaagtccactgatagattgttcagttattactggcaatcctagacttatatccgcatttgtggagaggtggcacaatgagactagcaccttccaccttcatgtaggagagttgacgatcacattggatgatgtgtcgtccatcctacatttgtccaccactggcgccttgcacagtttccacgctctttctacggaggaggccagattcttgcttacggagttgttggaagtgtctgctgaggaggccagagccgagacagcactcacacgtggagcatatctcgcgcttatctgctgcactctttttgctaataagagtgcaacatacatgcatgtggtccaccttgacgcttttcgggacctcgctcatagtggtggttacgcttggggggttgccgcgctg

SEQ ID NO: 23276 - DNA, 117 bp, Glycine max
  Peptide Sequence Number=SeqID_114961
atgtggaccaccacgggggagaagcttgccacccagctcgcccaggcgagcaaggttgcttcccctagaagcaacagccttctggaggaatcttctggagggcccaagtgggcctag

SEQ ID NO: 23277 - DNA, 513 bp, Glycine max
  Peptide Sequence Number=SeqID_114962
atggacagaggcatgacactaactaatgctcctagatctagcatggcattctcaaatttactgttcccaataatgcaaggtaaacagaaagtacctgggtccttacatttctcaagaatgtgtagaatgaagcttgacaggttcaggtgcaagtgcaggtgctgctactggtggaggcacttgaatttgggagagccatctgccccatctgatttgttagactctgaatggaggctcttgtctcttgctgaaattgcatattctggatggtcatttgcctcgctaactcttataaggaaggttgaggaggagcctcagttgcttgttgtctttgttgtgactgctgttgtattggaggaggaacataaggcttgcttggaccaacaacattctggaaaggagggacaggctgttgttgttgatgcaagctccattggagcttgtaggcctaggatcttcttcatcaatggattcctttgcttcttggaagatgaatggcagcggaatggataa

SEQ ID NO: 23278 - DNA, 567 bp, Glycine max
  Peptide Sequence Number=SeqID_114963
atgccttatgtggaagccgcagaggagtcattagaaaccgctttccagtcttttcaggtggtatgcatttcctccgtggactccttctctgggcaagcttgcctgtccggtgcagcagtaatgatggcccgagttatgttggggaatggttacgaacccggaatgggtttaggcaaagacaagggcggcataactagcctgataaatgccaaaggaaatcgcgggaagtatggtttaggctataagcccactcaggcagatgtaaagagaagcatcgcgggaaggaagggcggtggtcaaagctcgctgttgagacaagaaagtgaaggaagtccgccttgccacataagtaaaagctttttaagcgcgggtctgggggacgaaggtcaagtggtcgcgatatacgaagatgatgttccaagctttggttacggttttaaaagctctatagttgtagctcattacaagccaaaaagtggaaaaccatcttgtcctaaactttacggaaaaggggccttggatttgttttggaagtgtgtttcaaacccttttgcttatgttcagtga

SEQ ID NO: 23279 - DNA, 282 bp, Glycine max
  Peptide Sequence Number=SeqID_114964
atggcacgcagcgtgtttgctccgtgcccctattttaggaacctacaagggagggagctaaaagggcttttagtgatatttcccaaggtggtcatatctgtcttgatggtctctagagtccccagtggagtcgccaactgtcgcaacctacccttcagcgggagggcaacgcgtgactcgcaggtgcgtcttccaagaaaggaaaatgcgcggagtcgccaccaacgtttatttgaggaaaacgtcggaaaaaccagaaaagacgtggtctacgaactttaa

SEQ ID NO: 23280 - DNA, 297 bp, Glycine max
  Peptide Sequence Number=SeqID_114965
atggatgaattcattgaactgatgaaagaacataattgggaaacgttggacttttttgaaccttggcctatcaaaagaatccttcatccttttcccccgaagcaaaggacagcggaatctcctcaagggagagcaaatagaatgctaaaacccgatttcccaagaaggaaaggaggaagtgaaagaaaggaagaaatgaaagaaagaagaaaagacaataaaaagaagaaaagaaggattcccgatcgaagatcgaaaggaagtgaaaatggaaaagatcggaggaaaacagagtaa

SEQ ID NO: 23281 - DNA, 591 bp, Glycine max
  Peptide Sequence Number=SeqID_114966
atgaaggaaggcataggtcatatcttagacctcactcccataggaaagaaaagggaagaaagactcaagaggataacattaacctcccatacttccatgggaaggacaattgaaagtgaagaagaaaaaggggaaaaatctagtgaagaaatctacccccaagaagaaggacaacctttaatggttaaggaggagtgtaaggaggtaagtgtctcctccaagaggttagctaagaaggaaagtcattttgaaataaagacaaacattaaagaaacttcccctcttagacaacctccacatcttttcctttgtaaagagacacttgttggcactaccacacctcttgggtttgagattattcctcaagtaaaagagttgttggatgagggtttggttcgtaagagcttaaatccttatgctttattggtgcccaaaataggtattatgaggcaccaaatccctatgataggtgttatgatgaatgtgttgagtggtgcaaccctcttttgtaaaatcacccatgcatccaacatcttcatgattcacatacatagggactcattaggtaggtgctcatatgggacaccttag

SEQ ID NO: 23282 - DNA, 385 bp, Glycine max
  Peptide Sequence Number=SeqID_114967
atggtagaggcctctggtaatcgattaccagcctgtgtaatcgattacacagagggatgggtcactgatcgtgattgcggcgtagctaatccgtggtcgagtagagatggagtgcctagagggagcatgggagaccctcgaaggcaacacgagcgcactgtggagtggatactacccacgcctacaccctatcgtctagtggagcccgtccaagtgatcaaggtaacgtcatccgaggaagaccctgaggaggatctggaggagctacctcctgagcctgctgtggatgcccttgacttcctagagggtgatgaggatccacttcttgaggtggattctcccgaggaagtcatgcctgcatctgaggcagactctacggaggata

SEQ ID NO: 23283 - DNA, 57 bp, Glycine max
  Peptide Sequence Number=SeqID_114968
atggaggaaaacgtggaggaagctttggctgcgcacgagctccgattacatcctctg

SEQ ID NO: 23284 - DNA, 306 bp, Glycine max
  Peptide Sequence Number=SeqID_114969
atggcagaatcattgaagaagcacaaaggatcttcctccaccactgttgttgttggccaccactgtcacggaccttctggagcacccacaacaccaattcctcctttcctttcatctcctcgatcatctaccttgttttctttagatggtcaacgccaaaggtactattcccaattttgcaatagagtcattttagaccctaagtacctagaccttgatttctttgatggtgaaacatttgattgctatcaaatgaaattacccaatcacggtgttccttttgagggcacccttgttgatgactga

SEQ ID NO: 23285 - DNA, 366 bp, Glycine max
  Peptide Sequence Number=SeqID_114970
atgatcccgatgttggatcaatttgtgccagttatagagggtttcattgaggacattgttgatgtgaaagtggatggtaactgtggatatcggtcagttgccgctttgttagaacttggcaaatggtctcaagactacaaaaaactctttggtggcacggagagatttgaacagttgaggttgtccctacatgtggatgggttatccaaggttagtgtggacaagtggatggatataacggatatgggatatgtcattgcttcaagatataatgtttatctcaaagatcattgtcccttaccgcctatggcattgttgttgtcaagcaattcatatcctcaggcaaaacagtggccaactgcatac

SEQ ID NO: 23286 - DNA, 600 bp, Glycine max
  Peptide Sequence Number=SeqID_114971
atggctacatgtcctcaccttcaaaaggctacacgccctcgccttcagaggactacgcgtcctctccttctgaggactacatgtcctcgccttcagaggactacaaatcctcaccttgaaaggactgcacatcatcgccttcagatggttacatgtcttcgccttcagaggactgcatggttgcacgccctcgccgtaagaggactacatgtcctcgcctttagagggttgcacgtcctcgctttcagagggctccacatctgcaccttcagaggacttaaggtaagtatgcttgtggctcaactgatttctgatgccatccactatttgcagggatcgcacccacaagacacccagtggacccggtggagcccaacagggccctggggtttccagctctggttacgggcctctatcaatcctacaggggatcacgcccgcaagacacccaatggacccggagaagtccaacagggtcttggggtttccaactctaattatgggcctttgtcagttctacggagtgcctgtcgcccccagcaaggtcatcaggcccttactaaccgagctttcatcaagaagtactgcgccccctgtcag

SEQ ID NO: 23287 - DNA, 884 bp, Glycine max
  Peptide Sequence Number=SeqID_114972
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgattgtttccgggtatcgccgatgcgctcgccgcattgctggacagcggatggacgctgggcgtggcgaccggcaaatcggatcgcgggctggcgctgctgctcgcccatcatggcctgggccgacacttcacgacgttgcagacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 23288 - DNA, 570 bp, Glycine max
  Peptide Sequence Number=SeqID_114973
atggcctgcaccaagaaaactgggcagatgacgtctgaggcagcaaaggaaatcgctgagaagattgtaaaacaccctggccgtgtgcgtgctgctggagtcggtgtcaccatcaagcaatacttcggatcggctccacaaagctcctgcagttcctcctccatgcctcctgaagaactcgagcagctgactcaacaaatcagggaccagctggaggagtcgatcatagaaaaaccagatgtagtcccagttgcaatcacagatccaatcacagagacttcactgcctccagagcctgaggttggtccctcagctgctcgtgttagcacaaaggggagttgtgttgatccctcgtcgaccgttctagagacgggtgactcaaacaaatgtgggttgtacatcgaagacaatccttcccgcctggttaccctaggaagagtttatgagggatccacagcggttcacaacatccctttgttgcatggccaagtcaaggtaggtgttgaggaggttaaagatgcagaggctcccgttcctatacccactcacgaggttattttagtgggacag

SEQ ID NO: 23289 - DNA, 399 bp, Glycine max
  Peptide Sequence Number=SeqID_114974
atgcggagacaaattatggtcattccgcacccctttgccattcagacacagtcgtgtccgatggcacgtagagacaaattatgttcattctgcaaccttttgtcatccagaggcggcgggcccgatgacatgcggagacaaattatggtcattccgcacccctttgccattcagacacagtcgtgtccgatggcacgcagagacaaattatggtcattctgcacccttttgtcatccagaggcggcgggcccgatgacatgcggagacaaattatgagacaaattatggtcattctgcacccttcgtcaatcgcggccgacaagcccgttgacacgcggagatttacatcatcttccgcacttgcaagatctgtcatactgacttttgagtcacgctga

SEQ ID NO: 23290 - DNA, 351 bp, Glycine max
  Peptide Sequence Number=SeqID_114975
atgagttcaagatgttcaagattgaatcaagaacatttcaaggttcaagaggaaattcgatttcaagaatcaagaatcaagattcaaggttcaagcttccaaaaatcaagatcaagattcaagactcaagattcaagaatcaagagaagaattaatcaagataaagggtacatctacttgggtttgactgagaacaagagagggtacatctcttatggatcagttctagtggagggtacatccactaggttgttcaaagagaacaagggagggtacatcccttgtagatctttgcttgtaaaggaattatacaaggttgaaaagaaatctcgaggactgcaggtcgcgtga

SEQ ID NO: 23291 - DNA, 207 bp, Glycine max
  Peptide Sequence Number=SeqID_114976
atgtcgtttcgagtttgctttacacgatctaactctcttgtcgaatccctgaccacaactgcaatccttctcaaggaggggagaaacctggagaaaagatacggttttcttcccccaagaggacatcctagaatctcctcaaattcttcaacagttggtactaattggaagtctccaaacgtgaagcatctcaaaggctggtcatag

SEQ ID NO: 23292 - DNA, 87 bp, Glycine max
  Peptide Sequence Number=SeqID_114977
atgtcgggaaatgttcgatcggcgtcatccggtgatgcttcttttttaaacctcgatcggtcatctttcctgaccgatgttggctag

SEQ ID NO: 23293 - DNA, 301 bp, Glycine max
  Peptide Sequence Number=SeqID_114978
atggcgcagcctaaaccaagtgctggccttaaggggaaacctcaccagcatgctctcactttcatgccttcttgcatttcaaaaaaacaaaggcttgggccccctaggccaaagatactaggctgcctcccagcagcgcttcccgcttgtccggagttggacatgggacgacgatccgtcgatcatgggcctagcctctactcgccgttttcaaatgcaataatctttttagcgaaagctggtcgggttcagtttcatttaagtgcttggggcatcccatggactgagcgaaaaggctcag

SEQ ID NO: 23294 - DNA, 495 bp, Glycine max
  Peptide Sequence Number=SeqID_114979
atgatgagcacgaggaagataatggaagccaatgcggttacaattgccgctaccagcactgttgctaaggtgaacccgatgcccccatctggcctcaaccaaatgaatcatccaaccttagatatggagacacatgaaattccccaccacaatctagccgacttcgagccttgcctcggatatgccactgaagggcaagcagttggtggtagacccctacaaaaccctttggagggccctcagtatcacccacaactacacctcttgcattccacgacaagtaaaaaccctcatgctatggcagaaatgggaaagttggatcatctagaggaaaggctcagggtcattgaaggaggtgaagattatgcctttgctaacctagaagagttgttcctagtacccaatatcatcacccctcccaagttcaaggtgctggactttgacaagtacaagaggactacttgccctgagaaccatataaagatgtattattag

SEQ ID NO: 23295 - DNA, 216 bp, Glycine max
  Peptide Sequence Number=SeqID_114980
atgtccttcgccttgagagggctacacgccctcaccttgaggactacacgtcctcgccttgagaggactacacttaccctcaccgttgagaggactacacgtccttgccttgagaggactacacgtcctcaccatcagagggctgcacgccctcacctccagaggactacatgtcctcaccttgagagggctacacgccctcaccttgggtactag

SEQ ID NO: 23296 - DNA, 498 bp, Glycine max
  Peptide Sequence Number=SeqID_114981
atggccattagattagttaggcataatgtgcatcttgattaccctgaacattttgtaccttttgagcatcctgagcattctattattggtgagtctgagcattctgtggttggtgattttgaacatcctgattttgagcattataattttgagcattctgattttgaacattctaaaaataaagctcaacctccccctcgtgagaggactctaagggaaatggctgcacctgatttcacttatgaagcttgtgaagaccctcataaacatctgaaagaattccatattgtctgctccaccatgaaacctccagatgtccaagaagatcacatctttctgaaggcctttcctcattctttagagggagtggcaaaggactggctatattaccttgctccaaggtccatcacgagctgggatgacctcaagagagtattcttagaaaatttttccctgcttccaggaccatggccatcagaaaggatatttcagcattag

SEQ ID NO: 23297 - DNA, 387 bp, Glycine max
  Peptide Sequence Number=SeqID_114982
atgaaggtttttaactgttgcggtttggtttgctcttccctcccctgcattctcgtgattgtgagggttcgcgctctttgtcaggttggtgctggtgagcatgttggtgctggagagcagagagatgctggtgagcagggggatgctgatgctggtgagcaaagagatggtggtgagcagagggatactgatgctgctggtgagcaaagagatggtagtgagcagagggatgttgatgctggtgagcagagagatgctggtggtgaagagagagatgttgctgatagtgaggaggaaaaggaagttgacagtgatgagtggtttataaatttctcttgtatgatgaatgaagttgaagctgaagttgagacagatggttatcattaa

SEQ ID NO: 23298 - DNA, 512 bp, Glycine max
  Peptide Sequence Number=SeqID_114983
ctgtctctctggcaaaaccacctccaaagcccgatccgaaggtcgatgatccgctttatctgatgacattgaccatcccagagcttttcttgaggccttatcaggttacatgggatgtcaccgtgttcggggtctttaatccggatttcccgctctacttaaagcacgaagacctctccgaaatcgcacacgatgcggggaattctgatatctatggattcctcgagccacagtccattcagaggtctgggcaatcgcagtttgagtctgaaagctacataaagagttggatgcagagttcaaaacgcgatgtctatcttggagcctacctgaatggcggacactggcagatggtggtcattatgcccaacgaacacctagttgtgtggttttgttcattgcataacaagccagacaactaccttaagaggataattaatagtgctttaaaaggtcttgatgatgctccacagcctaaatcaaaggctcctgctaggtggattgtcatcaag

SEQ ID NO: 23299 - DNA, 543 bp, Glycine max
  Peptide Sequence Number=SeqID_114984
atggaagaaactttgttggatgatatttggtgggacaaggttgattacatactttctttcactgctcctatttatgttcttagaaagatagatattgatatggttgttctacacttggtatatgaaatgtgggattcaatgattgaaaagagtagcacacctcttcattgcctagcacattctttaaacccaagatattacagtcatgaatggttaagtgaagatccatcaagagttccctcacatcaaggtgtggaacttactgatgaaaggaagaaatgctttagaagatactttgatgatgtggatgctttcatgatgttgactcctttaagggacaaaggtgaattggatacaaaatcttggtggcttgttcatgcaatcttcgcctcacttcaagaaattcctcaaacaagaatgtgggatattgcaagagataggttttcacttgatgagaatggaatccttgaaatagcccatttatctcttgatgaaccggttttagaagctgtctttttcaatgaaggtgaccaagggctttga

SEQ ID NO: 23300 - DNA, 1788 bp, Glycine max
  Peptide Sequence Number=SeqID_114985
atggaagatttgtaccatgtcagtttcactacagatgacaattctagttcatccaacgacattttgtggtgtactgaggaactgaatgaattgagaaaggtccaattttcgggagcagaagatcatggagagtatgggggaattgacccactttactctaattttgggttcttcccagatgatccatcagaacaagaagggtaccttctatccactgatcaacaaaagtatcaccagcaagtgcaaccatcataccatgattatggacaattggatgataaccttcagtttgacatggtatctccaccactccaatttgatgcacaatatccaaccatggttccactatgtcacacaacaaaggacaagccaaactcaaactcaaatacccctttagcctcacttgacatcttgaacaactatggcaagggcttcaagaggttacgcaatgaagacaaaaccctgaagcaagttgatgatgtggctatggccacaacaaatgagggtattatgagaaagctctcaacagaagatgtcatgaggatagctgggacaaggttcatccaatcatcatcatcagagtcggaatctttgcctttcttggaaactcacccttttggtatttacttctctggactctctaatgaggagaaagaggatgtggaacttgctgagtccctcttggcttgtgccgagaaagttggccaccaacagtttgaacgtgcaagcaaattgctgagtcgttgcgaatcattatcttgcaaaacggggagtccagttaggcgtattgttcattactttgcagaggcacttcgccagaggatagatagagcaacaggaagagtttcatacaaggatttgcaaaagggtccttcatttgatcctttagaggcaaccaaggtactaaaccccactgttgttgcattttatgaagagcttcccttttgtcaaatttctgtgttcacagaagttcaagttataatagaagatgttgctgaagcaaagaagattcatgttattgatcttgagatcagaaagggggtgcagtggactatcctaatgcaagcccttgagtcaagacatgaatgtccaattgagcttcttaagataaccgctgtagaaagtggaaccactagacacatagctgaggacactggtgagagactaaaggattatgctcaaggtttgaacatacccttctcttacaacattgttatggtatcggatatgttacatctaggagaagatgtttttgagattgatcctgaggaaacaattgttgtttattctcattttgcacttagaaccaagattcaagaatctggccagcttgaaatcatgatgagagtgattagaatcttgaatcctagtgtgatggtggtagctgaaattgaggcaaaccacaattctacatcttttgtaaaccgtttcattgaggctcttttcttctttagcacattctttgattgccttgagacttgtatgaaaggggatgaggggaatcgaatgattgtagaatccctatacttcagtcatggaataaggaatattgtggctgcagaaggagcagaaagagatagtaggagtgtgaagattgatgtgtggagggccttcttctcccgctttggaatggtggagaaagaattgagcaaattgtgtttatttcaagcggatttggtggctaaaagatttccttcttatagcacgtttgataagaatgggcattgccttcttattgggtggaaaggaacaccaatcaactctgtttctgtctggaaatttctttga

SEQ ID NO: 23301 - DNA, 351 bp, Glycine max
  Peptide Sequence Number=SeqID_114986
atggatgacactgaccaaccaattcatgagatagatgtgctatctgggcatgaaaatgatgtgaattatgtgcaattcagtggatgcgcagtagcatcccggttttccacagcagaaactctgaaggaggaaaatattcccaaatttaaaaattcctggttgaatcatgacaacatagttacttgctctcgtgatgggagtgctattatatggattcctaaatcacgcaggtcacatggaaaaagtggtcgctggacacgagcgtatcatctgagagttccacctccacctatgccaactacaactcaaagaggtggtcctcgtcagagaattctaccaactccacgcggt

SEQ ID NO: 23302 - DNA, 648 bp, Glycine max
  Peptide Sequence Number=SeqID_114987
gctgagaggtgtgtgactgtggtaattgtacatgacagctctagtgtgagtgcatacacagagggtgtgagggagctggcatgtgagattttggagctaatggcagagggtctgggggtcccggatacatggtttttcagcaggttgatcagggaggttgatagtgactcagtccttaggttcaatcactacccacctattatacttaacaacaaagattgcaaggacaaccacaaccacaccaaggtaattggctttggggagcattctgaccctcagattcttaccatcctcagatccaacgacgtgggtggcctccaaatctctcttcaagatggtgtgtggaacccagttgcccctgacccctcagctttctgtgttaatgtgggtgatctcttacaggttatgacaaatgggagatttgtgagcgtgagacacagggccatgaccaactcacacaagtctagaatgtcggttgcatattttggtggtccaccacttgatgcatgcattgttgctcccccagttatggttacacccgagaggccctctcttctcttcaagccatttacttgggctgaatacaagaaagtcacctattctatgaggcttggagaacaccgcattgaccttttcaggagcaactag

SEQ ID NO: 23303 - DNA, 528 bp, Glycine max
  Peptide Sequence Number=SeqID_114988
atggaggatggtcgtcgaaccgtcgtggttgctgaagtggattcgaccaaggtggttgcgatggtggttgaggaagacgtcaaaagagaatatcagatctgcggagttggaagaaagggaaaatataaccgtcaccgccgaaaatcaccttcggcgactgcgagcggtggcgatagatcacttaagggaagaacaatccgcaataacattctgtaccctaaggaagacagagaccagaaagttcttctcttcgcttgccgcaactgcgaccatcaggaggttgctgataacttctgtgtgtataggaatgagatacatcactctgttggagagcgcactcaggtgttgcaggatgtcgctgcagatccaacgcttcctcgaaccaagtctgttcgctgcagtcaatgcaatcatggtgaagctgtctttttccagggcatattgcatgccttcatgattttgtttcacattagatgggtattcccttcttccttgtgtacatggaacgatgtggaggtagtgccgtga

SEQ ID NO: 23304 - DNA, 724 bp, Glycine max
  Peptide Sequence Number=SeqID_114989
atgggaataaacatttccagtagcaacaattactctgagcggtttcctatagacggttcttctgtggttgtcttacgcaaaaccaagatccagaaatggcgtcaagttgtggacacttggagtgcggacaagcacgaagaacagatatccatctcaatccacgaccacccaacagatcatgcaaaggacaacttcgattttcagatgagcatcagagtcaaagaagatcttcttttgaataacttcaacctaaacggaccacgaagcacacagcaacttcccgagaggaaaacccctattgcccacggtggggtcctcatgtcctcgtccttcttgtacggaagtgacactgaccgaaagggtcttattgtctttttgagggcaaagagaaacgatgagagtggattgcttccgtatgtgatcgctgtcaagcactattttgtggctgcatgctgttctcatggtgtctctgttgtggcgaagattcgtcgcggcggccacggaggtttgagtgttgagctagagaaacctagtaaggagcacaaacatgacttgttgtccatgtttgatgatgtccaaggaaaagggtggtgccctgatcccagcagttctgattgtcccattgagataattcccagccaaaacaagaatcctgcaaatgctaatcctggccaccaaaaccctaccgttgccattggcaatggtggatactttgaaggcaatg

SEQ ID NO: 23305 - DNA, 228 bp, Glycine max
  Peptide Sequence Number=SeqID_114990
atggcggaagtgtgggcaattgtccatggtctgatacatgcccaaagtcatggatttactaagcttatggtggagacatactcacttgccacaattgagctgataaatggtgtttgcatgcgggacaatccttgttaccatctggtggaagaaattcagtggagattggaggacctggacctttttcagtgttgctcatgtaggcatagatgcaaatggagtagctaa

SEQ ID NO: 23306 - DNA, 492 bp, Glycine max
  Peptide Sequence Number=SeqID_114991
atgccagagaataacattctccattcccctcttaaaaaaacacaaaggttccagttccatccatcatgggaaacatccattcttccgtggttgccccacgcaaaaccaagatgggggaaagggcgtgaagttgtggacacttggagtaccgagtactactcatttggaaagaaaacctgtggcaataattacaaccacgaacaagagttaaccatcacaattcttttaggaaaaatcaatgtaaacggaccaagaactatgctgcgtcttccccagcgcaaaaaccctattccgcaaggtggtggggttctcatcaagtcctcctccttcttgtatggtcgtgacactgacgatcaaaatggtcttattgtcattttaagggcaaggagacgtgatgacgacaaagagcttcctatcatgatcactgtgaagcactatttttgttgccgcgtgttgctctcatggtgtctctgttgtggcaaagattcgtag

SEQ ID NO: 23307 - DNA, 267 bp, Glycine max
  Peptide Sequence Number=SeqID_114992
atggcaaagtcgaagaatcacacagcacacaatcagtcctacaaggcccacaaaaacggcatcaagaaacccaagaggcatcgccacacttccaccaaagggatggatcccaagtttctgaggaatcagaggtacgcgaggaagcacaacaagaagagtggtgaaacagccaccgaggaagaggatttgaatcctcaatctcgccctttccttgtcccttcaaccaccaagccaacctttctcttggttttttatatcttgacatag

SEQ ID NO: 23308 - DNA, 2073 bp, Glycine max
  Peptide Sequence Number=SeqID_114993
atggagtgtattgtttgtcttttagtgtcaaaaactacttttattattccggttggtagttcagctaagggacagagaataaaccaatataaagatttttcttttcagaataagaaaaaatatatctattttaccggaacagttctagcaattaggagacatgcattaaaagtggtgtctgatgaagcaagagcaatgtacaacggtggacaggctggtttgacgtattggagtcctaatgtgaacattttccgtgacccacggtggggccgtggccaagagactcccggcgaggacccgacattggccgcaaaatacgccgccagctatgtcaaaggactccaaggcgatggtgccggaaatcgcctcaaggttgctgcttgttgtaaacactacactgcctatgatcttgataattggaatggtgtggacaggtttcatttcaacgccaaggtgagtaaacaggatttggaggacacttatgatgtaccatttaaagcgtgcgtgttggaagggcaagtggcaagtgtgatgtgctcctacaatcaggtgaatggcaagcccacgtgtgctgaccctgatctccttcgcaacactattcgtggccaatggggcctcaatgggtatattgtttcggactgtgactcggttggagttttctttgacaatcaacactacacaagaacacctgaggaggcagctgctgaggccatcaaagctggcctggacttggattgtggcccattcttggctatccacactgattctgccattaggaagggactcatttcagaaaatgatcttaaccttgcattggccaaccttattacagtccaaatgagattgggtatgttcgacggtgaaccatcaacccaaccattcggaaacttgggcccaagagatgtttgcaccccagcccatcaacaattggcccttgaagcagctagagagagtatagtcttgctacaaaataaaggaaactccctaccactatccccttcaagacttcgtatcgtaggagtcattggacccaatacggatgctaccgttacaatgatcggaaactatgctggtgtggcatgtggttataccacccctttgcaaggaattgcgaggtatgtaaagacggctcatcaagtaggttgtaggggtgtcgcttgcaggggaaatgaactatttggtgccgcagagatcatagctaggcaagttgatgcgactgttctagtaatgggccttgaccaaaccatagaagcggaaacaagagatagggttgggcttctcttaccaggccttcaacaagaacttgtgactagggtggccagggccgctaagggccccgttatcttggtcatcatgtctggtggcccggttgatgtttcgtttgctaaaaataaccctaagattagtgccattttgtgggttggttatcctggccaagctgggggaactgccattgctgatgtgatctttggtgcaaccaacccaggaggaaggttacccatgacatggtacccacaagggtatttggctaaagtgccgatgacaaacatggacatgcgtccaaacccagcaacaggatacccaggaagaacctacagattctacaaaggaccagtggtgttcccatttggacatggactaagttactcaagattcagccaaagcttagcacttgctccaaaacaggtctcggtgcaaatactgagcctccaagccttgacaaactcaaccctctcaagcaaagcagtgaaggtgagccatgccaattgtgacgactcattggagacggaattccacgttgacgtgaaaaacgaaggctcaatggatgggacccacacccttctcatattctcgaaaccacccccgggaaaatggtcacaaattaaacagttggtgaccttccacaagacccatgttcctgctggctccaagcaacgacttaaggttaatgttcattcctgcaaacacttgtccgttgtggaccagtttggggttcgaagaatcccaaccggtgaacatgaactccacattggtgatctcaaacattcaattaatgtccaaactacgcattga

SEQ ID NO: 23309 - DNA, 2835 bp, Glycine max
  Peptide Sequence Number=SeqID_114994
atgggagttgaaaaagatgggacaaaaagtggaggaggttatgttggtggttttttccagttgtttgattggagctcaaaatctcgtaaaaaattatttgcagccaagtcagatttaccagagtctttaaaactaggaagaaaagtcgattacaatgtggttgatgaagatgaaattggagtaggggcaagtgttagaggaagttgtgatcatagttatgcttcatctgttacggatgatgacgcatatggaacaagggcccctagtgttgttgccaggcttatgggattagattccttgcctccttccagtttttctgatccttattctaccccatactttgatacccggtcccttcaagactctcattacttcaagaaaaaccttggtcaccagcatgaccatcataccccatattctggaaagctggttgaaaaggttgagggctcttctaggaacttcatggatccaaagccgcaaaaggtcattaccagaccaattgaaaagttccaaacagaagtattgcctccaaaatcagcgaaatcaattcctgttacacaccataaactcttgtcccctattaagaatcctggctttgttccaaccaataatgctgcttatataatggaggctgcagcaagaattattgagcctggatcccaaactagtaccaagtccaagacacctctggcagcaccatcaacaccattgagagttagagatcttaaagataaggtggaggcttcacaaaaaggacctctaattgggccatcttccatgacctctagaactcgagatctaaaagagaaaagggaaatttctcatagaacaaccaggagctcagaatcttctcaaagatcagttgagtcaaatgctgccaagtatctaaaggggcagtctttgaacagaagctggaatggatctgcggatacatctgtatccgtcaaatctcctacaaacgaggaagaagattcttcttttaagaataagggaaagtccatctcacttgcaatccaagcaaaagtgaatgttcaaagaagggaaggtttgagtttgattggtggcagaagtatgacaggccagaaagagcatcctgatgttaaatccaaccaaccaatgaaggcaactgttcagaaaaatttacataagaaatcttctgttcagaattcttctggtgctctcagacagaataatctgaaacagaattattcaattgacagagacaaattaccatcaaagccattggttaccaattcacacaataggaaagttccgactggggattcctcttatggacgccatagaagctctagtaataaatccaatgcaaaatctaaagttgggtccagaaagtcagccatggaggtgacagatagtgaaaaggaagtcttatataccagcacaaacagttttcctagaaagaaaaggtctacagacaaggactggaatgatagggttgtggataatttgttcattgaaaaaacgcagaagcctgctaagtctaacccagtgagtaataaacaaagtagttggactgaagaagtcaaaaagaaagacatggatgtagtttccttcacatttaccacaccattaacaaggaacaatccaggttttgagacatctggacaagctggccagaatactaatggtctttcattggatcaatgcattaaaagagtgttacttgacccagacaatacaaagtctccaataggatacaatataattggtggtggtgatgccttaggtatccttttggaacagaagttgagtgaattgactaatatggaaatcacttgtcatgactcttctaaagtgaggcaacctgccatcactgcgccaatgtcagatgatcaagtagccagacataatatagttaatctcaatccaaggttgcgacagaaaaaagaccaaggtgtgttattttcagacaagttaagcagtaactatgattcagacatctccttcactggtcctcctgaattgtcattgacgcgtaactcatggattgatgagatggaatcacagttactcaattgccgacacccaagtccaatctctgttctcgagccttctttttcaattgaaagctgtgaatcttcattgagcacagatattactagtacagaaggagtcctaatacttaatctactttcaggaagcaagttaagctcatctgttcaagctcacgaagttcatggcttgagtttttcacggaagttctatccttgtgaatctgataccgagttatctgactcagcttcttcaacattagctgggaacatgatgagaaagcacacaagtacaacattttctgtcacaaggtttggaaggtcaagcacatgggagttgaactatgtgaaggatatattgtgtaatgttgagttgatgtatgtagacttttcccttggccaagcaagtgaggttatagactctcatctattcaaacagttggaaggctgcaagggagggtttaagcgcgatgacgagtctaggatgagaaggaaagttacatttgattgtgtgagtgaatgtctgggcttgagatgcaggcgttacgtagggggaggatacaaaatgtggaccaaagggtttgaaatggtgaaaagaaaagaatggttggcagaagatgtgtacaaggagatatcaggttggagtggaatgggagattcaatggtagatgagcttgtggacaaggacatgagcagccaatatggaagatggctagattatgaggttgatgcttctgaactcggatcagaggttgtggaccaaatatttaattctttggttgatgatgttgtcactgaaatgttgcaattgtatacaccttaa

SEQ ID NO: 23310 - DNA, 1953 bp, Glycine max
  Peptide Sequence Number=SeqID_114995
atggccttgcatgtccacagcttcttctatttttggttcgtcgtcatgatcttcgtcgtcgtatttttcacggcaccgtcggtgtctcagccgcaagccaccgggtcctgcaacgggatactcctgtcgtacgcgtataccggcggcttgcagctgcctccgaatgtctcggacccggcggagcagccgtaccggttctcctcgacattgacggtgctgaacaacgggctggaggagctgaggtcgtggagggtgttcgtggggtttcagcacggcgagtggctggtgtccgcctcgaacgcggtgctcgccgacggcacgagcctccccggttcggtggaaaacggcaccgttttgagtggtgaaaccgtgagggatctgaagactgcggtggcgaccgccggggacttgaatcagatgcaggtgagggtagacatggtggggaccttgcttggagtggcgccaccctctgtgccaatgccttcttctgttaccttggctaacgatggattcttgtgtggtcaaccctctggtcaagggagcaatgaaactcatgtgtgttgcacaagcgaccccaatttcaaaacaaacataaccacagaagaagagttcctacccaggcaaaagggtgaccttagcatcacatacgacatcatcagaacctatgactccgattactgggcagaggtcacaattgcaaaccacaaccccttaggtcgtcttgataactggagactaagctgggactggaacaacaacgagttcatccacacaatcaaaggtgcatatcccttaaacgtggattcctctgactgtgtcttcggtccacaaggcctgttctacaaggaactcgacttctccaacgtgttaaactgcgaaagaagaccaaccatagttgatcttcctcccacaatgttcaacaacacagacttcggtaaaatcccgttttgttgtaggaatggtactatcttgccaccgacaatggaccctagtttgtcatcttcaaggttccaaattcaggttttcaaaatgccaccgaaccttaaccgttccaagctttcaccacctcataattgggagataaagggtacccttaaccctgattatgcatgtgggaaccctattagggttagtcctagtgaatctcctgatccaacacacccaccatcgaacaaatccgcgattgcaagctggcaagtggtttgtaacatcacaaacacaaaacgagaagcacgtaaatgctgtgtttctttctcagcttattacaatgaatcggttgttccatgcaacacgtgtgcatgtggatgtagtaaccctgagagaacgtgtagtgcaacctcacaagcaatgttgcttccaccagaggcacttcttgtacctttccagaacagaaccgagaaggcacgtgcttgggctgagatacaacacttgaatgtccctaacccttttccttgtggtgataactgtggtgtgagcataaactggcacttggtgacggatcaccggagcggttggagtgcaaggatcacactcttcaactggggtgaagccagttttgctgattggttcgccgcggtgcgaatggagaaggctgcaaaggggtttgaggaggtgtattcttttaatggaagccttttggatggtgtggatggcacgatattcatgcaagggaagaaagggttgaactttcttgtggcggagacggatggatctaaccctcggagagatcccagggtgcccgggaaacagcaatcggtgatctcttttacaaagaagaatactcctggaatcgatgtggttggtggtgatggttttcctagtaaggttttcttcaatggggaggaatgttctcttccttcagtggttccaagcagtggtactagaatggaggtttcattggctactatgatgttcttggttctgtttttgtggattctcttcatgcggcaatag

SEQ ID NO: 23311 - DNA, 3273 bp, Glycine max
  Peptide Sequence Number=SeqID_114996
atggcgacggagcagttaatgtcctccgccggcggcggcagctctcgctacgtccaaatgaaatcgtctccgccgccgtcgccgccggccgcggcggccgaggagatttcctcggtcccgtcgttccggcacagcggcgccgaggccaatcggattttcgaggaattgcccaaagccgccatcgtctccgtctctcggcccgacgccagcgacatcagccctatgcaactctcttacacaattcaggttcagtacaaacagtttccccgaacaaaagtttctgcttttgcgaatttgcttttggccttcaccagctttttagttgttagagttgaaagtgtgtccttccttcctacaggagggtacttatatgtctcctttgcattccagttcaagtgggagctaacaaagaaagcccatcaagtatttattttgcatttcgcgctaaagaaacgtgcttttattgaggaaatccacgagaaacaagagcaggttaaagaatggcttcaaaatctaggaattggagaacacactgctatggcgcaagatgacgacgaaggtgatgatgagactgtcccgttgcatactgaagaaactcatgaaagtgccaaggacagagatgttccatctagtgctgctctgccaattatacggccagccttgggaagacagcattctattgcagacagggcaaagagagcaatgcaaggatatctgaatcactttttgggaaatatcagtattgtgaactctcgtgaggtttgcaagttcttggaggtatcgaagttatctttttcacctgaatatggtcctaagctgaaggaagaatacgtgatggtgaagcatctacccaaaatccagaaggatgatgattccaggaagtgttgtttgtctgactgttttagttgctgtaatgacaactggcaaaaggtatgggctgtactgaaacctggattcttggcattgctggcagatcctttcgatacacagcctctagacatcattgtttttgatgtactgcctgcctcagatgggaatggggatggtcgactatcgctggcgagtgaaatgaaggaacgaaatcctttacgtcattcattcaaggtgacttgtggaatccggagcatcagaattagagtgaaaagtagtagtaaagttaaagattgggttgctgcaattaacgatgctggactcaggcctcctgaaggctggtgtcatcctcaccgttatggttcatttgctcctccaagaggcctagttgaagacggaagtcaagcccagtggttcattgatgggcgagcagcatttgaggccattgctttttcaattgaggctgcaaaatcagagatatttatctgtgggtggtggctgtgcccagaactgtatctacggcgacctttccacactcatgcttcgtcaaggcttgataatttgctggaagcaaaagctaagcaaggggttcagtacagtccttacaataatcaagtagttacaaagatttacattcttctctacaaagaggtggctcttgctttgaaaatcaacagtgtttatagcaagaaaaagcttcttagcattcatgagaatgtgagggtattacgctatcctgaccacttttctactggtgtttacctgtggtcgcatcatgaaaaactagtcattattgataaccatatttgctttattggaggacttgatttgtgctttggtcgttatgacacatctgagcataaagtgggagatttccctcctctaacctggcctggaaaagactattataacccaagagaatctgaaccaaattcatgggaagatacaatgaaagatgaattagaacgtgaaaaatatcctcgtatgccttggcatgatgttcattgtgccctttggggaccaccttgccgtgacattgctaggcactttgttcagcgatggaattatgccaagaggaacaaagctccatatgagcaagcaattccattacttatgcctcagcatcatatggttattccacattacttgggaagaagcagagagatacagattgaaagtaggaacactgacaatcatagagttctcaagagagaagattcattttcctcatcttcccaagaccaagatattcctctacttttgcctcaggagcctgatgggttggatactcatgaaggagaccaaaaattgaatggggtaatctccttttcacatcaccttgacaagccaagaaggatcagcagtggtcttccgttctcgttccggaaggccaaaattgtagcagttggtccagatacaccaatgaagggctttgtagatgatctagattctgagcatggtcttgagaaaatgtctctggatagagtggctcattttgatttacaaagtacaaagccacaatggtgggaaacgcaagaacggggtgaccaaggaggttttgctgaagaatcaggacaagttggtcctcttgcttcctgccgttgccaagttattaggagtgtgagtcaatggtctgctggaacaagtcaaaccgaagagagcatccacaatgcttattgctctcttattgagaaagctgaatacttcatctacattgagaatcaattttttatctcaggtctttctggagatgagatgatacggaatcgtgtgttagaagctttatatcgacggattatgcgagcttacaatgacaaaaaatctttcagggttatagttgtcatacctctcctgcctggcttccagggcggtcttgatgatagtggtgcagcatctgtgagagccataatgcattggcagtatcgaaccatttgccgagggcagaattctatcatgcataatctttatgaacttcttggttctaaaatacatgactacatctctttttatggcctaaggtcttatggtagactctctaatggtggccctgtggcaaccagccaggtgtatgttcacagtaaaatcatgattgttgatgattgtattactttgattggatctgctaatattaatgataggagcttacttggctccagagattctgagattggtatagttttagaagacagagagtttattggttcttatatggatggaaagccttggaaagcaggaaagttttccttgaccctccgattgtcattatggtctgaacacttgggtctccctataggagaggtcaatcaaataatggacccagtcgttgaatctacttacagggatatttggatggcaacagcaaaggcttcttttcttttcatttttgttattttggccaagtaa

SEQ ID NO: 23312 - DNA, 366 bp, Glycine max
  Peptide Sequence Number=SeqID_114997
atgaagagtatactaccattaagcttgagtatagcaattgtttacatagttagttctgaaattggcatagcatttgcgagggattcaaccgctttagctccagaacctctagctgattctcctgccccagatgaaattcctcctgctgattcagctgaaccacctacactagataataacccttcttatgatggctcagctgaatacattgagttatattcaacgctattagaatattttgatgtgactcgtaatggagcagtggctgatgggaggacagattctagctctccagaagcaagtaaccagcatgttctacggtatggtatcagtatcactagtgatttaaggacaaagcttatctaa

SEQ ID NO: 23313 - DNA, 237 bp, Glycine max
  Peptide Sequence Number=SeqID_114998
atggcacgagcagtggctggtggcagcgtgactggaggtgccaacgatgttcgcgactacgaaacgtcaacgacaagtcccaacaccgctacctccactcagtttttcgtgctctatgcaatggagcgagtggaatcgcattttggggtaaggagtgaggaagtcatagtgatagatccacaaggaatgtatagaagaaactatagtgggttgtgtgaaaacgcagagggatgttga

SEQ ID NO: 23314 - DNA, 312 bp, Glycine max
  Peptide Sequence Number=SeqID_114999
atggcatcatctcaagcagacctcagaaagattgctgtagaaagcttcgatttgatagacaagctctacggtcgaaggggccccgccagcaatgatgcattccccagccaacgacaatgcttttgggtggttcatcaagtgcctaatggtgacatggatcaaaagcctggtctgaaaaacaaacatgttgttaactatggaatacctgttgcaaaccagtaccctaggggaaaagctcagaatcgctggggtcatataggtaggttatttactgagtctagcaatgatggaatcaagactctaagtcaatga

SEQ ID NO: 23315 - DNA, 135 bp, Glycine max
  Peptide Sequence Number=SeqID_115000
atgatttgtgggggttgtggtcctcatgctcggtggcttctgtggcctccacgtgctttatctcttccctctctcacatgcttgcgtgatatttttgaagaagcactctatatggtcctagtagcagttgaatga

SEQ ID NO: 23316 - DNA, 660 bp, Glycine max
  Peptide Sequence Number=SeqID_115001
atgtcttcctcttcctttctctctcacacactctttcctttttgttctgtctctcttttccaatgcttcacccagtttttgccatttccaataccatgcccacttccggatatattcgacagagcttccagtttgagggagagagtgcaagacaccctctctaggtaccgcaacgagttcatctctcttctctccaggtatgttgctgggggcaaaggaatactacaaccacatgaccttctagatgaggtagaaaagcttcttgaagaggatgaagatatgcagaaactcaaagatagcccttttgtcaaagagttagaatctgcaaaggagtatgttcgtgttaatgcatttgaattcagtgtggataatctgagtgttgcagaatatgactcaaagaagaacttcccaccaaaccagtctcagaaaaacgacgatctcgaaccctttcaccgttggatcgtcgtgaaatttgagtatcatgttcgaaacacaattccgagcattctcaccgttgggaatttcgatatcatggagaaaaaggaatcgcatgaagacagtatgagtggaggtttcaatctcttctccgtctctctgacgtttgagaattctatcggagcagtcggaggaataactgaaagaatttcagggaaccgctag

SEQ ID NO: 23317 - DNA, 1838 bp, Glycine max
  Peptide Sequence Number=SeqID_115002
atgggtggacataacaatgaccatgaacaacaacgaagctttgccatttttatcatctcttcaatccttcttgtggctacgatgcctgttgcaatggcttttggtttaaaccctaaccctgttggattaaatactaaccctaaccctaaccctaaccctggaggtgaaactaatggagaaacagggcatcaatcgaatgtcttgagcactcatagtagtggaatcacaatttgccaaggaacagaatacgaagaaaagtgcaagcaaagccttggaaattcactttttgtaaacacagacccgaagaagctcatcgaaactcagttcaaagtcgcaattggggaacttgtagacaacataataaacaactccaccctttataaacagattgtcacagatgagaggacaagactagctatggatgattgtaaggaaattttgggctatgcagttgatgctattatgaaatccacaagtctattgattcagtttgattttagcaagttgatggaaattgtttatgacctcaaggtatggctcacggggagtatttctcaccaatatacttgcttggaaggtcttaagaatatagaagaaaaagctagtcagaaaatggctatggctatgagttcctctttggagcttagtagcaatgcattggatatgacagatacaatctctagaatgctcaacggctttcggccaaaaattttcaataggagacttctctctgaggaagcaacagttgtggatggtttcctttcatgggtgaatgaaggacaaagacgttttctccaggttgcacttggaagtgttaagcctaatgcagttgtggcccaagatgggtctggtcaatttaaaacactcactgaagctcttaagactgttcccgctaacaatgataaaccttttgtgattcaagtcaaggccggtgtgtataaggaaattgtaaaagtgaccaataccatgacccatgtcacaattattggagaaggtgctacaaagactaaattcactggcagtttaaactttgttgatggttccacaactttagagagtgctacctttgctgttaatggtgccaacttcatggccaaggatattggatttgaaaacacagcagggtcttcgaaacaacaagcagtggcacttttagtaacagcagaccaagctgtgttctacaattgtcaaatggacgggttccaagacactctttttgcccaatctcaacgccaattctaccgtgattgcaccatcagtggcaccattgactttatctttggggatgcctttgcagttttccaaaactgccaactaattgtgagaaaccccttaaagggtgcacgatgcatggtgacagctggtggcagagtcaaagctaatagtgctagtgcccttgtgtttcaaagctgccacttcactggagaacccgaattggcttctgcagaacctaagctagcattccttggaaggccatggatgccatactctaaggtggtgatcatggactctcaaattgaaaatatctttttacctgaagggtacgaggcatggacagcaaatgcaaacaaggacacatgcacatattatgagtataacaacaagggccctggtgctgacacctcaaaaagagttaaatggcaaggtgttaaggtcataacctctactgaagcaaataattattatcctgggaagttctatgaacttgctaattcaacttcacgtgatgcatggattactgatgctgggataccctactctcttggccctatgagtggcacagttcctgcagggttggcccaaagttctactacaggatcggcccagagtcctacagg

SEQ ID NO: 23318 - DNA, 1773 bp, Glycine max
  Peptide Sequence Number=SeqID_115003
atgcaacttcatggttgtgctagggcatgccctgaacatagaaatcaggatcatatagatggggcatcagtccaacctgaagaaagtggtccccgtgcagttaccgatgaagaaaatgatcaattctggggcttggatgacatcccagttgaagaaaagaattccttggatgctacaacaggcaaagtgaatttagatcactttattaaacctcctgcaaatctagttgttcttgaaggtgactgcttggatgctggtggtgatggaggggaattggagtcttttctgttgtccaccacagacctgtaccaggactttattttattggacacatctgatgctattgcagttcatgagtttttgaagagcagcaaagctgccacaactcaaaatgatgctaatagaggaacctcagctcgtaaaagctttctttctccaggacatactggtggaagtgctcgtagattatcagctgctaagagtcagggtgctaataactgctcccctaaacttaattgtggctttaatgatgaaaatgtccggtccagttctcctgcttctgctggtcttgatgacttcaattatggatttgatatggatcatggatgtgatgcatctagggattcagacaattcagacgaagataatgatgatccatggaaacctttaaatcctcatgaaccaggcaacttaagggtgaagccattcagaaaagtgaacactttaaaaaagaatagcatcaatgtcagactaccagtttctatgaacaccttgtttccgcttgcaaaattgcgtggtcctatcagtccagagctcatggaaatgtgggagatgcggcatcttgtccatgaacgacaaagggattctcaagctccattatatgagaagctgaggcaatctcttgttaatgaggggaatgaaactggtggaacattttttaactctgaagctgacaatgatgacaatgaatatgatggtggaaatcctgattttgatatgccggacaatgcttacatggaagaagatctaccatctttcagtaatgagcatgaatttgatgatgctcatgtcaaccctgatgaagctgtggatctttctcagactagtttggaagatctttgccgctctcacctgaatgctctcttagcaagcattgctgaaactgagaagcaaactgaaatggctacaagggtttcagcgtggaaacaaaaaattgaggacaacttggaagaacaggacttgcatccaccatttgatatccaagactatggtgagaggattcttgacaagttctccctgctttcccttgaagcaagcagtagtggtgtcctatccttttctgatttagtgaagggtcaaaacaagtatgatgtggctcgaagtttttcttcccttcttcaactggtaaacaatggagatgtagctctagagagaaatggagttgatgggtctgtctgctactcatccgttaatccctttcatgttaagctccttaagcaaaagagtaaggaacgggagggtgtgcagcttcgtttgccaaaaaagagagcaaagtctccaacaaaaaatccctccacacaaggtgacaagaacaaaactgtaagaaaaaagtctccctcgtcttctagacatggatcaaccggggtgtcaccaccaacaaattgtaagttttctgtaaagcttggaaaggtgagtggcatgaagtcccccgaagccaaaagaaggcgtagatctcagtatgttgaaccagttaatttacattcaacagggtga

SEQ ID NO: 23319 - DNA, 162 bp, Glycine max
  Peptide Sequence Number=SeqID_115004
atggtgggtttgagtgtagtgttggaagcacagaaaggtagcgttagcaagaagactccacaacactctccttttcaggaagcagcagcaaagtttctagaccaatgctttctctgcaggaagagactcttgccagggaaagacatctacatgtacaagtga

SEQ ID NO: 23320 - DNA, 183 bp, Glycine max
  Peptide Sequence Number=SeqID_115005
atgaaagagggaagaaaaaggtgcaacgaaggcttccacgagttcacgactgaaacaaacagtgaagaaggaacggtgaaaggaacggtgaagaagcgaagaagtgaagagggtggaaacagggtgaaaggaacggtgaagaagcgaagaagtgaagagggtggagacatggtaaaacggtga

SEQ ID NO: 23321 - DNA, 1051 bp, Glycine max
  Peptide Sequence Number=SeqID_115006
atgagtgaagacgcgaaaaagaacattgccggagctctaacggcgaggcccaactccgatgaccagaaaccatcgccgttaccgtcaccggcgccagccgtcccgccgaagaaggtcatcatcaagagcgccgacatgatccccgacatgcagaaggaggccgttgatatcgccgtcgccgcgtttgagaagtacaatgtggagaaagacgttgcggagcagataaagaaggagttcgataagaggcatggacccacttggcattgcatcgttgaaaagggggctggaagcatccccggggaagggattccagggggagccatggtaagaactaagaatggagggaacaatgaagagcctttgtcagaactcaagcaaccagtggaggattatagagagatgtctcccacaaagggtagaggggaggaattaactattggagataggagaagatgggcttatgtgaagagggtttggcccgtcaacaatagaaacacattgggaaacaagtggataaggtccaatgacccgaaagaaatgaacggggctagatcatgcgggctgggttgtggatcagtgagtcaaacagagggatcagggagtagaggattgggggaccatgtaattgcacatgagtgcttgactaggatgacctctaagaagtctttgaagggtataaaacctgaggtgattaaggaatatactgttgaagaaggtgatggccaccgaattcaaaataaagggttttgtagaaatgttgagttgaagctgccaactatgaatattgtgcttgagttttatttgtttgaacttggagggggtggatgtgaggtagaaataaagggggatccatcattatctagaactgtggcatctttgaaggcaatgttaaaggagctgaaaagaggaaatgaggcatactatgtggagttaggaatgctaacactttatgacttggatttgcaaagaacagtggaaggactggagggagtgttggaggaatatgcagagctttttcaagaagccattgaactacctcctactagaagat

SEQ ID NO: 23322 - DNA, 546 bp, Glycine max
  Peptide Sequence Number=SeqID_115007
atggcagaagcgagtttctttgttggagtcataggtaacatcatctcaattctcatgtttctttctcctgtacctacgttttggaaaataaagaagcacggatccaccgaagatttctcaagccttccttatatttgcacattgcttaattgctccctctggacttactatggaatcataaaagctggagagtaccttgtggccactgttaatggctttggcattctcatggagacaatctacattattctatttctcatatatgcaccaaaagggataaggggtaggactgctattttggctttgattttggatgtggtaatcttgacggcaataataattattactcaattagcattagaaggagagactcgtagtggtgctgttggtgttatgggagcaggcttaaatattgttatgtattcctcacctctgtcggtcatgtgtcccacaggggcctacggtttttctaaagtatttttctcctttcatgatgacacccacaccaataatagggttgtggaatcagatccagcacgtgcgtaa

SEQ ID NO: 23323 - DNA, 1542 bp, Glycine max
  Peptide Sequence Number=SeqID_115008
atggaggtggagcccgtggagccgcagtcgctgaagaagctaagcttcaagtctctgaagcgcgctctcgatctcttctctcccatccacggacacctcgctactcccgatgccgaaagcaagaaaatacgcactagccacaaggtgagcgtggagtatggtggaatcaaaagcactgccaatcaacctcctcctcgtcaagttagttctgccacccaggatccagggtcctctaacactctggctcttccagcttcttgcggcattgccattgtctttattacatcggtgcatatgctgaccttaagtctcgggagttggggaaactcctttgtccgtaagaagatttgtagaggacaaggtcccggagattccaaggattctcagaaaggaggaccccaaaatgccttggttgttggtccaactatcccatccacaacaccgaatgatactggttttcagaacaaaagtacagcggttgtttcagcctctggttcatctgaaagaaatttatcaacatctgctttgatggaaagaatgccaagtaaatggccacgtcctgtatggcacgcaccatggaagaactacagggtcatcagcggtcacttgggatgggtgagatctgttgcagttgatcccagtaacacatggttttgtactggttctgcagatcgaactatcaagatatgggacttggcaagtggagtattgaagctcacattaacaggccacattgaacaagttagaggtcttgctgttagcaacagacatacttacatgttctctgctggtgacgataaacaagttaaatgttgggatcttgaacagaataaggttattaggtcttatcatggtcatctgagtggtgtttattgcttggctcttcatcccacaattgacgttttactaaccggaggacgtgattctgtctgccgggtttgggatatacgaagtaaaatgcagattcatgctctttcaggtcatgataacactgtctgttctgtgtttacgcggccaacggatccccaagttgttacaggttctcatgacactaccatcaagatgtgggaccttagatatggtaaaacaatgtcaactcttacaaaccataaaaaatctgttcgagcaatggcccagcatcccaaagagcaagcttttgcatctgcttcagctgacaatattaaaaagttcacccttccaaaaggagaattttgccacaatatgctctctcaacagaaaactatcatcaatgcaatggctgtcaatgaggagggtgtgatggttactggaggcgacaatggcagcatgtggttctgggattggaagagtggtcacaatttccagcaatcccaaacaattgtccagcctggttcattggacagtgaagctggtatttatgcttgtacctatgatcttactggttcgaggctcataacctgcgaagctgacaagacgataaaaatgtggaaagaagatgagagtgccactccagaaacccatccccttaacttcaggcctcctaaagacatccgtcgattctag

SEQ ID NO: 23324 - DNA, 114 bp, Glycine max
  Peptide Sequence Number=SeqID_115009
atggagtgtgtgggtagctggaaactcagaaatggaatcttgttcaatcaaaaggagaaagatgaagaagatgtactggagatgataaagacaatggtcacggttaatgggtaa

SEQ ID NO: 23325 - DNA, 3792 bp, Glycine max
  Peptide Sequence Number=SeqID_115010
atggaggaaacggtgtctcgcgtaatctccgagctagaggatctccgtggaaaccctcaaccaccaccactctccgaacaaaccctaacgaatcttctatttctcctcaaacactctctttcagagtctctctacgatgagctttcatcgaagaatctctctccgtcttctctcattcctcccattgcttccgcaatggactcttcccctccgcaccactctcttctcgcttccgatgtcttcctctcgcttctcctcgctccgaacgcacccgtttttacactctttacaccaatgtcgtttctttccttcctccgctccctccgccgctcctgcaaggcccactcccaccctggcccggcccaagacaactcgcagaatggcaaacgaaagcgcccgggtcgcggtcgcgcgaaaaatccccaaaacgaggacgattcgcccgacactagttcccaacacgaccccagggtgctcctccgcgtgctggagaagctagtcgaagtgatgggtttaatccacctcaaccgcttccccgagactctgaagtcgctgatccaaaccgtggctgaaatccccgtgacctcgctcaacacgtgcgggaacgcggcggtgtatagcagactgcttagcctctgctcgcacgtgctgaaggaagttctcaaatccgagcacggtgaaccttccaacactgctgcggaggttttgaaatcgctgtgttcgcttgttctcatggcgaagtcgcaggcgaggacttttgcgctcggatttgtcacgagtcttggtaatcaatgtgatgatgtgaaaaaggcgctggttaattttccgaggtatttggcgaagaaggcgccggagaaggccgagccgagagcattggctgtggagtccatcatggaggttgttaaagtgatgggttttgatgatcaaattgcgtttgtgaagtatgttgtgcagatggctcaggggaagtccagtcttcggcttttggcggttgatctcattttgaatctggtgatgtcgttgaaggatccgttgggcgtggagagtgaagagagtgaggtgtgggggatttggtgcttggaggtgctgttgaaaaggtgttctgatgtgagtggcgcgattcgggcgagggctttgtcgaatttggcccagctggtggggtttttgtctcgcggtgagaggactagtgtggttctgaaggagtttatggggtttggaaaggttggtgatgggaatgttgaaggtggaatgaatgacatgctgaggagaaggtgtatggatgataaggcagctgtgaggaaagctgcattgcttttggttactaacttgacttctcttcttggaggcgccattgatgaagtggtgctcaagacaatggggatggcttgttcggatccacttatcagtatgcggaaagcggcaattacagctctatcggaggctttcagaacattctctgctgaaacagtaataactgagtggctacattcagttccgcgtttaatatctgacaatgaatcaagcatccaagaagaatgtgagaacatgtttaaagaacttgttttggaccggataattagagctgcaactgctacctcttcatatagcgagcctttgtctaatagaaagatgaaaggaaaaggtttagacaatgagatggagatgttttttcccaatggaactctgtatcttctgagagagatttgccatggggaggtgtcaacattcctttcaaaagtagtagactgggagtttcttcatcatcattggcaacttcttgacaaacatgaagtggaaggtgagttcaaaagcccatttgtacaaagaaatgcatctgaagaggaagaaagcatagaatgcaatcatgttgcctgggctagtgaccgagttttcctcttacaaacaatttctaatgtttctgtggagctgccccctgtacccgcagctgatttggctcataacttgctcaaacgggttgaacaattcaacatgcattcaacagaggttgatgctcatttaaaagcactaaaaacattatgcaagaggaaagcttcaaatctcgaagaggcagaagcattagtcttgaaatgggtccaccaagttctctccagggcttctggaataatagaaaaattcatttcagagaattcagaacaaaacgcagaaggtagcttcttcactccacctagaagtgggactagcaaaggcaggaaatcagtagcaaagtccaagtcattgtctaaagcagtaacagcgatttatacagttgggtcggtagttattgtttgcccatctgctgatatgagcaatttagttcctctgttgcatacaatcatcacttctgggagttctggtcctaaattaaataacctacccagcccttcaacttctttgcaacaggaagctccctctttttatattcaagggtggctagctatgggcaagctttgccttgctgatgggaagctagctaagaattatattcctctgtttgtacaggagcttgaaaagagcaaatctgcagctcttcgcaacaacattgtggtcatgatggcagacttttgtgtccggttcactgctcttgttgattgggactatgtgaaatggagaggagtgctatttcttcggttccttttgtcacttgttgatgaatcagaaaagataaggcagttagcggattttctctttggaaatattttgaaagtcaagtctcctcttttagcatacaatagttttgttgaggctgtttttgttctgaacgactgtcatgtccataatgggcatcgtgagtctcaaggatcacgaaaggaaagccaaatcttttccatcaggggtactgatgaagagtcaaggtctaaaagaatgcacatttatgtttctttactaaaacaaatggcccctgagcatcttctagcaacctttgccaagttatgtgcagaaattctagccgcagcttctgatggtatgctcaatatagaagatgcaactggacagtctgttctacagatcgaacggctggtcggagtgggatccaataactcaaccggtttggctcaggcatcggaaacccggtgtgacctgggcaagtttatggatgcttttcaaattctcggctgtaaagagatacgcatttcatccactcgtgcatcatccgagtcagcagatgtagaggaggaagggggagaaagtggatctgcagctagaggaaagactataactcaggcagtcaagaagggtcttatccaaaatacagtccccatcttcatagagttgaaacgtttattggaaaccaagaatagtcctctcataggttctctcatggagtgcctccgcattattctaaaggactataagaatgagattgatgacatattggtagctgataagcagctgcagaaagagcttatttatgatattaaaaaatatgaagcagcaaaagctaaagcaacagtagctgaggctgtgggcaccaaaccaaaatcagtttcaaatcaatcacctgatgcttctaagaatctgaccaagacgcaaggacaaacagttggacaaagcagtaatgagcttccaagtgattcaagagttgcttcagcaatggcaaatgcagcagctgcagcaacagcccgttctgtgctcagggaaataaacaaggggaccgctacaccatcacttagttctttgagtgttcctaaagtcaagtcttgtactggtatgtgtcattccaaagataagcgcatggatgtcatacaatctataaggaaaagacagtctttcgattctgatgaagaaaactaa

SEQ ID NO: 23326 - DNA, 1407 bp, Glycine max
  Peptide Sequence Number=SeqID_115011
atgggtgcgatgaccgcaaaccggaagcgctccgaagaatgcatgaacgtaaaccacacaaattccgattctccgagaaaacgcgccaaattctcgatcaaacccgttccgtccgccaccagcgccgtcgcgagactctcccggtacccagaggttcacgcgccgttggcgagggaggttcacgcgccgtgccggtcgcgaaaattcgaacgctctagggttattgtcagtgccggcaacgtcatggggaactttctggcaacgaagttcaaggaggcgaagcgttcggcgtcggcgaaatgcaggaacctggtggagaaggggaaggaggtgattgaggtggacgcagagacggagagtgaagagcgttacgtggattcgagtgtggaagaggcgcgtggcgatggtgacaaggttgtcagggttcagcagcagtcgcagtcaacgttgtcgtttgattcggagatgatgaatgcggagttgaagatggtgagtggtgggaaggtgtggggttatgagacgcagcgtgatttggaaaatgttcatatgtataagaagttgcttgaggatgttgggaggagaagtggcacgcttcagaggctgaattttgagattgatttgaatgagaagcgcagggaacattataatttgttgcggccgaagaaggaattggttgaggaacaggaagtgccgcaagagccttttgttgctcttacaagtgaggaggaagatgaggttgaatgtgccttttcttccaactggaggaggatcttggttacccacgagaattctaacattgtgatcacgggagagaagtttcagtgccttaggcccactggatggttaaatgatgaggttataaatttgtacctggaattgcttaaggagagggagcaaagagaaccacagaaatttctgaaatgtcattttttcaatacctttttctacaaaaagttaataagtgggccgaaaggttatgatttcaaatctgtcagaagatggacaacccaacggaaattgggatacagtctacttgaatgtgataaaatatttgtacctatccatcaagagatacattggtgcttggcagttatcaataagaaagataagaaattccagtatcttgactcaatgaaaggagaggatagttttgtgctagaaaagctggctaaatattttgcggatgaagtaaatgacaagactggaaaacatattgatgtaaatacctggaaaaaagaatttgtgaaagaccttcctgtgcagaaaaatgggtatgattgtggggtgtttatgatcaaatatgcagacttttatagcaggggtctggaattgtgttttaaccaggaaaacatgtcttactttcggcgtaggacggctaaggagatcttgagattgaaagctgaatga

SEQ ID NO: 23327 - DNA, 1353 bp, Glycine max
  Peptide Sequence Number=SeqID_115012
atgctggagtgctgccttggaacacggcgcgtccggcagattcatcgcgcctgccgccacagcaccgtgaccttcctctgcctcttcctcacgctggtcgtcctccgcggcaccatcggcgccggcaagttcggcacgccggagcaggacttcaatgagatccgtcaccacctctccgccgcccgcgcccgccgcgtcctcgaagaagtcaaacccgaatccctatcctcctccgaatccaacaactacgcgaccttcgatctctccaagatcctcgtcgacgagccccccaccgacgacgaaaaacctaaccctaacgcgccctacaccctcggccccaaaatctcaaattgggacgaacaacgctcttcatggctatccaacaacccggactaccccaacttcatcggacccaacaaaccccgcgtcctcctcgtaaccggttcgtctcccaaaccgtgcgaaaaccctgtcggagaccactaccttgtcaaatcgataaagaacaagattgactactgcagggtccacgggattgagattttctacaacatggctctcttggacgcggaaatggcagggttttgggccaagcttccgttgattcggaagctcttgctttctcaccctgaagtggagtttctctggtggatggacagtgatgcaatgttcaccgacatggcctttgaggtgccatgggagaggtataaagattcgaactttgttatgcacgggtggaatgagatggtgtatgatgagaagaattggattgggttgaacactggtagttttctgttgagaaactgtcaatggtctttggatattcttgatgcttgggctccaatggggcccaaggggaagataagagatgaagctgggaaagtgctcactagggagcttaagaataggcctgtttttgaagctgacgatcaatctgctatggtttatttgttggcaactgggaaggagaaatggggtgacaaggtttaccttgagaatcactactacttgcatggttattgggggattttggtggatcgttatgaggagatgattgagaattatcacccggggcttggtgatcataggtggcctttggtgactcactttgtggggtgcaagccttgtgggaagtttggggattaccctgttgagaggtgcttgaagcagatggatagggcctataactttggggataaccagattttgcagatgtatggattcactcataagtcacttggtagccgtaaggtgaagagggtgaggaatgatactagcaatcctcttgaggttaaggatgagcttggattgcttcatcctgctttcaaagctatcaagctctcttcttcttga

SEQ ID NO: 23328 - DNA, 810 bp, Glycine max
  Peptide Sequence Number=SeqID_115013
atggatgcaaaacctcctcaacttgcttcacaacctttgaactatcagacatggttcttgaaagtttccatccactgtgaaggttgcaggaggaaagtaaagaaagttctgaagagcattgacggtgttttcactgcaacaatagaccaacagcagcagaaagtaacagtcaccggaagtgttggtgtagagatccttctcaggaaactgatcagagccggaaaacacgccgagatatggccggagaatctcaacctcgacgacgaaagaatcgccggcaaagggaagaaaaagaagaagaagaagaagaatgaagcaagagaaccacagagcttggaaaacaagggagctgaaaaaaatgctactaccactgccaagtgtagcagtgtgaacaagagcagcaacaactcgccggaaaagtccccctccggtgaccatgttccggcggagggtggtggttctggtaagaagaagaaaaagaaagttcagagtagtttgagttcagcagcagcagaatctactggtgcacctgcacacactggattgcagtttgaggatcttgtgggccaggtgaatgtgagccctccacgtcagcaatcgttgtcgttcccagaaactggttactatcctccgatggttaatgttgcagcttataacagattttatccttcttattatttctatgttccatcttcaccctacacgtgtgctggtctagaccatgatggtcattatcaatttcaatcaccaccgttggtttcctttgagatcttcagtgatgaaaatgctaatggctgttatgttatgtga

SEQ ID NO: 23329 - DNA, 164 bp, Glycine max
  Peptide Sequence Number=SeqID_115014
ttgatgatggtgtgagggagctggccgagggttttgttgtgttttcaatgttgcttaacaagtttcagggatcgccatggtgtgaaggagagaggagaatgacgaaaaggacagaagaaatctacgccgtttttgccatcaccgattttggcttcgtgcagtga

SEQ ID NO: 23330 - DNA, 990 bp, Glycine max
  Peptide Sequence Number=SeqID_115015
atgtatgtctccttctccctcttcctcacgactattgtttgtcttcttcttcttcacttctgcgctctccttccttgcatcgtcaaacgccatcgttcgtccctccgtctgctccgtgtcgcgccgccagtgagtttccccgacgtcgacatcgcctttgccatcgtctccaccataagcaggattataggaagatccttagggacagaagttagtggtgatgcgaatgaagcctcccagcatcaaaggtcaacaacatctgcatgtaggcaacggacagctgcacatgttgctgaggatgttgagcatgtagatcatacaactgacgaggaacgtcttgagttgaagttgtcctcctatggaaggaagatagaaaaatttggaagggttgctctagagattaaaggcatagtggctgccataggattaagtcctctgattgaattaggagaggtgattatcaccctcgataatgtgatatcgttgctacatttgcctattacaggcgccttccataactttgaggctcttaatgtagacaaagtcaaggacttgttagttgacttgcttgaacattttcctattgttgctttttctattgctgctgaagattatcatgagagaaaaccacttgcttgccgttggaagtctgagaaggcattaccagtgtcgacgtatcgtaagcaattggatagattgacatctgatgttgtgtactggattccttataatgaccatcgtgcattcatagaattagaactgatcattcctccacatcctgctgctccatctttatcaatagatgatagatggattcagttttttgaataccttgcacggcttggggatcctcttagacatccacctggggtgcacagtgacacatttattgagctagatcctcctcagcagtcggtcgctacggcggctatggcagaaccatctgtagctgcacctgacaatccaccaaactctctcaggctttcatga

SEQ ID NO: 23331 - DNA, 1002 bp, Glycine max
  Peptide Sequence Number=SeqID_115016
atggaggcaaagtcactgctcaagggttcatcacttaaaccttcttatcccatccataagctttcaaaaaccacgatgatgacacccaactgcgttagattcagtttcaactacaactcatgcctcatattcgcaaatgggtacccttcttcttcacttccactttctcttcagaataagcccagaaaatcggcatcagtggttgtgagtgcccgaaggaaagacaagaaagaagatacccatagctctgttcccaaacccgacgaggtcactggtttcttccccgaagctgtgctccttaaaaagagaacagttgaggaagaagggaagcttctcccggagtttgaagatgctgatgaaagagaactctttgaagcgctgatgcttgagctggatagtgatatggatgttgatatattgcgccactatgaggttatgtacttaattcatgagaagcatgaagaggaggttgtagctgtcaatgagaaaattcaagactttttgagggagaagaaaggtcaggtttggagattgaatgattggggtatgagaaggctagcttacaaaataaaaaaagctaacaatgcccactacatgttgataaactttgagttggatgccaaatatatcaacgatttcaagactctgttggaccaagatgaaagagttattcggcatctggtgataaagagggatgaggcaatcactgaagattgccctcctcctccggattttcatacactgcgtggaaatgcagatgatgatgaggacgaagaatttgatgaagattatgatggtgactgggatggtgaagatgaggaggatggcgatgaaggcgaggatgatattatttttgtagatggtgatgaagatgatatagattctagaaaacagacatcagcaaatgttagacaaccagatataagaaaattgagggctgagaacgttttgtcagcggaaggtattgaacctgcgatttttccctcttacctcacatcttaa

SEQ ID NO: 23332 - DNA, 459 bp, Glycine max
  Peptide Sequence Number=SeqID_115017
atggcacctcacatctctagagcctctgttgttgttttggtagctttcctagtccttcccttacttttctcagacatggcaagagcaacaattccagaatcagatgttgatcttttagaatttcctttaaatttagaatacttggaggctgaattctttttgtttgggtctttgggtcatggattggatgtagttgctccaaatctgactgagggaggaccccctcctattggtggaaaattggccaaacttgacaactttgtcaaggatgtcatcttccagtttgctttacaggaagttggacacttaagggccataaagaggacagtgaaagggttccctaggccattgttagatctaagcgcgacatcttttgcacaacacatccccctttcgccagctggcgtaatagcgaagaggcccgcaccgatcgcccttcccaacagttgcgcagcctga

SEQ ID NO: 23333 - DNA, 522 bp, Glycine max
  Peptide Sequence Number=SeqID_115018
atggataatgcaatcgggcatcctctacttccttccttcgatccctatgctaattcgatcaattttctgcttgcatcttacgtgattccctatgttggcctcactggttatgttggtgctaatccactgctgcaaaatgctgcttccaggaagctagttgcagggcttttgggtgtagagtccgggcaagatgcagttattcgagcattattgtatgaacatcgagcatcgctggtgcatccgtacggattgagcgtggaagtgttcacagatcgcatttcaatgcttaggaacaagctaggaaacaaagatttgaaagatgaaggtcttattgtgcctaaagtggaaggtgctgagggcaatattcttgctggtgacataaattcattggcatatcctaggactccagaagaaatcttgagaataatatatggaggaggtgatgaacattttcccggtgacttctactctcgaggagcaagtggtcgcatagccacttcttacttaaattttactacctaa

SEQ ID NO: 23334 - DNA, 996 bp, Glycine max
  Peptide Sequence Number=SeqID_115019
atggcggaggagaaaagacaagagcaagtagcgaaccccaacaactcatcatccaccaccatgccattttccgatcagattcccaacaacaacaactccatcatgatgactttccctttccaacaaccatccaccatcttcgacctcatgatgatgccttcttcttcttccttcatggacctgctcgccgtgcaggactacaacgtgccgttattcgattggctccccgccggtgtcgcacaccatccttcgccgtctccggccagctccaacgtccccgactcctccgaggtgctcaacacgccggcgtcgcctaatttttcgtcgatttcctcgtcgtcgaatgaggctacggtcaataacaactccgaacaacagagtgggaaagaattacaagaagaagaaggtggtaatggaggcagaggagataaccaagatcaagacaagactaagaaacagctaaaagcgaagaagaagaagaagaagaagaaccaaaagaagcaaagagaaccaagattcgcgttcatgacaaagagcgaggttgatcacctagacgatggttataagtggcgcaagtacggccaaaaagctgtgaaaaacagcccttatccaaggagctactaccgttgcaccagcgcgggttgcggcgttaagaagcgcgtggagcggtcctccgaagacccttccatggtggtgacaacctacgagggtcagcacacgcacccgtgccctgcttcggctcggtctagccttggcttcgtgacccaacctgctgcgttcggtccctcacactttatgctgccacatcaagcacaagcttcggctttgagtgttgttagctccagtagtaactacatcaatacgacatcgtttggtgggtttgttcaggatcactcgacccgtcgtggttttggacatgaggctttgttgagggacaatgggctgcttcaggacattattgtcccaactcaggtgaccaaggaggagatggattga

SEQ ID NO: 23335 - DNA, 324 bp, Glycine max
  Peptide Sequence Number=SeqID_115020
atggaatttgactctccaacctctcgtcctatccgaagtgacgtcgttttggaccctccaccaccgtttccgaccatttacacttttctgccgccgccaccctccacggtgctgcttccgttacctatcaacccatcacttttctttacaatggacaatcaaaggtccatttctctgtttcagtttatggctgatgaaggacttgttccatggctagaagattacttgtacggacttggcataaatatctatgcaggtactcagggattttgtgaccctaaccctacaaatatgttgataatgagaaaatggagtcaaatgtag

SEQ ID NO: 23336 - DNA, 339 bp, Glycine max
  Peptide Sequence Number=SeqID_115021
atgcgggggtgcttcagagggtccacaaggcataggaaatgtcacaaagaaaggacaaggaacttagggggagtagcaatgggcccatcggcggttaccgtagaagaagacgaagaggtacatgccctcaagaaagaacttgagaaagcccaaacagtcaaagaaaagttcaagtcagcacctgttaggatccgaaaggagaacgccgaactgagagacgtcaatatagccaccaccaaggccttagaacaagagaccaagagggcccgtagggaagaacatggccggaacaaattccgaggggctctgtggggtagtaacagcgagcttaagctctga

SEQ ID NO: 23337 - DNA, 530 bp, Glycine max
  Peptide Sequence Number=SeqID_115022
gggtggaagttgaaactccggaagaagacgaagaggtacaggccctcaagacagaacttgagaaagcccaaacagtcaaagaaaagttcaagtcaacaactattaggatccaaaaggagaatgtcgaactgagaggcattaatatagccactgccaaggccttggagcaagagaccaagagggcccgtagggaagaatatggccggaacaaattccgagggactctgtggggcagtaacagcgagcttaagctccgaagagaggaaagggaccaatcgtccaagaggagcttgtctcagctgttaagcgagaccgaaaccaacatgttagccatcatcagcaagtaccaagaagaattaaatctagccacggcccacgagcacaaagtagcggacgaatacgcccgagtgtatgcggaaaaggaggctagaggaagggtgattgactcgttgcatcaagaagcaacgatgtggatggaccagtttgctcctactccgcccccgaggagatccacgggctcctccgctatt

SEQ ID NO: 23338 - DNA, 211 bp, Glycine max
  Peptide Sequence Number=SeqID_115023
atggctactacgactgactgctgccctactactaataatgagcatgccaacacctgtaacaacatgatcgactactcagcctctccgtactggggactgacagcgcatagtatacgagagggtccctcagcttatctatatgacgacgagaggacgactactagaaccgataggctggtacttctcccagctctagaatcgagtagtgagg

SEQ ID NO: 23339 - DNA, 642 bp, Glycine max
  Peptide Sequence Number=SeqID_115024
atgaccatgattacgccaagctcgaaattaaccctcactaaagggaacaaaagctggtaccgggccccccctcgagatggccgtgatggcgcctgtggcgaagaccgccgccagcagaaaggcggcgatgcgcggcgtgccccggcgtccgccgctgaacagggtccaacccgtggccagcaccgcgacgacgaccgccccccaatagacctcgcgctgcttcagacacaggttgcagggcgcaaggccgccgaaccgttcgaacgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 23340 - DNA, 791 bp, Glycine max
  Peptide Sequence Number=SeqID_115025
ggcttcccggtatcacagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatctattttctatagctgccaatcttttgtttttggaatctcctgttggggtggggttctcctacaaaaacaccagcagtgatataagtgagcttggtgataccattaccgataatgttatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 23341 - DNA, 234 bp, Glycine max
  Peptide Sequence Number=SeqID_115026
atgtcgctgcatgttctttatctttatgcgatttctggatttcccccagggatttcccgtctgctgtatctctcgttgcaatctttcaaagaaatgaacgggcaggatcatcttgaactaccttctggggtggggaccaaacagggaaagcagaaaccaatcaaggtacttaggaacggatgcaagtggggatggggtcacgaccgactgatcgttgccttttctctgcgctaa

SEQ ID NO: 23342 - DNA, 228 bp, Glycine max
  Peptide Sequence Number=SeqID_115027
tttgaatttgatcctgtatctgatttttatgctgagagtgaatttgaatttgagtctggttctgattttctgggtgttgcttcttcgaggactgttcttcttgacctcctatccctcttcctttcccactgtatagagcaattccacccacaaaaccagaatggaagcctaccagtggaactcaaggatatgcttacttggaggacttcaaggaaaaatttccagtga

SEQ ID NO: 23343 - DNA, 438 bp, Glycine max
  Peptide Sequence Number=SeqID_115028
atgaccatgattacgccaagctcgaaattaaccctcactaaagggaacaaaagctgcacagcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 23344 - DNA, 249 bp, Glycine max
  Peptide Sequence Number=SeqID_115029
atgtcatatgctcactcgctccgagtcagtgtggatcgccccaaaaatggttcttctcccatccgtcagcacctccggaactctcctttccggctgccccttcccccctgcctttgctttgcccctggcccgccactagaaatccataaggagaaggagaaaaggttcagctctaacggaaaagagtccacccaagagagttccccggcttctcgtgatgagcgcagcgcagcaaagggtgtttgctag

SEQ ID NO: 23345 - DNA, 364 bp, Glycine max
  Peptide Sequence Number=SeqID_115030
attgattcatgtttgctgaaatcaatcccttacactaagaatgctttaagaaatggtttcctcaatcctgtgccaattgccaatagctttgagctcctcataattagatttggtgttgttcactgtagctcctttgatcaaaaatctggtccagttcctgtatccactgatgaggtttccttagtggggcaggcacttcacaccttccttgcttggacgacacatctggtagttgtgtctccggcaaaaccacctccaaagcccgattcggaggttagatgggatgccaccgtgttcgggatctttaatccagatttccccctctacataaagcacgaagacctctccgaaatcgcacacggtg

SEQ ID NO: 23346 - DNA, 246 bp, Glycine max
  Peptide Sequence Number=SeqID_115031
atggcgtttatcgcctggcgtaacctgcggctggtgaaccgcatcgcggccatctacggtattgaactcggctacttcagtcgcatccggctggacatcgccgcccgtctctcggcgcgtgcggcgcagggcatcgggtgccgggctgctcaccgcccggctggggatcaaaagcgaatggaaattatgccgtccgctgccgtggctgggggaggacaaaccgcggctcggcgatttccgccgtga

SEQ ID NO: 23347 - DNA, 147 bp, Glycine max
  Peptide Sequence Number=SeqID_115032
atgaagaaacaacaatggaagagaagcggaagacaaaggaaaataggtgagaggaggcgccatccattaaggaataagccatggaagaaggagcttcaccaccaagatgagccttggataagaagcttggagaggatgcttcaatga

SEQ ID NO: 23348 - DNA, 363 bp, Glycine max
  Peptide Sequence Number=SeqID_115033
atggttatgggggattccatcagcagactctccttccctgcatgtttgcattttagtggagataacaccgagactttttcaagtctcacaagttatccagaactacgtaggtctgagttcctcattggaggatacgtaggagcaagagcctcacttttgtcgaccacaccaccttttgctgtcatgacccaagagctggtagctcgcagagacaatcttacggttatccgcacctcgtcattcagtgaccccaagtgtgattgcatgagcaaaggccattgtggtcatttgcacccttttccggagacagcatcttccggatggagactttttcaagtctcacaagtatctagaactacgtag

SEQ ID NO: 23349 - DNA, 417 bp, Glycine max
  Peptide Sequence Number=SeqID_115034
atgaagggagagggagagaagagcacgaaattttgtgctctatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 23350 - DNA, 1227 bp, Glycine max
  Peptide Sequence Number=SeqID_115035
atgcatcagaaaccccaggttcgccgaggtaaatgtataaaaaagggacaaattttagcggatggtgctgctacagttgacggcgaactcgctttgggaaaaaacgtcttagtagcttatatgccatgggaaggttacaattctgaagatgctgtactcattaatgagcgtctggtctatgaagatatttatacttcttttcacatacggaaatatgaaattcagactcatatgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaaaggtatcgtttcaaaaatttttgtctagacaaggatatgccttatttgcaagatggaagacccgttgatatggtcttcaatccactaggggtaccttcacgaatgaatgtaggacaaatatttgaatgctcgctcgggttagcaggaggtatgctagaaagacattatcgaataacaccttttgatgagagatatgaacaagaagcttcgagaaaactagtgttttctgaattatatgaagccagtaaacaaacatctaatccatggatatttgaacccgagtatccaggaaaaagcaaaatctttgatggaagaacagggaattcttttaaacagcctgctataatgggaaaaccttatattttgaaattaattcatcaagttgatgataaaatacatggacgttccagtggacattatgcacttgttacacaacaaccacttagaggaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaaggaagcttaa

SEQ ID NO: 23351 - DNA, 261 bp, Glycine max
  Peptide Sequence Number=SeqID_115036
atggcacctacatcttgtgggcaggttctcatcttttgggcctgctctcacccgataaagcgcgatacgcggaaccaagatcgatataagatattggacggtcttaggggcccgcgtagcccatgccggccttgcttgaaagtcccacttatctttcatccatccactttttttctgacttttagcggtagtcagctgtccttggaactatcgctcatgactggatctttatccataccgaataaaaaaatggatttctga

SEQ ID NO: 23352 - DNA, 198 bp, Glycine max
  Peptide Sequence Number=SeqID_115037
atgagggttcgggagttgtttacgcatgaggaaggtattaacaccccacgtgcccatcataagggacgacaacctttaatcgactgtgcaaaatattacttcaaacctcagattgattttaattgcaaacaaaagtcatttatgatgcaagctccaatggagcttacatcatgtggtatcaagagcatcttcatctag

SEQ ID NO: 23353 - DNA, 159 bp, Glycine max
  Peptide Sequence Number=SeqID_115038
atgacaggggagccgacgaccgaagccccggtgaacggcggccgtaactataacggtcctaaggtagcgaaattccttgtcggcttaggtggagggcaaagaaggcctccttctgggggggccagagccatcagtgagataccactctggaagagctag

SEQ ID NO: 23354 - DNA, 567 bp, Glycine max
  Peptide Sequence Number=SeqID_115039
atggctgaaaaagaagacgaagaagtccaagctctcaaaagcgagttaggaaaggcgaaacttgccaaggagaagttcaagttagccgctacacacatccggaaggaatgtgccgaattacgggaagagaatgcaactaccgcaaaagcccttgaacaagagaccaagaaggctcgcaggaagagtatggccatatcaaatttcctccggagccctctgttgggagcacaggaacttcaattgctgcgaagggcaagagagtttggaccgcataaaacagactcggacgagagattgggtctcgcgtttatgcgagacggtagactttgctacatgctttggggtctcctcattcgccaagtccaagaagaggttgaagtggacctagcagcaatcgtgctccaccatagcaaggaaagtcgcggggatgtatacgcggaaaaagaggctagaggaagggtgatcgatctgtgttacccgaggcaccatctggttggatggatcagaacttcccttgttagccaagagccaaggcaatgcgcatgtcctcctgagcctcgctcgtga

SEQ ID NO: 23355 - DNA, 456 bp, Glycine max
  Peptide Sequence Number=SeqID_115040
atgcggcttgttgagccatcgtccggcgatgtgtcactcgatggttatgacgtgatgcgtctcgatacggtcgggctccgcaacatgcgcaaatccgtgcagatgatctttcaggatccgttctcctcgctcaatccgcgcatgacggtgggtacggcaatttccgaacccttcatcaagcataaattgggcaccacgaaacaggcgaaggaaaagacggccgatcttctcgaaaaggtcgggctttcagccgacatggccaatcgctacccccatgaattttcgggcggccagcgccagcgtatcgccattgcccgtgcgctcgccctcgatccgaaggttatcgtcgccgatgagagtgtgtcggcgctcgatgtctcgatcaaggcgcaggtctgcaacctgctgctcgacctgcagcagacctcaactcgccttcctgttcatcagccatga

SEQ ID NO: 23356 - DNA, 708 bp, Glycine max
  Peptide Sequence Number=SeqID_115041
atggtggtatcttgcttggcaaccgccgaggcaagtttgcttaaagatgaaaaagaatatggtgtttgtctggtcgatgttggcgcaggcattaccaatcttgcggtttatctagatggacgtttggctctggcacgtacattgcagcgcggtggtgaacacgttacacgtgatattgctgctgtattgcaaaccacgacagaagaagctgaacgcattaaaattctgtatggttgtgtcgatttaagtgctgttaagccagatcacatgattcaggtagaaggaattgatggccctcaaaccattagtcgaattgagttgtcagaaattattattgcccgttatgaagagatctttagccagattcgcgatgaactcgcccacagcggtgcaattcatggtttataccatggtgtagtgctgacaggtgatgcttgtcaaatcgaaggtatggtgagcttggctcgccgtatgttgggggtatctgcacatttgggcaatccaccgttacaggtttatgctgatgatcagcatcaagccgcgttacgtcgttcgatgtatgcaacagcagctggtttgctcatgtttagccaaagtgagttgcaagaagctgttgaagagcctgaagaggcaaatgaccgttcggtatgggaacgaatggtaaatggctggaatgcgtttaatagcaagctaaaagccattttttag

SEQ ID NO: 23357 - DNA, 435 bp, Glycine max
  Peptide Sequence Number=SeqID_115042
atggttaaggaggagtgtaaggaggtaagtgtctcctccaagaggttagctaagaaggaaagtcattttgaaataaagacaaacattaaagaaacttcccctcttggacaacctccacatcttctcctttgtaaaaagacacttgttagcactgtcacacctcttgggcttgaggttattcctcaagtaaaggagttgttggatgagggtttggttcgtaagagcttaaatccttgtgctttgttggcgcccaaaatagatagtgatcaaggggttcccacggaccctaagagaataaaggtcattcttgaatggcctactccaccaagtgttgagggaaggagcccaaggtatgaagaacctagggatttgaggtcaaatcctttccaaggtggagggaacgatgcaatcctaccccgcaagggcattgggtag

SEQ ID NO: 23358 - DNA, 324 bp, Glycine max
  Peptide Sequence Number=SeqID_115043
atgaagaagcatgataaaggcaaaaggtcattaaaaatcaatgacgactctttgcaaatccagaaggagggattccttacaatccaaaccacaagctcaaatgagaagttcgtcttcatgggaaatagagtgaaaactccagtggaagcagtcgggacttattgtttaaaactcgacactgggcatcatttagatttactggaaactctttatatggtttgtatgttgtgtggaagaaatgtcttccaaggttattttgatgatgccaaagaatcaagagtcaagaaaaatccaaagattcaagaatcaagtttcaagaattaa

SEQ ID NO: 23359 - DNA, 619 bp, Glycine max
  Peptide Sequence Number=SeqID_115044
actcgccaaggagaagttcaaatccgctgctacacacatccggaaggagtgcaccgagttacaagaggaaaacgcggccactgcaagagcccttgaacaagaaaccaaaagggcccgcaaggaggaatatggccgagagaaattccgaggagcattgtggggtagcaacaatgagctcaagctccgaagagaggagagagatcggtcactggtgcatggcatgatcttaaaagaagaattagttgcttgcgcgaggtccaaaaggagtttggctcaacacttggaagccacggagcaaagcatgctagctatcatagggcaatacaaggaagaattgaaccagtccatggcccatgaacaaaagctagtggaggattttgcacaagtgtatgccgaaaaagaagcaagagggagggtgattgatgcgttgcatcaagaagcgactatgtggatggataggttcgccttgaccttgaatggaagtcaagacctcccgcgtctgttagccaaagcaaaagccatggccgaagtgtgtactgccccagaggagattcatgggctaatcaattactgtcagcacatgatagatttgatggcccatatcattaggaatcgttag

SEQ ID NO: 23360 - DNA, 111 bp, Glycine max
  Peptide Sequence Number=SeqID_115045
atggaacgtattgctgacaagataaaaatcatcgacggatctaaagaaactctgaaacttgctgtaaggataatcgatctttggtttgttgggacaccgggcagccgttaa

SEQ ID NO: 23361 - DNA, 534 bp, Glycine max
  Peptide Sequence Number=SeqID_115046
atggaggcaccgcttaaatctgaggtcattaatgttgagtgttggatggtgcttcacttgctttgtttcttttctttgttttgcatgcagtcaattctttgctcgctggcaggtatcttgcgttccagtttacctttcctcctgctgacacttgcacttttgtgttctgcatatgaggtttcgcttttgttgccttcctgccaattctttccaatcaagagatcattccttataggcgcttcagtcatagcatcctttggttatattaaggagcatgatggatcatgggtaaagaagggtgctagaaatattggtgaagaaggacatgagggagaagattcatctcttctttcgaagattttggaaaggtttgatggtcttcaaacctttgttggtgaaaggtttgatactttagaattgcaagtggatatgcgcttcaatgaaatggagtcaaggatgacaaaggttgaagaagatgtatcttacatccgatcaagcttcgatcttccaccaccgccgcctccatcatcttag

SEQ ID NO: 23362 - DNA, 249 bp, Glycine max
  Peptide Sequence Number=SeqID_115047
atgggtgttaagtacctcgaagcagtcaagcgaaggtcgcatcccaccaaacagatgaactatgcaatcgattaccaatgctttaaaacggttaaaaatgattttgcagaatttgaaatcccacaggcttctaacagtatgacgaaaaagatgttacttcagactatcggtgagagatggaggcagtttaaatcaaacctcacgaggaaatgggcccttgcagccgatcaggacgatgtggacgacact

SEQ ID NO: 23363 - DNA, 897 bp, Glycine max
  Peptide Sequence Number=SeqID_115048
atgagcacattcaagactaaagacggcgtaaacctgtacttcaaagactggggcaaggggcagccggtgctgttcagccacggctggccgctggatgccgatatgtgggacagccagctcaacttcctcgccgagcgcggctatcgcgtcatcgcgtttgaccgccgcggctttggtcgctccgatcagccgtgggaaggctacgattacgacacttttgccgacgatattcacggcctgatcgagcacctgcagctggatgaggtgacgctggtgggcttctcgatgggcggcggggatgtgtcacgctacatcggtcgttatggtaccgcgaaagtgaaaggactggtgctgctgggcgccgtcaccccgatctttggtaaaaccgacgatcacccggaaggggtggaatcagcggtgtttgacgggatcaaagcgggtttgctgaaggatcgtgcgcagtttatcaaagagttcgccacgccgttttacggcaccaacgcgggccagacggtttccgatggggtgctgacgcagacgctgaacattgcgctgctggcgtcgctgaaaggtacactggattgcgtgaccgcgttctctgagacggatttccgtgcggatattgcgaaggtggatgtgccgacgctggtgatccacggcagtcatgaccaggtggtgccgtttgaagccaccggtaagctggtgcacgagatgattgcgggttcgcagctgaaagtgggaattaagggggagagtgcgttttttcccctcaccctaaccctctcccgcttgcgggaaaagggggaccgatcgagcgggggattggctcttggaattaaccctggggctgtctccggtcctttcatgtggcagcggtttccttctccccgggggtag

SEQ ID NO: 23364 - DNA, 468 bp, Glycine max
  Peptide Sequence Number=SeqID_115049
atgaagcacttcactgacaccctcatcagtgccaacatagacataaaatgtttttacttttcgttcattacttaccatcataatcatggtttttcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 23365 - DNA, 432 bp, Glycine max
  Peptide Sequence Number=SeqID_115050
atgccaatctccaagggccctggggtttccaactctggttacgggcctctgtcagtcctacagggtgcccgttccccaagcgaggaattgcacccacaaaggcacccagtggacccggagaagtccaacagggccctggggtttccagctctgggatcgcgcctgcaagacacccagtggacccgaagaagtccaacagggtcttggagttgtcaaactctaattacgggtctctgtcagttctacggagtgtctgtcacctccagcaagggcatcaagccccctactaatcgagctttcatcaagaaatactgcgcccccaggcaggcacagggcgaaacaccacagcagcctggggatggccggcagcgggcaacagacgcaccgccattacctctagagttcacctcagctcatccacaaaaaggttag

SEQ ID NO: 23366 - DNA, 273 bp, Glycine max
  Peptide Sequence Number=SeqID_115051
atgaccaaacttggtctctgcttgccatcggacacaactgtgtctgctaagcaaaggggtgcggataaccgtaaggtatctccgcgtatcataatgaccaaacttggtctctgcgtgccatcggacacgactgtgtctgaatgcaaaggggtgcggataaccgtaagaatgaccaaacttggtctctgcgtgccatcggacacgactgtgtctgaatggcaaaggggtgcggataaccgtaaggtatctccgcgtatcatgtgtgcagaatga

SEQ ID NO: 23367 - DNA, 192 bp, Glycine max
  Peptide Sequence Number=SeqID_115052
atggctaaattttcacatctcatgctgaaactcaaattcattactctccattcttttctaatgattatccctaaccttgacttctgggttagcttgcctaggagaacacagagtctgtgtacatctttggtgaggaagtttaagggaccgtctgaaggttaccggagctcttattctcctgtgaacttctga

SEQ ID NO: 23368 - DNA, 450 bp, Glycine max
  Peptide Sequence Number=SeqID_115053
atggggcttgtgtggtggctggccagctgtgaatcttgtgtgatatatgggatatggcctctggtaatcgattaccaagggtggagtaacaagccactggtaatcgattaccagttatgtgtaatcgattacacagtgcattttacaggttttcatgttctgaagctgcgtaattcgtgtttggcctctggtaatcgattaccaaggctgtgtaatcgattaccagagatgaaaagccttgagatcgtgatggcggcgcaactaatccatgatcgagtggagatggagtgcctagagggagcttgggagaccctcaaaggcaatgcgaggtgccgattccggggcacgattcgattcacgactacttcattggtgcatccagaggaacccgtgtgcacgcttcagtgcactgtggagtggatactacgcacgcctacaccatatcgtcta

SEQ ID NO: 23369 - DNA, 189 bp, Glycine max
  Peptide Sequence Number=SeqID_115054
atggagacaagatttttagtgtcagaaaaatatattgccttgcaaattgcgatgacgaagacattgaaacgatgctggaaaacgaagattgacaagcctgcggtatttgtgcaaaagtcccgagatgatccaccagtacacgatgaattcgattataacaatgttgtatttcaatggaaggatatatga

SEQ ID NO: 23370 - DNA, 269 bp, Glycine max
  Peptide Sequence Number=SeqID_115055
ggccctggggtttccagctctggttacgggcctctgtagtcctacagggtgcccgttccccccggcaaggtcacgtcatcatgacatagggatcacgcctgcaagacacccagtggacccgaagaagtccaacagggtcttggagttgtcaagttctaattacgggcaggcgcagggcgaaacaccacagcagcctggggatggccggcagcaggcaacagacgcaccaccatcacctcttgagttcacctcagctcatccacaaaaag

SEQ ID NO: 23371 - DNA, 284 bp, Glycine max
  Peptide Sequence Number=SeqID_115056
gtgaggacgtgcagtcctctgaaggcgataggtacaagtacccaagggtccacccttatgagaaagcaagagatcgactcattgagagggtcggtcatcccaaatccacacgactggatattagatgtaggaaatctatgcagttaacaagatttttagggatgcagatgcatgcaacctttgtcttgaaatgcgtgtcataccctaatttcgtccggggacctttgctcgatgacgtgcgaccattctttggtcctcgtgaggtgcttggcacccatcattag

SEQ ID NO: 23372 - DNA, 378 bp, Glycine max
  Peptide Sequence Number=SeqID_115057
atggcttacactcacattccggattcaacaagcgattctcctcaaatttcagccagcccgtatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagtagatatgggatcaagtttagcatatgacaacggaatttggggtgaaccctacaggctttttgctgcaaaattcctttttgttggtgttttttttttgtttgtgctaaaagtggtcttcgtcattggaagtgcggtagacagactttgtggttga

SEQ ID NO: 23373 - DNA, 222 bp, Glycine max
  Peptide Sequence Number=SeqID_115058
atgcagactcatgactgtctttaccagctaagcctcaacctacagagccagggttttacttcttttccatgccctacttcggatcagttcagggcagaggtcgcttggcccggagattggccggaggcaccagcagaggctcccgacgaggcagatgaggcccgcgagaatgaggagatgatcgatttgcttgatttcttgggagggagcggagccacatga

SEQ ID NO: 23374 - DNA, 372 bp, Glycine max
  Peptide Sequence Number=SeqID_115059
atgtttgtggaaatcttggatggagccgtggtacagcgatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtgggttacgcgcagcgtgaccgctacacttgccagcgctga

SEQ ID NO: 23375 - DNA, 426 bp, Glycine max
  Peptide Sequence Number=SeqID_115060
atgctaacatccaaaatctcatttgtggttatgggagatttcatcagcagactctccttccccgcatgttcgcattttagtggagaaaacactgagactttttcaagtctcacaagttatccagaactacgtaggtctgagttcctcattggaggatacgtaggagcaagagcctcgcttttgtcgaccacaccgccttttgtcgccatgactcaagagctggtagcccgcggagataccttatggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaagtttggtcattctgcacccatga

SEQ ID NO: 23376 - DNA, 425 bp, Glycine max
  Peptide Sequence Number=SeqID_115061
tgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttttcgccgggcattcaacatatcaagcttatcgataccgtcgacctcgagggggggcccggcggtttgcgtattggggcgctagcggagtgtatactggcttactatgttggcactgatgagggtgtcagtgaagtgcttcatgtgggcaggagaaaaaaggctgcaccg

SEQ ID NO: 23377 - DNA, 2118 bp, Glycine max
  Peptide Sequence Number=SeqID_115062
gaaatgattttgaaagaaaaagaatttcgtgcacaggtggccgctatcaatactgatgaatatattgatgcttacatatacatttacaattcggcagatgctattgttccattgtgggcttattttgtccttacagccaaacttactgatgttgcaaagaaaatagtctttggtaaccgtgaagatcttgaagttattttaatgcacaatgcaatacagacttatgactttgatgatttaagagataaaagggtattggtaaaaggatgttcggataaggaaattcctgagaatgcgtatgtagaattggtagaacaattgaagccgatcgctgaaaacaaatttggaatcagcaaaaaccagattattgctttgttagctgtagcagcacccctaattatttcgtacttaagaaataaatctcaggattctaaagaagctgaagcattaaacaatgctctggataaagaccataacggaagtatcctggatgatgcttcacaagttgaagcaagacaggcagaaggaggctcaatccttagccacattttcggtaacaacaaacaaaatgttgaaaatcagttatcacaaaatacgggaatttccattgataaaataggtcctgttttggcaatgcttgctccggttattatgggctatattggcaaagaaaaacaacagaacaatgttggagcaggtggattgggagatctattgggtggaattcttggaaatgcctctaatcaggcacaggctcaacaatcaagtccgttaaatgacattcttggtagtgttcttggcggtggcgggcaggctcaatcttcaggaaatccattaaatgatattttaggaagcgttcttggtggaggccaaaagcaacaacaaggcggactaggtggtatcctgggaagatgggtacaaactatccgtgataaaggatttatgatttggatagatcttcgggatcgttacggaattacacaattggttttagaccaggatcgctcttcagctcaattaatggaagaagctaaaaaactgggacgtgaatttgtgattcaggttaccggaaaagtaattgagagagtaagcaaaaatcctaatattccaaccggagaaattgaaattttagttgaaaaactaagcgttcttaatgactctcaacttccacccttcacaattgaagatgaaacagacggaggtgaagaattaagaatgaaataccgttatcttgatatcagaagaaatccggtaaaagataaattaatcttccgtcataaaatggctcagaaagtgagaaattacctttccgaagaaggattcattgaagtagaaacacctgttttaattaagtctaccccggagggagcgagagacttcgtggtgccaagcagaatgaacccagggcagttttacgcactacctcaatctccacagacattcaaacaacttctgatggtaggtggaatggataaatatttccagattgtaaaatgtttccgtgacgaagacctgagagcagacagacagccggaatttacacagatcgactgcgaaatggccttcgttgaacaggaggatgtgatgaatgtatttgagggaatgaccaaaacattgctcaaagatattaccgggcaggaattcggagcttttccgagaatgacttttgcagaagcgatgcaaaaatatgggaatgacaaaccggatatccgtttcggaatggaattcgtggagcttaatgaactggtaaaaggaaaagattttaaaatatttgatgatgcggaattggtagttggaattaatgttgaaggctgtgcagactataccagaaaacagatcgacgaattggtggactgggtaaaacgtcctcaaatcggagcctcagggatggtgtgggcaaaattccagaatgatggcgtaaaaacatcatctgttaacaagttttacaacgaagaagacttaacaaagatcattgaaaaattcggggcgaaagaaggagatttgatgcttattctttcaggaaatgaaaataaagtaagagctcagctttccgcattgagaatggaactgggaaaccgtttgggattaagaaaaggagatgtatttgctcctctttgg

SEQ ID NO: 23378 - DNA, 207 bp, Glycine max
  Peptide Sequence Number=SeqID_115063
atgtcatctactgttgttcatctgcttcctcaaatgaaggttcatgatcatcataggtaccaaccatacggtgcaaaattgcaagggaaaactaggcagcaggtgtcgaggtcaccatgtcatgcacaagcaactcccccctcccacatggtgattaacatgagtcacaagggagtttcaaaccaagtgacatgcccccaagtacaa

SEQ ID NO: 23379 - DNA, 123 bp, Glycine max
  Peptide Sequence Number=SeqID_115064
atgacccttcgcttaacgaacatgcacagctcatccttcttccagattcttcctcatgctcagccgaggagtgttgcgctcagcggatggctcgctaagccagcagattggcttagcgagaag

SEQ ID NO: 23380 - DNA, 924 bp, Glycine max
  Peptide Sequence Number=SeqID_115065
ttgctcctgctactcagcctagagccttgagcattgtacaaggacgtgctgtaggagtaacacattaccttctaggcttagctcaagaccccactactcgtcgtatttggtttggtattgctaccgcacatgacttcgaaagtcatgatgatattactgaggaacgtctttatcagaatatttttgcttctcatttcgggcaattagcaataatttttctgtggacttccgggaatctgtttcatgtagcttggcaagggaattttgaagcatgggtacaggatcctttacatgtaagacctatagctcatgcaatttgggatcctcattttggtcaaccggctgtagaagcttttactcgaggaggtgctctaggcccagttaatatagcctattctggtgtttatcagtggtggtatacaatcggttacgtactatgggatctttatactggagctcttttctatattccttctactatatctttaatagcgggtgggtacaacttgcaaccaaatggaacccaagcgttccgtgggcatttagtccatgtcgctattccgggatccaggggggaatacgttcgatggaataatttattaagtatattgcctcaccccgaaggattaggtccatttttcacaggtcagtggaatctttatgctcaaaaccccgattccaatagtcatatatttggtacccctcaaggagcaggaactgctattctaacacttctcgggggatttcatccgcaaactcaaagtttatggctgaccgatattgcacaccatcatttagctattgcatttctttttctagttgctggccatatgtatagaaccaacttcgggattggtcacagtataaaagatcttttagaagcacatactcctccggggggtagattggggcgtggacataagg

SEQ ID NO: 23381 - DNA, 432 bp, Glycine max
  Peptide Sequence Number=SeqID_115066
atggctagaggtatcctttatagaagccatgtgcagtcagctcacccaatactacgacctgcctttgagatgcttcacgttcggagacttcaattggaaccgaccattgaagtattgaggagatctaggatgtcctctcggggaaagaaaaccatatcttttctccggttgtctcccctctttgagcagaattgcaactgtggtcgaggattcagcaagaggtttggaccgcgtaaaacaaactcgaaacggcatagcgggcctaccacggaagtacctagaagacaaggcgagggatatggcaaatcaagaagattgggtcccatttatggatgtgttagcattgctaatctttggggtcgtcctttttccaaacgtagatggtttggtggacctagccgcaatcaatgcgttccttgcataccgccatag

SEQ ID NO: 23382 - DNA, 530 bp, Glycine max
  Peptide Sequence Number=SeqID_115067
atggtgggagcaggtttgaaaaaggatcttagagtgtctagggttgtgccaggagggtctcttaatgccttcctttttcttctcatcggagttatttcacaaagacttgccatggaatctattgattctctcccaattggttggactgtaggtgcgatgatttacttcacgggcgaggtctctggttcaagtccaggatggcccagctgcgtcaaggaaaagaatagaaggaagggttctcttgactccttcatgcatgcgggccccggcgggggcccgcacgacgggctattagctcagtggtcgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacagaccaagaactacgagatcgcccctttcattctggg

SEQ ID NO: 23383 - DNA, 593 bp, Glycine max
  Peptide Sequence Number=SeqID_115068
gtctcacaagttatccagaactacgtaggtctgagttcctcattggaggatacgtaggagcaagagcctcgcttttgtcgaccacaccgccttttgttgccatgacccaagagctggtagcccgcggagacaccttacggttatccgcacctcgtcattcagtcaccccaagtgtgattgacgagcagaggccaatatggtcatctgcgccctttccggagatgtcagcattttccgatggagacttttcaagtctcacaaattatctagaactacgtaggtctgagttcctcattggaggatacgcggcaggcccgatgatacgcggagataccttacggttatccgcacccttctgtcatccagaggcggcgggcccgatgatacgcggagataccttacggttatccgcacccttttgtcatccagaggcagcgggcccgatgacaagcagagacaaaatttggtcattctgcacccttgtgtcatctagaggcggcgggcccgatgatgcgcggagataccttacggttatccgcaccctttgtcatccagaggcggcgggcccgatgacaagcagagacaaaatttgg

SEQ ID NO: 23384 - DNA, 300 bp, Glycine max
  Peptide Sequence Number=SeqID_115069
atgagatctgtccctagaagttcgtatgaaaatgccaagttctacaaagaaaagactaaaagttccatgatctcacctgataaccttaaggaaggagctttggtagggcaaaaagtgtgggggggttattgttggataattctaggcttggctcatgatttccaaagcgactccgttcaacaaaaaaaaagcttcaaggtcaatggacaccgacttaagccatttctcacaaacccttctttagtggacgtagtggtggaagagacttccttactccaccctactcttcctccaccatga

SEQ ID NO: 23385 - DNA, 228 bp, Glycine max
  Peptide Sequence Number=SeqID_115070
atgggccagctccagcgacaagcctttcgcaaagcttacggaattagaacgcggaaagcaagtcgaaaatggggtggttggggtaccaaggaaatgtttggaagaaaaggcgagagtcttggcgagtcaaggcgaatgggccccgttcatggacatcctgacacttttgatcttgggggtggtcctctttccaaatgtggatgggttggtggactgggcagcaattga

SEQ ID NO: 23386 - DNA, 804 bp, Glycine max
  Peptide Sequence Number=SeqID_115071
atgaggggagcgccaaccgaagaaattctctcgcctttccttgtgtgggatctaggcgcgcaagaattcacatgcgcgagggttagattgctctccaaattgaaagttatcgatgaggagaacttcgaagctccggaggaagatgaagaagtccaagctctaaaattagagctagggaaggcaagactcgccaaggagaagttcaaatcagccgctacacacatccggaaagagtgcaccgagttacaagaggaaaatgtggccactgcaagagcccttgaacaagaaaccaaaagggcccgcaaggaggaacatggccgaaataaattccgaggagcattgtggggtagcaacaatgagctcaaactccgaagagaggaaagagaccggtcacgggtgcatggcatgatcttaaaagaagagttagctgcgtgtgcaaggtccaagaggagtttggctcaacacttggaagccatggagcaaagcatgctagctatcataaggcaatacaaggaagagttgaaccagtctgtgacccatgaacaaaagctagcggaggattttgcacaagtgtacgccgaaaaagaagcaagagggagggtgattgatgcattgcatcaagaagcgactatgtggatggataggttcgccttgaccttgaatggaagtcaagacctcccgcgtctattagccaaagcaaaagccatggccaaagtgtgtacagctcctgaggagattcatgggctaatcaattactgtcaacacatgatagatttgatggcccatataattagaaaccgttag

SEQ ID NO: 23387 - DNA, 204 bp, Glycine max
  Peptide Sequence Number=SeqID_115072
atggcttcctatggtgaagcaaaggaatccattgatgaagaagattcaaggcctacaaactccacatggagatacatcacaaagcaaggctggttgccaaaggttacttacaacaggaagaaagtgcattcctcatatggattagcaaaaagcaagcaaaaacaagtcattttgccaagagctctagaggcccaaaatcagtag

SEQ ID NO: 23388 - DNA, 381 bp, Glycine max
  Peptide Sequence Number=SeqID_115073
atggagaagtctgaaaagaaaaatattaatgaaaagaaattgaagaaagcatacattacatgggatgaaaatgatatggaatcttctgaagattcagaaaatgaagaaataaacctctgccttatggaaaaaatatatttggtgacaaagagtcaattagaacttgcaaaggcttatgttccctctatcaatagctggaaagagcatgaaatggaattactaagattaaatcagcatgaagaaacagataagaagaagaagggaatcgctcttaaagcctcatctgcaatccaagaagacagtgataaagaagattcaattgacttggataatgatgaagatattagtctgtttgtaaagagattcaacaagttcctaaga

SEQ ID NO: 23389 - DNA, 387 bp, Glycine max
  Peptide Sequence Number=SeqID_115074
atggctccgaaaaagctttctgcgaagagatctaggagggacaccgcggctgaagggaccagtgccgctcccgagtttgatagtcatcgtttcagaagcaccgagcaccagcaatgcttcgaggccatcaaaggatggtcgttccacagagagagatgcgtccagctcagggacgatgagtacacagattttcaggaggagatagcttgccaatattggacgtcgctggtcactcccatggctaagtttgaccctgatatagtcctggagttttatgctaatgcttggcccacagaagagggagtgcgaaacatgtggtcatgggtgaggggtcagtggattccctttgacgcagatgcccacagccagttcctgggtgacccgtta

SEQ ID NO: 23390 - DNA, 139 bp, Glycine max
  Peptide Sequence Number=SeqID_115075
gagaatgatagatctcatccagcgcaagttgttgcagcccagatacgcacactgctatataaacatgaaggctgcacgagttctgtaccaagtccgggattgaagaagttgatctctattgttcagagagcaatctctg

SEQ ID NO: 23391 - DNA, 334 bp, Glycine max
  Peptide Sequence Number=SeqID_115076
atgactaggggaaatccagctgatttacaaccctttgatcctgaaatagatagaacctttcatagattagttaggagtagtgtgcatcctggtcattctttgcattttgagcattctgagcattctattgagggtgattctgaatattctgattttgagcattccactactaattttcatactcaacctccacctcgtgagaggaatcttagggaaatggatgcacctgatttcacttatgaaaccttgtgcattcaatatcctgatgagggtgttccatatgttctcaagactggactaatacatttgctgcccaagtttcatggtcttgcag

SEQ ID NO: 23392 - DNA, 210 bp, Glycine max
  Peptide Sequence Number=SeqID_115077
gcttgtagtgagcttcaaaacaaggaaagggaaataaggctcaaaagggctatcaaaggaattaattcaaggacgcatcaacaagaatcaagccaaggctattgtgcaagcaatcaatggggcaaaacacaccaaatgattataatgatggatggctcaaattctcacaaaggtaaaatcatcactttcaaagactatcatgacatgtag

SEQ ID NO: 23393 - DNA, 576 bp, Glycine max
  Peptide Sequence Number=SeqID_115078
atggcacagaagaagagtactccaatcactcctgccacatccagaagaagcaaggttgctatcccctccaagaaaaggaaagaaatttcctcatccgactctgatgatgatgtcgaactagatgtctcgacatctaagagggccaagaaatctggaagaaaggtgcctggaaatgttcctgatgcaccattggacaacatctctttccactccattggcaatgttgaaaagggcaagctgggcattgtaagtctagctcagaggaattgtattgtcaacactgatccatctgacacaaactggttcccaagaagacaacagggagtgaagatttctgaaaaccctagccttgcaacaagtcctagggaagtagatacggagatggacaagaaaatccgcagtattgtgagtagcattttaaaagacgcctctgttcctgaagctgatgaagatgttccaacatcttccaccccgaatgtttctgtgcctgatgttgagaaagatgttccaacatcttccggcccaaatgctgaagtactctcttcccccagcaaagagagatcacagaggagatga

SEQ ID NO: 23394 - DNA, 1550 bp, Glycine max
  Peptide Sequence Number=SeqID_115079
ggctcggcgattgccattcgtaaaacaatccggagctgaaagccgcgctggatcaggcgctgcgcttatgactattgactggcaactgttaggttttggtgacgaaggctggggcggcgtgctgctggacgccgccaccgtcacggtaacggtctcgctgtgtgcgtggctgctgggcgcgatgctcggcagcctgctgtgctggatgcagattggtggcggccgctggcagcagcgtcttgccagcggctacatcacgctgtttcgcggcgtgccggagctgctggtgatctacctgttctactttggtggccgacaggtggtcgggtttatcggtgaagctatcggcctgcagggaccgtttgacgttaacggcttcgttgccggcgcgatagccatcgggctgatttccggcgcttatcagagcagcgtatttcgcggcgcgttttacgcgattcccgccggcacgctggaagccgctacggtcaccggtatgggccgttttatgctgttccgccgcatgattgtgccgcaggcgctgcgcaccgcgctgccgggcatgggtaatcagtggcaatcggtgattaaggagtcggcgctggtatcggtgaccgggctggtggaaaccatgaaccagatttccaccgcgtcgaattccacccagatgccgtttttcttctacagcgtaggcgcggtgatttacctgattatcaccacctcacacgctggcggcgctgctgcgcggactgccgctgacgctcaacctggcggtattgtccctgctgggcggcggaatactggcgctgctgctgaatttgctgcgtcagcatcgccttggcagctacgttacgcgtttttatgtctggctgttccgcgcctgccggcggtgcgcgaaagcgtgctgtggccgctgctgcgtgagccctactggtgcgggttaattgcgctgattctcaacgacgcggcttacaccgccgagatcctgcgcggcggactgaatgcggttagcgtgcagtcactggaagcggcgaaagtgtgcggcatgtcgcgcttcactacactgcgacgcatcacgctgccactggcggtgcgtcaggcgctgccggcctacagcaatgagatcatctcgatgatcaaatccacgtcgctgcgcggcgattatctatctgctgctgaccgtgctggtgagcaaagcggtggcgctgctggagcgccgtttgtccccttatcatgctggagcaccctgacggcgcaggatggcgacgtcatttcgctgatcggtgccagtggctccggtaaaagtacgctgctgcgctgcatcccgtttcttgaagtgccacaggccggtgagattgccgtgggcgatgaagtggtcaccctcgataacgcggacgaaaagctgagccgtgaacagcgccgccgcattaagctgatgcgcatgcagctcggctttgtgtttcagggcttcaatctgtggccgcacaaaaccgtgctgcagaacatcattgaggcgccgatccatgtgcagaagcgcagtgcatcaggaggcc

SEQ ID NO: 23395 - DNA, 1128 bp, Glycine max
  Peptide Sequence Number=SeqID_115080
atgactgccgccggcggattgagtttaccggcgcaggccgccatggatatccgcgtgacgtatgccggttcgatgggaaaagtgatggatcaggcactgggcccggcatttgcacaacagcatgacggtaagtatgaaggtcagggccagggggcttacggcatggcgcgcctgctggcgagcaaaaaaatcaccgctgacgtgttcgtgtctgttactcccggtccgatgcagatcctgaaaaccgccggactgatcgacaacgcagtaccggtagccagcaccagcatggtgatcgcctataacccaaaagggccgtttgcgccgcagtttgccgcagccaaaggcaatgatggccgctggcttcagctgctggcagcgccgggactgaaatttggccggaccgatccggtaaacgatcctaaaggccagaacattatttttaccctgctactggcgcagaaatattaccggcagcccggcatcgctgacaacattctcggcggttaccagaatcccgcacaaacccatctggagggtggcttgctgacgcggctcgagagcggtcaggtggatgcggcagcaggctatgaaagcgaagtgatctctgcccatctgccttacatcgcgctgcccgatgaaatcaacctcagcaatccggcgatggcgactaagtggtacaacacggtcagctttagcgtcaaagacagccaggcaaggctatgccgcgccgaagggcgatgggctttacaccccatgaaaatccgccatgctggcgcgctgtggctgtcgctgcccgccctggtgctgctggccgtaccgtttatcaccctgacgggcgtcacacactggcaacacctgcggctggcgtggggcgcggggaaaaatgcgctggctggtggaaacgctggtgatgatcccgctgctgacgccgccgctggcgatgggaatcctgctggtcagcgcgtacggtccgtacagtttgcccggccagctgctgagcaagctgggctggacgctggtgaacaatcccgccgcctttattctggcgcagtggtatggcgcgctgccctactttgtcaccagcgcacgctcggcgtttatcgcggtgccgccggagatccttga

SEQ ID NO: 23396 - DNA, 735 bp, Glycine max
  Peptide Sequence Number=SeqID_115081
atgccgcccggtgcgcctgaagagaagcagcaaatggtgaccagccacgccgcacagtccggccagcaggctaccgaacagcacccagcgcccggtacgtccgagatgcaggcgctgaaactggtcctgtgcgagaaatatcagccggttgaacgccacgccgcagccaccaaacagcacacccagcaccagatagagccacagcgtctcggtgggcgcgtcacgcagctgaccgatattaatgatggcttcgttaccgttgagcacgcgaaagacaatgctcgacatgatcacgccaacaaacaccgcttttatcgatatcaggctatagcgaaactgcgggcgcatctcttcgataatgaacaaaatgccggccagcggcgcgttgaacgccgccgaaagccccgccgcggcaccggtcgccagcagcgtatgacgcgattcggaatcgcgcacgcgaaacagatcgaggcacataccaccgatgttgccgccaatctgcaccgtgggtccttcgcgtcccagcaccatgccagagcccagcgcacccatgccgccgataaatttaaccggcagcacgcgccaccaacgcaccgggcgcagctcttccagcgcgccctcgatttccggaatacccgagcctcccgcctctggcgcgaagcggcgcaccagaaaatagccgatgccgcccagcagcgccgaaataaaaaacgcgctcagcaacgccatggccag

SEQ ID NO: 23397 - DNA, 951 bp, Glycine max
  Peptide Sequence Number=SeqID_115082
atgtcccataccgctttatctgctgattctgccctgcatcgttccggctttttcctgctgctgctgttactgaccgccgccaacttacgcacgcccatcaccgccaccgggccggtactggaaaatattcgcctgacatttggcctgagcgccagcgctgccggcgtgattaactttttaccgctgctgatgttcgccacgctggctccgccagccgcctggtttggcaatcgctttggcctggagcgcagtctgtggggagcgttactcctgatcgtcctgggttcactgctgcgaatcagcggcagcgaaacggcactgtggctgggtacgctgattctcagcagcgggatcgcggcggccaacgtcctgctgccgccgctgattaagcgggattacaccgcgcacaccgcgcgttatatcgggctgtatgccatgaccatgggcatcaccgccagcatcgcctccggcgtggccgtgccgctggccgaactgagcagcgccggctggcgtctgtcgctggcggtctggctgattccggcgctgatcgcgctgctggcgtggctgccacagctgaaaaatcccgcgacgcttgagcagcgcgcgacagaggtcaccgtaacgcgttcgccgtggcgttccgcgatcggctggcaggtttcgctgttcatggccagccagtcgctgctgttttataccctgattggctggtttaccccgttcgcacaggataatggcattagtcagctccaggcgggcggcatgttgttcgtctatcaaatcgtggcgatcgcctccaatctggcctcgtctgatcgggctgctggcttcgctgtcgatcttcatcgcggtgaccggcctgctgctggcacccgcatggtcgctattgtggctgattctggcaggcctcggggcgggcgcctcgctgctgatcagcctgtcactgtttaa

SEQ ID NO: 23398 - DNA, 1702 bp, Glycine max
  Peptide Sequence Number=SeqID_115083
atgttgtgccgcgaactgcccgcggtgctgaaacgcctgcaggtcgatggtgtgattgccgaccaaatggaagcggctggcggtctggtggcagaggcgttacggctaccgttcgtgtcggtggcctgcgcgctgccggtcaatcgcgaagcggccattccgctggcggtaatgccctttcgctttgctcaggatgagaaagcgctgcagcgctatcaggccagcagtgacatctacgaccgcatcatgcgtcgtcatggcgctgtcatcgctcgtcatgcgcgcaccttcggcctgcccgaacgccatggcttacatcagtgtctgtcgccgctggcgcaaatcagtcagctggtgcccgcttttgattttccacgtcagcaactgccagcctgctatcacagcgtcggcccgctgcggactccagtcgctagcggcgcgctcgccgctccctggccagcgctgcgccagccagtggtgtatgcctcacttggcacgctacagggacatcgctttcgcctgtttctgcatctggcccaggcctgccgcaatcagcagctgtcgctggtggtggcacactgtggcgggttgactgccaaccaggcacatcagctcagactggccggtgctgcgtgggtaaccgattttgtggatcagcgggcggcgctgcagcatgcgcaactgtttatcactcacgccggtctgaacagtgcgctggaagcgctggaatgcggcacgccgatgctggcgctgccgatcgccttcgatcagcccggcgtggcggcacgtattgagtggcacggcgtcggccggcgcgcctcacgtttcagccgcgtcgcgcaactggagcaacacctgcaacagttactgagtgacgatcgctatcgtctgcgcattcaggcgcagccggctggcaatcatacctggtcgttccatcgcgaagacgtcagcgaagcgcagttccgctggctcgaaccgctgctttcggcgcgctggcccggttatcaggtacgcttccccaccctgcgtcgccagctggatggtgaatattgctcgattgcctcggaggattttgcccggcacttgcagcaggtgctcggtgccgcgctacgcaccgcagcgccggtcagcgaggtctcacccaccggggtcagactggcggatggcgggatgttacaggcgcaggcggtgattgacggacgtgggctgcagccgacaccgcatctgcagctcggctatcaggcatttgtcggtcaggagtggcaactggccgcgccgcatggcctgcagcagccaatattgatggacgccagcgtcgatcagcagcagggttatcgctttgtttacaccctgccgctcagcgccagccgtttactgattgaagatacccattacatcaaccatgccacgctggatgtcgcacaggcacgccggcacattactgattatgcccaccagcgcggctggaatctgcgccagctgctgcgcgaggagcacggctcgctgccgatcacgctcagcggcgatatcgatcagttctggcaacagcagcacggacaaccgtgcagcgggctgcgtgccggactgtttcacgccaccaccggttactcgctgcctgcggcagtggcgctggcggagaagattgccagcacgctgcccgccgatgctcacacgctgagccactacatcgaatcctttgccc

SEQ ID NO: 23399 - DNA, 1182 bp, Glycine max
  Peptide Sequence Number=SeqID_115084
atgacgacgcaaaaagtggcggtaatcggtgcgggtgttatcggcctcgccgtggcgtgggcgctggcgcggcagggggtgcaggagaccctctttgaccggcaacacatgggcgcgggcaccagcagcaccacatttgcctgggtgaactccaacggcaaacagcctgccagctatcaccgcctcaatgcgctggcgatggaggagcatatccggctgcagctgacgcagaccaatggcgtgcgctggctggaaccttgtggcacctgggagtgggccggcgcgggtgaagccgaacagcaactgcagcagcgtgccaccgccttgcaggccgctggctatgcggcacggcaaaggacgctggccgagctgcagcaggaaattcctgaactgcgcgcgtctgcggtgcacggcagcatctggcattttccaacggaatcggtgctctatccggcgctgtatctggcacggctgtggtcagaggcgcaggcgcacggcgcggtactgcatcagcatcaggcgattcagcacatcagtgaaaatgcggaaggcgtgacggtgcagctggagcagggtgagcagtggcagggtgatcgtctggtgctggcgaccggacgctgggccaatcagctgctgcatacgcttggactggaactggcgctgattgacaccagcaagcctgatgcggtggcctgcagctttctggcgcgcaccgcaccgcagccgttatcgcttggcaccaacctgatttctccgcagctgaacgtgcggccggacggcggcgggcggttactgttacaggcgctggatctcgatcacctggccgatccgggcgcgccgccgtcgactcatggcgccatcgccgatcagtttcgtgagcgctaccgtgcgctgtttgccacggccggtgcgttgcagatcgagcagattgtcgtcgggcagcgggcgcgtccggctgatggtttgccggcactgggctttgtcaccccgcatcagcgcgtgtatgtcgcggtgacgcacagcggcgtcacgctgtcaccgctgattggcaggctggtggcggaggagctgatcggcgacagtcccagcgacctgctgagagagttccggccacaacggctgatcggcaaaaccgccagcgcgtttgcaccgattcagcgaaactttccggcggcacagtga

SEQ ID NO: 23400 - DNA, 361 bp, Glycine max
  Peptide Sequence Number=SeqID_115085
atggtgttgccgataagaattgatcccgtcaccgccgcgatcgtgaccattgtgattaactccggtgcctacattgctgaaattacccggggcgcgatcctctcaattaataaaggctttaaagaagcgagtctggcgatgggcttatcgcagcgcagtacgctgtggtatgtcattatgcctttagcgttacgccgcatgattccggctttgggtaaccagtggattatcagtattaaagatacctcactgtttattgtgattggcgtggcagaactgacgcgtcaggggcaggagatcattgcgggtaatttccgtgcgctggaagtgtggacggcggtagccattgatttatctgctg

SEQ ID NO: 23401 - DNA, 691 bp, Glycine max
  Peptide Sequence Number=SeqID_115086
tggatcgacagagccgcacggcggcctgcgcaaaactgccacactccatgccggatggttatgtttcgccacaatcgcggctgagtcaatacggagaaacatcatggcaaaaacactcgatagtaaaacgctggcgcgcatcgcgccaaagctggcggaactcagtcagcagcctgattacgctggccgcactgacggcgctggggcgagtgcaacagctaccgtggcatatcgaattcgcgcaacaaaatggcctggcacaagaagagatcgtcgaagtgttcacccatctggccttctatgccggctggccggcggcagtgtcagcgctaagctgtctggaagaggcgtaaccctcatgccttttacccgcatcatactgcgtcagggttatagcgacgcgcaattaacgcagatttccgacatcctgcaacagagtctggaggacgaatttgccgttccacccggcgaccgctttcaggtatttgaagaactgccggcgcggctaagggtgtttgatcgccactataaaagtcgcgggcgttcagagaattttgttcagttcatgatgactgcgggcaagccgcgcagccgcgaacagaagcacaagctgtgtccgcaaattgtgtcagcaactctcgcaatcgctggatatcgatccgcaggatgtgatggtgattattcagtttaa

SEQ ID NO: 23402 - DNA, 486 bp, Glycine max
  Peptide Sequence Number=SeqID_115087
atggccaaacaggaagcgctcagaaccagcgaatgcccggtcgcccgaaccgtggaggtgattggcgaacgctggtgtctgatgatcatccgtgaagcgtttgatgatgtgcgccgcttcagtgatttccagaaaaaccttgggctggcaaaaaatatcctggcgtcacggctaaaactgctggtcgaagtcggcgtgcttgagagttgtccggcgtcagatggcagcgcctataaggaatatttgctgaccgaacggggacgagccgtcttcccaatcgtcgtggcgatgcgccagtggggagagcgttatctgtttgaaaaaggcgagactcactcggtattgctggataacgccaacggcgaaccgttacctgaactggccgtgtattctgcccggggagaacggctcgatcccgccgactgtcatcgccggcgcgtcatagccggtgatcgcgctgatcaggcttcgtcgatcgtgaaataa

SEQ ID NO: 23403 - DNA, 810 bp, Glycine max
  Peptide Sequence Number=SeqID_115088
atgctgttgaccatcacccacgacatcgccctggcacgccagctgggcggcgacgtgctggtgatacataaaggcagcgtgattgaacagggcccggcgcagcaggtgttgcagtcaccgcagcagccttacacgcgcgcgctgctggctgccgatccggccgtctggcccgcccgacagcaaacggtgatcggtgccaggccggtgatcagcgcccaggacattatgctggcgcgcgggggcaaaaggctgggtgtgccacgcgatttcacgctgcacgccggtgaaatcgttggcctgcacggtgccagcggcagcggcaaaagcagcttcggcgacgtgctgttggggttgctcgcgccgcagcagggccgcgtaacgcaccacgctgatgcggatgcgctgaaatatcagaaaatctatcaggatccttccgcgctgtttccgccgcagcgcacgctggggcaaagcatcaacgatgtgctgcggcgtcacgctctcccgccggcacagcacgatgcgctcatggcgcggctggccttgcatcccgcgctgctgacgcggcgaccagaggcgctctccggcggcgaactgcagcgcttcgcgctgctgcgggtgatgctgctgcggccggtatttctgtttgccgatgagccgacgtcacgcctcgatccgctggtgcagcagcaaacatggcagttgatcgcggaactggcgcgcgagcagcagtgcgcggtgctgttggtgagtcatgaccgcgatctgctggagaaaggcacgcatcgggtgatcgccatggaagcggcttag

SEQ ID NO: 23404 - DNA, 646 bp, Glycine max
  Peptide Sequence Number=SeqID_115089
atgaacgcgccaacaggagtaattgtgaccccgcccattgctatcattgccgccggactggtgcgcgaacgccagcgtgccggactttcgctgacggaagtggcgcgccgcgctggcatcgccaagtcaacgctgtcgcagctggaggcaggcaacggtaaccccagcattgagacgttatggtcactgtgtgtggcgctgaatattccatttgcacggctgatggagccggaagtgaaaaagatgcaggtgattcggcgtggcgaaggcatggtggtgtcagcagagttagcggactttcaggccgcgctactggccagctgcccgccgggcggccgccgcgacctgtatctgatcaccagccagcccggcgcaccgcgcgcctcaaaaccgcatccaccgggttccgtcgaacacatcatcctggcacgcggccgcgcgcgggttggcctgatggaagcgccggtcgaactgttcccgggcgattatatttgttatcccgccgatgaaccgcacatctttgaggcgctcgaagcaaacaccatggcggtacagttcatcattggcagaacagcaggaacatatggaccttattcccgcgcagccgcatcacgcggcggcgatacagaagatttacgcctggcac

SEQ ID NO: 23405 - DNA, 477 bp, Glycine max
  Peptide Sequence Number=SeqID_115090
atgatcaacaatgccggcgtcatgccgctgtcgccgctcagttcgctgaaggtagatgaatgggatcgtatgctcgatgtcaacgtgcgtggcgtactgtacggcatcgctgccgtgctgccggtcatggagtcgcagcaaagcggccatatcatcaatatcgcctcgattggtgcgctggcggtatcgccgacggcagcggtgtactgcgccacaaaattcgccgttcgcgccatttcggatggcctgcgtcaggaatcgcgccagctgcgtgtgacggtcattaatcccggcgtggtggaatcggaactggcggacaccatcactgacgagaccgcacgcgtggccatgcagagctatcgtcagattgcgttaaaacccgaagccattgcgcaggcggtgagctgggccattaatcagcctggcgaagttgatgtcaatgagatcacggtgcgccctactgccagcgcacattga

SEQ ID NO: 23406 - DNA, 851 bp, Glycine max
  Peptide Sequence Number=SeqID_115091
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcaatggaattatcttaaagagctttatagacgcatttgatcaaacgggaatgaaaacagaggaaacagctgtaatatccgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 23407 - DNA, 291 bp, Glycine max
  Peptide Sequence Number=SeqID_115092
gcgaggctcacgggtgcgctttccaaaggaggaaaatgcgcggagtcaccaccaacgtttatttgtggaaaacgtcggaaaaaccgaaggaaaccagtcaaaaagaatattccaagttcgggagttgtatttacgtttgaggaaggtattagcacctctcacgtcgacaaaagcggggctcttgctcctacgtgtcgcaacctacccttcggcgggagggcgacgcgtgactcgcgggttgcgtgttccacgaaaggaatacgcgcggagtcgccaccaacgtttatttga

SEQ ID NO: 23408 - DNA, 330 bp, Glycine max
  Peptide Sequence Number=SeqID_115093
atgacttgtcggtcactgacctactactttgcttacctttggctttggacttggtcgcctattggttggccatgtggtgtaggcaatactcaaacctttttgtggatgagcagagtacttcttgatgaaagctcgattagtagggggcctgatgcccttgctggaggtgacagagtggtcatgttggtgcgcatgatccgcactcgtctctttgcagcgacacaggtgaaatcttgccccggtatgcatagtagctgtgtgatagcctccctctctggttgtgctcgcacagttggccctcctccaatatcagggggggtggcccagtaa

SEQ ID NO: 23409 - DNA, 625 bp, Glycine max
  Peptide Sequence Number=SeqID_115094
ggctgcacgtcctcgccttcagaggactacacatcctccatttcagaggactacacgtcttctccttcagagggctgcacgctctcgcctttagagggcttcacgctctcgcattcattcctgggccattccctgattctggaggagggccacctatgcaagtacaaccagaggaggaggctatcgtgcaactactatgcataccggggcaagatttcacccgtgccgctgcaaagaaacaagtgcggatcatgcgcaccaacatgaccactattacacagatatggatgacgttgctacttagcaacattccgtccaacgaccgtaatgccgatctccccctgcggaagtatcagggtcgcgcccacaagacacctagtggacccggagaagaccaacagggccctggggtttccaactttggttacgggcctctatcagtcctacagggtgcccgtaccccccggcaaggacacccagtggacccaaagaagtccaacagggtcctggggtttccagctctgattacggacctctatcagttctacggagtgcccgtcacccccaacaaggtcatcaggccccctactaatcgagctttcatcaagaggtactgcgcctccca

SEQ ID NO: 23410 - DNA, 345 bp, Glycine max
  Peptide Sequence Number=SeqID_115095
atgccaatctccccctgcagatgtatcggttgggatcgcgcccataagacgcccagtggacccgaagaagtccaacagggccctggggtttccaactctggttgtgggcctctgtcagtcctacagggtgcccgttcccccagcgagggatcgcgcctgcaagacacccagtggacccgaagaagtccaacaaggtcttggagttgtcaagctctaattacgggtctctgtcagttctacggagtacctgtcacctccagaaagggcatcaggccccctactaatcgagctttcatcaagaagtactgcgtctctaggcaggcgcagggcgaaacaccacaatag

SEQ ID NO: 23411 - DNA, 429 bp, Glycine max
  Peptide Sequence Number=SeqID_115096
atgagtgcaaagaagaagctaaatctagcagcgactcacgagcaaaggctagaggatgagtatgccaagatatcagcagaaagggaagcaagggaaagggtaattgattcattgcaccaagaggcaacaatgaggatggaccgatttgctcttactttgaacaggagtcaagaacttccccgattgctagccaaggccaaagcaatggcagacacctactccgcccccaaagagattcatgggcttctcggctatttattggcgatcaaaattgccattccctgggttatggggttgaaccaagctcatgctttttcgaaaaaagttcatcaagtcaagttgaagtatggaagtaactatcttgcaaaaattggggcaaaagatgaatcgagttacatcactgcttcatttactgccaaacacatttag

SEQ ID NO: 23412 - DNA, 321 bp, Glycine max
  Peptide Sequence Number=SeqID_115097
atggcacaagaatgcttcccaaatgaatatatgatgtggaattgcccctcaagtgtagatagatggcatgaaagttccttttcaaatgcaagaaatggccccgaggaaactcacctcaagagatccaggaaggataaggcggccgaaggaactagttccgctcccgagtatgatagtcaccgttttaggagcgctgaacaccagcagtgcttcgaggccatcaaaggatggtcatttctccgggagcgacgcgtccagctcagggacgatgagtataccgatttccaggaagaaatagtcgccggcggtgggcatcactag

SEQ ID NO: 23413 - DNA, 108 bp, Glycine max
  Peptide Sequence Number=SeqID_115098
atgggggagaattatgtttgtcatcatcaaaaagggggagattgtagaagcaagcttcatgatgatgaaccaagcaattttgatgataccaaaagcccaagtgattga

SEQ ID NO: 23414 - DNA, 309 bp, Glycine max
  Peptide Sequence Number=SeqID_115099
atggtggagtatgcacgaacagcgcttgaaatcaattcgtgcagcccgggggatccactagttctagagcggccgccaccgcggtggagctccaattcgccctattgtgagtcgtattacaattcactggccgtcgttttacaacgtcgtgactggaaaaaccctggcgttacccaacttaatcgccttgcagcacatccccctttcgcccgctggagtaataccgaagaggcccgcaccgatcgcccttcccaacaatttgcgcagcctgaatggcgaatgggacgcgacactgtagcggcgcattaa

SEQ ID NO: 23415 - DNA, 195 bp, Glycine max
  Peptide Sequence Number=SeqID_115100
atggtcgagactgatgataggaataaagagaaaataaccacgtttgacatcataggggtagtagctatgtgggagaggagactgtcgttgaaacttctgctcgctgccttgaatggaaaggattctgcagtagctatgtgcagattctgcaggctcatgggtactaccactgctgagctatcgttgaatcggtaa

SEQ ID NO: 23416 - DNA, 1160 bp, Glycine max
  Peptide Sequence Number=SeqID_115101
atgttccaacatcttccaccccaaatgctgaagtcctctcttcatccagtaaagaggaatcaacagaggaagaggatcaagccacagaggagacccctgcaccaagggcaccagaacctgctccaggtgacctcattgacctagaagaagtagaatctgatgaggaacccattgccaacaagttggcacctggcattgcagaaagattacaaagcagaaagggaaaaacccccattactaggtctggacgaatcaaaactatggcacagaagaagagcactccaatcactcctaccacatccagatggagcaaagttgcaatcccttccaagaagaggaaagaaatttcctcatctgattctgatgatgatgtcgaactagatgttcccgacatcaagagggccaagaaatcagggaaaaaggtgcctggaaatgtccctgatgcaccattggacaacatttcattccactccattggcaatgttgaaaggtggaaatttgtatatcaacgcagacttgccttagaaagagaactgggaagagatgccttggattgcaaggagatcatggacctcatcaaggctgctggactgctgaaaactgtcaccaagttgggagattgctatgaaaagtctaaaaagagtgatgagtatcagaaagtgtttgtcagaggaaaatgtattagattctcccctgctgtaatcaacaagtacctgggcagaccaactgaaggagtggtggatattgctgtttctgagcatcaaattgccaaggaaatcactgccaagcaagtccagcattggccaaagaaagggaagctttctgcagggaagctaagtgtgaagtatgcaatcttgcataggattggcactgccaactgggtacccaccaatcatacttccactgttgccacagaatcttttgctgtcaaattacccattgccttcccaactgtattgtgtggcattatgttgagtcaacatcccaatattttaaacaacattgactctgtgaagaagagagaatctcctctatccctgcattacaaactgtttgaggggacacatgtcccagacattgtctcgacatcagggaaagctgctgcttcaggtgctgtgtccaaggatgatttgattgctgaactcaaggacacatgcaag

SEQ ID NO: 23417 - DNA, 946 bp, Glycine max
  Peptide Sequence Number=SeqID_115102
gtctaggagggacgccgcggctgaagggaccagcgccgctcccgagtttgatagccatcgtttcaggagcgcggagcaccagcagcatttcgaggccatcaaaggatggtcgttccaccgagagagacgcgtccagctcagggacgatgagtatgcagattttcaggaagagatagctcgtcggcgttggacgtcgttggtcactcccatggctaagtttgacccgaatatagtcctagagttttacgctaatgcttggcccacggagcccccgcgtgcgggacatgcggtcatgggtaaggggagtgcgagttttagtcagagaaggaaccgggccgatggatttgacgaggaggccattgcccagctgttatgcataccgggtcaggattttgcccggactggtgccgggaggcgggtgcggatcatgtgcactagcatgaccaccttgacccagatgtggataacgttgctgctcagcaatgtcctgcccagcgatcataactccgacctccctttgccgaagtgtcagctggtgtatgccatcctgacacggatgagcatccatgtggctcagttgatcgctgacgccatttatttatttgcaggtatgccacctaccaggcaccctctagacccagataagtctaacaaggccctggggttttcagcgttgatcacgggtctctgccaagcattcggggttctcgtcacacctagtaaggtgattcgaccgccgatcacccaggccttcattgagaagtattgcacgcctagacaggggcagggtgatgcaccgcaggccgcaaacgcaccgccgccacctcatcaggctggctcagctgggtcattggcatggagcggtatttatagcactgggttcccagcaggcggccaaccacaggggcagtacagatacatgagtgtctctactagctcagcctca

SEQ ID NO: 23418 - DNA, 273 bp, Glycine max
  Peptide Sequence Number=SeqID_115103
atgggtgccaagtaccttgaagtggtcaaacgagggtcgcatcctaacaacggatggtccccggacgaaatcaggtaccgacacatcatcctgacactgtcgattttgtctctgtgttttgttggaaatgatcgagcctgggcggcgagatacagaatgaccataatttgtctctgcatgccaccggacatgatcgcctctggatggcgaaaaggtgcacagaatgaccataatttgtctccgcccatctctcgacttactgtttttgaatga

SEQ ID NO: 23419 - DNA, 168 bp, Glycine max
  Peptide Sequence Number=SeqID_115104
atggatgttatggactggtgtgaggaattgatttgggcaagattggatgagaggaagtgtgaatttcgaaatctgcactttgtgcagatttttgctgtgaaattgtgcaacaggattgtgcacaagtgcagaaaaatgctatgttttcgctggttgtggaaagagtag

SEQ ID NO: 23420 - DNA, 126 bp, Glycine max
  Peptide Sequence Number=SeqID_115105
atgaaaatacagaaaaaaggtgtcgagggaaggagcctagagtatgaagaacctcgggatttgaggtcaaatcctttccaacgtggaggggatgatgcaatcctacccagcaagggtataggataa

SEQ ID NO: 23421 - DNA, 480 bp, Glycine max
  Peptide Sequence Number=SeqID_115106
gttgtaggatgtaccatctgtgggggagctcatgaatctggatgctgtattcctattgaagaacaccccacttgtgaaggacaatggaggaaccaccctgaaaatcagttcaacaaagatcaaggtggaccatccacaaggccacaccaacaagggcctagtctctatgatcgcacaacgaagctggaagagactctagctcagtttatgcaagtttctatgtccaatcagaagagcacagagtctgccataaagaatcttgaggtccaagtcggacagcttgcaaagcaattggtgtatagatcatcaagtagttttacagctaatatagagaaaaatcccaaggagaaatgtaaagctgtgatgactagaagtagaatggcaatccaaggaaatgatagtgaagctggaaagaagatggaggaacataaacacagctggcacctaagccaacactttaacctatttttgattctgtag

SEQ ID NO: 23422 - DNA, 453 bp, Glycine max
  Peptide Sequence Number=SeqID_115107
atgtcgccttcatcttctcttgtatctcctctacttcacccattactccagcttagcacaagttcggaaagaatgcaaagagcaatgcaaccaatgaacaacatggatattttcaacatggtccatgacatctccatcaaggtgaaactggaagtaacagggacattgacatccctaaatgtgtttggtagtagacgaagcaatgatgtaacacgatccatcttttgccccaatttttgcaagatggttacttccatgcttcaacttgactcgatgaaccttttcgtaaaagcacgagcttggttcaaccccataacccagggaatggcaattttgatcgccaatacttcaaaaacatttcatagggatgaaagactcgagaatacgcatgctacgcatagaaaatgtaattatgagattgagatgcccgaagagacatcttttcttaattaa

SEQ ID NO: 23423 - DNA, 405 bp, Glycine max
  Peptide Sequence Number=SeqID_115108
atgtgtaaagccaagagtgaaagttggtatcagagcttggccttaagggttgagtatctgacaatactaagaaaaagatccaggatatcaaagttagggaagaaggattctccaccaacaaaccaccaatatctatgggatgtgacgaaaaatggagattatattccatatgatggtcaagtgaatgagattcctagaggccaatggacggaggagcaaaaactcagattcctgatcaactcctatgctcaaaatgtgatgttgtgtgccttgctcaaagaagaatataccaaggtacgtagcttcaaaagtgtcaaacaaatgtgggacaccttggctataacatatgatatgaaccctcatggcacaagggctgacttaggatcgtctaggattaaaccttga

SEQ ID NO: 23424 - DNA, 1272 bp, Glycine max
  Peptide Sequence Number=SeqID_115109
atggcgagccaagagaagtggggcccgtttgcggatgttttagctttgctgatttttggggttgtcctctttccgaacgttgacggcttggaaagtccagtggtagctatcttggcagatttgttcgacacctttgaccggaggtgtgagaaaaacagtgcacggattgtctgctgtttacccgctctctgtgtgtggttgatttcacacctattccgacaagacacgagacacccgtgtccgcttcaaagctatcgctcatgcgccgaaaaaggaagagtcgattgggaccaacatttggctgggatagggggcagcacgatcaattggtttcctcgttggaaggaaggcaaggaaggagttcttttctcgtgtggggactatcctaatgttccactgatagggactaggggttgtattaattataatcccgcactcgccataagacagctagggtatcccatgagaggggcgccaaccgaagaaagtctctcgcctttccttgtgagggatctaggcgcgcaaggtctcaagagttcacacgcggggttagattggctctccaaattgaaagttatcaataaggagaacttcgaagctccggaggaagatgaagaagtccaagctctcaaattagagctagggaaggcgagactcgccaaggagaagttcaaatcagccgctacacacatccggaaagagtgcaccgagttacaagaggaaaacgcgaccactgcaagagcccttgaacaagaaactaaaagggcccgcaaggaggaatatggccgagagaaattccgaggagcattgtggggtagcaacaatgagctcaagctccgaagagaggaaagataccagtcacgggtgcatggcatgatcttaaaagaagagttagctgcgtgtgcaagatccaagaggagtttggctcaacacttggaagccacagagcaaagcatgctagctatcatagggcaatacaaggaagagttgaaccagtctgtggcccatgaacaaaagctagtggaggattttgcacaagtgtacgccgaaaaagaagcaagaggaagggtgattgatgcattgcatcaagaagcgactatgtggatggataggttcgccttgaccttgaatggaagtcaagacctcccgcgtctattagccaaagcaaaagccatggacgaagtgtgtacggcccccgaggagattcatgggctaatcaattactgtcaacacatgatagatttgatggcccacataattagaaactgttag

SEQ ID NO: 23425 - DNA, 363 bp, Glycine max
  Peptide Sequence Number=SeqID_115110
atgatcgcaggggaacggatcactcattctccattggggacaggtgcacgaacgacaactccaaacgtcacacatccgtcgcctacttaccgtttaggtggcaccagcgatatccagctaagccgtagccgcatattgagcgcagcggatatgcgggatttcagttggatcagatctttcgctttgacggaagcttttggacctagcgaaaaggactttataagccttcgcgcaagcaagcgcgagagaagcaagcaaagtcgaagctttgccagaagcaagacgaggaagcagagctgtcgtataagcggtagcttcccccgacctactaaacaaaaatacaacagtcgcgacctactttga

SEQ ID NO: 23426 - DNA, 291 bp, Glycine max
  Peptide Sequence Number=SeqID_115111
atggtagccataaccctagccaagagttcattaacctccatttctccgagaatacaactcgaacgttcaaggtgtggcttgtcacggagaagccccggggactacgttgccattgagcattgtagggctctgaagcgtattaggtgcaagaacatttgcaaaaagggggacggatctttcaaagaacacgcccaaaaggtggagggatctggcggcccaggtggtacccccaatgatggaaagggagacgatgatcgtgatggtagacacattatcgatactctactatga

SEQ ID NO: 23427 - DNA, 429 bp, Glycine max
  Peptide Sequence Number=SeqID_115112
atgaggctaaatcttgaagtgctaaaagtggtagttgcgctcagctcaccatttgggctcagcgcgcatccattgctaagcgtagcttcagtgcgcttagcgcgacagaagaatctggaagagcatcaatatctaggccatgcacgctgttctcgtgctaagcgcaacggttgtcttaaggcaggctcaacgcatgacaagcgccaagctcaaatccacttactcgcgctaagcttgagcttagctcatcagtgggctaagcgcgcatccatcgctaagcacagctacagtgcaacagaagaatctggcagggcatcaatatcaaggccatgcactaagcacgagatcaatgcactaagtgcaatagttgtcttcagccaggctcagcgcacgactggcgctaagctcaaatccacttactcgcactaa

SEQ ID NO: 23428 - DNA, 273 bp, Glycine max
  Peptide Sequence Number=SeqID_115113
atggaacaagaaggtggattatgtgatgggaaagaagttgatcagtttcatcaaccgtctggtagtaatgaggttgccattgctaatgaggatggtatttcatatggatcagagctcatagaggttgacaaaatggtgctctctgggatattttttggagacaggatgtccctaagttgcaggaatatctggaagaatttcagagagtttaggcatgtccattgctgtcgtttaaagcaggattggttgaaggatcaggctgctaataaatag

SEQ ID NO: 23429 - DNA, 531 bp, Glycine max
  Peptide Sequence Number=SeqID_115114
atggttaaggaggagtgtaaggaggtaagtgtctcctccaagaggttagctaagaaggaaagtcattttgaaataaagacaaatattaaagaaacttcccctcttagacaatcgccacatcttctcctttgtaaaaagacacttgttagcactgccacacctcttgggcttgaggttattccccaagtaaaggagttgttggatgaaggtttgtggtcaagggattcccacagacccaagagaataaaggtcattcccgattggctcactccaccaagtataagggaaatctggggctgccatgacttaacaaacttttacaaaaggtttgtcccatatttttccatacttatagcgccactcattgagttggtgaggaacaatgttccctcatgggaagatgtccatgaaaggggtgtcgagggaaagagcccaaaatatgaagaacctcgggatttgaggtcaaatcctttccaaggtggaggggatgatgcaatcctaccccgcaagggattggatagaagactctaa

SEQ ID NO: 23430 - DNA, 453 bp, Glycine max
  Peptide Sequence Number=SeqID_115115
atgcgcccatttacaatcaaggcagcttcgttacctagattatttacacgtacctccaaggtgtatttgttacttacatcacacacattcccttggctaaactcacatacatgcatactcaagcattttggggcaccaaaaattgcacatgtgcacatcttggcatttctaatacctacatacgcaaacttcatgatgaatcttgactatctacacaataagtttctaggcctaggacacatgcggggcaattactctagctctttcgaaaatgaatgcatgtcccaaaaatatgtgcaaaccaaattgccccatgggttgtttccctacaaaaatcacgcgctaatgccattgaggcatttcaccgaacacttggtgggcgcgcgtttaggcgtcaatagcaagagaacggggacaatgtggcatgccccattacttcaaaatgcattatag

SEQ ID NO: 23431 - DNA, 366 bp, Glycine max
  Peptide Sequence Number=SeqID_115116
atggcccgaggagtcacctcaaattccttgacttttgagtcctttagcctagccattaacttggcttacataaagaagaacagctggaacttggacgacccaacggtcagctttccagggaccccatcagccaattatgagcatggagcagttttctttgcaggtggcctggccaagagtctagccttcttctcatggaggagaggccactcccccagagtcatttgtaccagaaacggatccagaggcaaatccagtgattgtggaggccagtccacaggcatcaccagtatctacaccaatattggagctgagcaccccgtaaggatcaccagcaggcacgcctgtgctgcacttgaccgatga

SEQ ID NO: 23432 - DNA, 516 bp, Glycine max
  Peptide Sequence Number=SeqID_115117
atgcaattaccgcaagagcccttgaacaagagaccaagagggctcgcaaggaagagtatggccggaacaaatttcgcggagctctatggggtagcaatagtgaactcaagttgcgaagggaagaaagggaccagtcgcgagcacatggcatggtccaaaagaagcttgtctcagcgtttatgcgagacggagaccaacatgctagctatcatcgccaagtaccaagaagagttaggtctagccgcggcccacgagcataggattgcggacgaatatgcccaagtatacgcggaaaaagaggctagaggaagggtgatcgactctttacaccaagaggcaaccatgtggatggatcggtttgctcttactttgaacgggagtcaagaacttccccgattgttagccaaggccaaggcgatggcagacacctactccgcccccgaagagattcatgggcttctcggctattgtcagcatatgatagacttaatggcccacataattagaaatcgttag

SEQ ID NO: 23433 - DNA, 341 bp, Glycine max
  Peptide Sequence Number=SeqID_115118
ggcttaaaaatggagacaggatgttaagatggcctctgggagataggacactggtaatcgattaccttttaggtgtaatcgattacacagtggaatttgtaggtttctatgtgcagaagttgtgtaactcgagtttgagcactggtaatcgattaccagagaggaaatcccttgagaaggatattttgactatgcgtagccgttatggaacgcattgtattgttgcctggagtttgggagaccctcgaaggcaattagaggtgccgattccgtggcacgattcgactcactgctacttcattggtacatccagaggaaccagcacgcacgcttcagcagct

SEQ ID NO: 23434 - DNA, 327 bp, Glycine max
  Peptide Sequence Number=SeqID_115119
atgacaccgaagtatcctgacccccgtggcgatgagtacgtactggcgcttaagataggggctctcactaacatattcgccgataatgcttcttacgaccgtctcacccccagccgcagaaaccgtgtcccttccttcggcacggtgagcatcagtgcgctgcaatatcacttaactccaattcacacccatgcgttgcaactcgatcggcacggtaatagcgcaccacatcgcccacaatcagtaacgacggcgacacccggtttttgctgttcaacagtttcaggcaacccggccagcgtggtgatcagcacccgctggttctga

SEQ ID NO: 23435 - DNA, 210 bp, Glycine max
  Peptide Sequence Number=SeqID_115120
atgctacaatgcgaaaggtatatctctcagctcaaagatgatatcaaaatttccaacgtgctcaaatttcacgacgatccaacggtgaaaaagtccgagatcgtcatttttctgagacaggttaggtggcctacaggaaagagagagggttttaggagaagagagaagaaacgaaattgtgaagtagaggaggcggaggagtcagtctga

SEQ ID NO: 23436 - DNA, 272 bp, Glycine max
  Peptide Sequence Number=SeqID_115121
ggaaagctgctgcttcaggtgctgtgtccaaggatgccttgattgccgaactcagggacacatgcaaggtgctggaagcaaccatcaaagccaccacagagaagaaaatggagctggaacgcctgatcaaaaggctctcagacagtggcattgatgatgaagaagcagctgaggaagaagaagaaactgaggaagaagaagaagctgctgaggaagaggaagatgcagcagaggatactgaatcagatgatgattctgaagccaccccatga

SEQ ID NO: 23437 - DNA, 264 bp, Glycine max
  Peptide Sequence Number=SeqID_115122
atgaaatctataccccagacatcaaacacctcacaaaatagcataggttgccgaggcatttgttgtcgccatatcttccacgcatctttaaagatggtaaagggccaattaaaaccatcaataagcaatctggacaaatgcttgaaacccagagaaccggtaggaagaagaaagaactccctaagtcatggtggaggaagtcagtctcagggtggagtaaggaacccgtctaatgacctgtccaccacaatttccacaaagtaa

SEQ ID NO: 23438 - DNA, 547 bp, Glycine max
  Peptide Sequence Number=SeqID_115123
acctactgatggagtgatagatattgatgtttctgagcatcaaattgccaaggaaatcactgccaaacgagtccagcattggccaaagaaagggaagctttcagcagggaagctaagtgtgaagtatgcaattctacacaggattggtgctgcaaactgggtacccaccaatcatacttccactattgccacagaatcatttgctgtcaaattacccattgccttccctactgtattgtgtggcattatgttgagtcaacatccaaatattttaaacaacattgactctgtaatgaagagagaatctcctctatccctgcattacaaactgtttgaggggacacatgtcccagacattgtctcgacatcagggaaagctgctgcttcaggtgctgtgtccaaggatgccttgattgctgaactcaaggacacatgcaagcagctgaagaagagaagaagcagccgagaagaagaagaagctgctgaggaagaggaagacgcagcagaagagacagaatcagatgatgattctgaagccaccccatga

SEQ ID NO: 23439 - DNA, 276 bp, Glycine max
  Peptide Sequence Number=SeqID_115124
atgaggctgaggcgctaccgaatcatgaccgtaattgatttccacatcgttctttgttcgacgttcttcgttcgtcatccagttagtatttatttgaagtatttgaatacaatctattcacccttatgggacctctttgttgatttgtacatcttcaggtgcacccttgaatctcgcctcgccctcccgctaaagggtaggttgcgacaatacccgttagacatagtattttcttcacctgatagtaactttttggcaacgtgttttcctctataa

SEQ ID NO: 23440 - DNA, 423 bp, Glycine max
  Peptide Sequence Number=SeqID_115125
atggtgaaagttggaacctcttacgtgccgatcaacgtcttcattttcgccaaaaattggcccagggcttcccggtatcaacagggacaccaggatttatttattctgcgaagtagtcttccgtcacaggtgctccagtggcttctgtttctatcagctgtcccctcctgttcagctactgacgggggtggtgggcggtcaccgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccagtcacgacgttgtaaaacgacggccagtgaattgtaa

SEQ ID NO: 23441 - DNA, 234 bp, Glycine max
  Peptide Sequence Number=SeqID_115126
atgaagctcctcaagaacgttcagactgggtgcggccatgcattcctgattttccattgggaaagtggcaagtcgtggaacgacccgaagcttccatggcgggcacaatatctgataacgagtcttgtgaaaaaaggtactaatactgaggaccctgctgttgattttgaacgagaagcgaatcggcctgaggttgataaagatgaaggtatggaatttccccctaagctataa

SEQ ID NO: 23442 - DNA, 845 bp, Glycine max
  Peptide Sequence Number=SeqID_115127
atgcctcaaaatgttctttacgatgccatgggatatatcaacggtgttggaacctcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatatcctcgacgccttccgccagcaggtggcggaaccgggcctgaccttcaaccccggcctgatcctgggcggcaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 23443 - DNA, 128 bp, Glycine max
  Peptide Sequence Number=SeqID_115128
ggaaaactgccagggaaccacatttcaagcgaaacctcaaagagagttgggcttcgtcctcaaaaggaaacaacaccagaaaatctagccttccatggattcaaacagaaaacgcggggatcctctag

SEQ ID NO: 23444 - DNA, 309 bp, Glycine max
  Peptide Sequence Number=SeqID_115129
atgtttaacacccatcggggtggaatccgtaaagttccgagatgtttcagtcagaaaccggcccaaaaacacaaaaacgggagtgatttagcaaaaaggcttaacactcatcgcggtggaatccgtaaatttccgggacgtttcaaaaagaaaacagccaaaaacacaaaagcaggggtgaacttatcaaacatgggggtgcgctcaagaaacttcatccagaacattctagaaggaatcatcctcaagaagcctctgggcggcaaccacctccattttgttaacaaatggcatccggggcttccgtaa

SEQ ID NO: 23445 - DNA, 324 bp, Glycine max
  Peptide Sequence Number=SeqID_115130
atggttatctatttccctcatgccacttctgttgattttgcatcacttttcccaaaaattggcaatgctgacattcatcaaggttcaaactgtgacttcactgctctgttggctaggtttatgacatctcttgttattgatgtacccagccaggctcactggattactcagcttacaaaatatgactctggaggtcaacaggacatcttgttacttcagtacctagatgtaacaatcaaagacggttattatgtaataatcgtctttgaatgccaaccgagatgtaacattcaaagacggttattatgtactaaccgactttga

SEQ ID NO: 23446 - DNA, 578 bp, Glycine max
  Peptide Sequence Number=SeqID_115131
atggcagatgtatacccagctctcgaggaagttcatgggcttttcgattattgccaacatatggaagtgcaagagcagatgaaggccaatataaaggccatgaagaaccaaatgacctctatgatggaggccatgttaagtagaaggaggatgatggaggacaatgcagctgcaacgaccacaaccagtgccgccactgaggcggatccggctcacccattcggcataaaccaaacaagccgtctagtcccagacatggtagtcagggaggagaagtattgggcagtatgggcggtcctcatatgcgagaatgccaaccactctgttcctatactccttgaaggccaacaaccccagatagggcatgtgccctttactcaacctatgggagaaacccgcaaagagccctgggatcatgctctgggcgagttcgaaccataccctacatatgtcatagagggaccaacatttagtggcatgcctcagcataatgccttgggggcccctcaacaccgcccgctgcaacccctacatttctcggtagggagactacctccagccatggaagaaagaaagaa

SEQ ID NO: 23447 - DNA, 189 bp, Glycine max
  Peptide Sequence Number=SeqID_115132
gaatttagaattcctgtgactggtcctgggtgtcctgtgtctgaacatcctcctcatctgtcagatgaagtgagggttggtccaccactggtgatgcaatcctaccccgcaagggcattggatagaagactccaagtaaattgggccaaagatgcaagagaaggccctagggttctcatgagccttagg

SEQ ID NO: 23448 - DNA, 405 bp, Glycine max
  Peptide Sequence Number=SeqID_115133
atgtctgtgaagatgcggactacctgcacctggacagaaagaccctatgaagcttcactgtttcctgggattggctttgggcttttcctgcgcagcttaggtggagggcaaagaaggcctccttctgggggggccagagccatcagacctacgggccgagggacagtctcaggtagacagtttctatggggcgtaggcctcccaaaagggttgatcttcccccaagagctcacatcgacgggaaggtttggccccctccgatgtcggctctccgccacctggggctgtagtaatgttccaaggggttgggctgttccgcccattaaagcggtacgtggagctggggttcagaaacgtcgtgagacagttcggtccatatccgggtgtggggcgttagagcattga

SEQ ID NO: 23449 - DNA, 459 bp, Glycine max
  Peptide Sequence Number=SeqID_115134
atgccaaggaagggattgacctttttaacgcatattcagtcgtaccggcatggccccactgatttgttttcgatcagagcatcaagcagcgcaacccgcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 23450 - DNA, 291 bp, Glycine max
  Peptide Sequence Number=SeqID_115135
atgggtgaatttagagtggctgtatttaagtttaagtgggtcaatgcgaataccagtgtgcatcaagatcatttgggatttactttagttgaccttaataaggtggcttacatggaaaacctttcattatggcagaataagccagacaagtcttttacgtcgaagatccatgtgattcaagattgtcaatggttctacaaggaagagcaagtggtatcagtcacgaaaatgatgattcaacacttgacatttgtgagacgcctgctttttgcaaatgaatgccttctataa

SEQ ID NO: 23451 - DNA, 404 bp, Glycine max
  Peptide Sequence Number=SeqID_115136
ggcttcccggtatcaacagggacaccaggatttatttattctgcgaagtgatcttccgtcacaggtatttattcgcgcaaagtgcgtcggctgtccctcctgttcagctactgacggggtggtgcgtaacggcaaaagcaccgccggacatcagcgctggcaagtgtagcggtcacgctgcgcgtaaccaccacaccccgccgcgcttaatgcgccgctacagggcgcgtcccattcgccattcaggctgcgcaactgttgggaagggcgatcgtcacgacgttgtaaaacgacggccagtgaattgtaatacgactcactatagggcgaattggagctccaccgcggtggcggccgctctagaactagtggatcccccgggctgcaggaattcgatgatgtga

SEQ ID NO: 23452 - DNA, 255 bp, Glycine max
  Peptide Sequence Number=SeqID_115137
atggccatttggttggagatgaggcacgacaagaggtcttcgtacgtcattgggatcaggggtaattctggaattggcttcgggggaaagtttctcatcgcgttggaaccggcaccaaagtgggcattgccgaccgagcgggtcgtggttggagtcggagcttggggggcttccctttggatgggggcgggcgttctaggctgcgcgggtgctgaattggaggagttcccgacgcgagatgagaagctcggatga

SEQ ID NO: 23453 - DNA, 255 bp, Glycine max
  Peptide Sequence Number=SeqID_115138
atggaagaatgtaaagttgtcatgacaaggagcaaaatggcaacccatgtggatgaaagaaaagttgacaagaagatggaggaacataaacaacaactggctgatgaactgaagctggaaccggttgatgatttagttgaacttgaagaaattgttgaggaagcagaagtgctgttattcaacgcattcttccacccaagcacaaagatgcaggagttgtcacgataccgtgttctattggtgaggttgctatag

SEQ ID NO: 23454 - DNA, 381 bp, Glycine max
  Peptide Sequence Number=SeqID_115139
atgacattgctacttagcaatattctgcccagcgaccgcatgccaatcctccccctgcaaaagtatcagttggtctgtgtcgtcccgacatggggatcgcacccacaaagacacccagtggacctgaagaaatccaacagggccctagggtttccagctctggttacgggcctctatcggccctatagggcgctcgtccccccagcaagctcatgccatcatgacatggggattgtgcccgcaagacacctagtggacccgaagaaggccaacagtgtcttggagttgccagctctaaatacgggtctctatcagttcaagggagtgcctgttgcccccagcagggtcatcaggccccctaccaatcgagttttcatctag

SEQ ID NO: 23455 - DNA, 440 bp, Glycine max
  Peptide Sequence Number=SeqID_115140
ggagctgagaacggcttccacatccaaggaaggcagcaggcgcgcaaattacccaatctgacacggggagttaaaaagctcgtagttggaccttgggttgggtcgatcggtccgcctccggtgtgcaccggtcggctcgtcccttctgccggcgatgcgctcctgtccttaactggccgggtcgtgcctccggattctgatcctattgtgttggccttcgggatcggagtaatgattaacagggacagtcgggggcattcgtatttcatagtcagagataccgtcctagtctcaaccataaacgatgccgaccagggatcagcggatgttgcttttaggactccgctggcaccttatgagaaatcaaagtctttgggttccggggggagtatggttgcaaggctgaaacttaaaggaattgacggaagggcaccccagga

SEQ ID NO: 23456 - DNA, 366 bp, Glycine max
  Peptide Sequence Number=SeqID_115141
atgtcccgagtcgatcggcggaccggctctcaccgttccacgtcccggttcaggaattttaacccgatccgggacacatcgcgcccatccgggcttccctcccgacaatttcaaggactctttgactctcttttcaaagtccttttcatgctttccctcgcgccttggacggaatttaccgcccagattggggctgcattcccaaacaacccgactcgctcgacacgcctcgggtgcgacagggtcctgggtttcacgaccggggctctcaccctctctggcgccccctactcatcggggacttgggcccgccggcccgaggataggtcgcgcgctttagcgccagactccaattttcggggctag

SEQ ID NO: 23457 - DNA, 363 bp, Glycine max
  Peptide Sequence Number=SeqID_115142
atgtcttatgtcatttacacaaagccaatagagttggcatgggatggggcgaaatttgggttacctaattccacaaatggttttttcatcacacatgtagatgtgactgaaatcattttaggagacaaatggtttatgaatgattggagtacaagcattggttttgctccagtgtattgtttccttgagccccagtctatacgttgcgcaaaggacacgcatgaagaatgtcaacaatacatagaaacgtgggtcagggaatcacatcaggaagtctacttaggaccttacttgaatcatgcaatgaagaaaatatgcagtaatttccaaggcaaggacaatgcacctccacctccaccttaa

SEQ ID NO: 23458 - DNA, 486 bp, Glycine max
  Peptide Sequence Number=SeqID_115143
atgatacgcggagataacttacggttatccgcatccttttgtcatccagaggcggcgggcccgatgacaagcagagaccaagtttggtcattctgcacccttgtatcatccagaggcggcgggcccgatgatacgcggagataccttacggttatccgcacccttttatcatccagaggcggcgggcccgatgatacgcggagataccttacggttattcgcacccttttgtcatccagaggcggcgggcccgatgacaagcagagaccaaagggcggcgggcccgatgatacgcggaaataccttacggttatccacacccttttgtcatccagaggcggcgggcctgatgacaaggcagagaccaatttggtcattctgcacccttgtattcatccaagaggcggcgggcccgatgatacacggaaatacccgagtggttatccgtataacattcttttgctatctgtaagacagaacgcttga

SEQ ID NO: 23459 - DNA, 243 bp, Glycine max
  Peptide Sequence Number=SeqID_115144
atggaggagacacatgaaattccccacaacaatctagccgacttcgagccttgcctcggatatgccactgaaaggagcaagcagttgggtggtatacccctgcaaaacactttggagggccctaagtatcacccacaaccacacctcttgcattccacagtgggtagaaaccctcatgctatggcggaaatgggaaagttggatcatctagaggaaaggctcaggaccattaaaggaggttga

SEQ ID NO: 23460 - DNA, 1149 bp, Glycine max
  Peptide Sequence Number=SeqID_115145
atggccaatcaaggagattgggtcccgtttatggatgtgttagctttgctaatttttggggtcgtcctctttccaaacgtggatggtttggtggacctagcagcaatcgacgctttccttgcataccaccatagcaaggaaagttcggtggtagctgtcttggcagatctatttgacacatttgaccgaaggtgcgaaaagagtagcgcacggatcatctgttgcttgcccgccctctgtgtttggttggtttcgcacttgttccaacaagacacaaggcatccatgtccgctcctgagccatcgctcgtgtactgaaaagaggagaatagattgggaccagcttttggctgggataggaggtagaacaatcagttggttcccccgatggaaggaaggaaaagaaggagtccttttctcatgtggaggatacccaaacattccactggtaggaacgaggggttgtattaactacaatcccgtgctcgctataagacaactagggtaccccatgaggggagcaccgacggaagaaagcatgtctcctttcgagaaagatcaagagcttagaggcattcgtaatggcatcattggtgggtaccacgaatggctgaaagttcatacacgaggtttagattggctcgccaagttaaaagtcgtcagcgaagagagttttgaagcaccggaagaggacgaagaagtccaagctctcaaaagcgagttaggagaggcaaagcttgccaaggagaagttcaagttggccgctacacacgttcggaaggagtgtgccgggttacgggaagagaatgcaattaccgcaagagccctcgaacaagagaccaagagggctcgcaaggaagagtatggccggaacaaatttcgcggagctctatggggtagcaatagtgaactcaagttgcggagggaagaaagagaccagtcgcgagcccatagcatggttctgaaagaggagttaattgcttgttcaaggtccaaaagaagtttgtctcagcgtttatgcgagacggagaccaacatgctagctatcatcgccaagtaccaagaagagttagatctagccgcggcccacgagcataggattgcggacgaatatgcccaagtatacgcggaaaaagaggctagaggaagg

SEQ ID NO: 23461 - DNA, 408 bp, Glycine max
  Peptide Sequence Number=SeqID_115146
atgggttctccacctgcctccactcctcctcctcctcctccttctcctccttctcctcctcctcctcctcctacttcggacgcatcagcttcgacgtctgccgtgaagcggacacgcaaagcctcacgcctacgatcgttgtccactagaccacctggtgttgagagaccagtggtgcatgttgatcctactacagggaaggccgacggtccccacaagaagaaattaagaacatatttggggattgtggcacgtgataaggtggacatcacctacgagaactggaaggaggtccctactgctcagaatgacctgatttgggaggatattcaggcggaatttgatatcccagaggcttctgacagtaggacgaaaaggaagttactacagaccatgggggagagatga

SEQ ID NO: 23462 - DNA, 348 bp, Glycine max
  Peptide Sequence Number=SeqID_115147
atgctttctcataagggtggacccttgggtactagtaccctcaccttcggaggactacacgtcctcccctccagaggactacgtgtcctcgcctttagaggactacgtgtcctcgcctttagaggactatacgtcctcgccttcatagggctacatgccctcaccttcagaggactacacgtcctcactttcagagggctacacgccttcgcctttagaggactacgcgtcctcgccttcaaaggactacacgtcctccctttcagagggctacacgtcctcgcctttagaggactacgcgtcctcgccttcaaagggttgcacgtcctcacctttagaggactgcac

SEQ ID NO: 23463 - DNA, 336 bp, Glycine max
  Peptide Sequence Number=SeqID_115148
cgagaggacgcggaaaaatgcgcaaaagctgacgacggcgtctccggaagacccgtaggggtctccggaagtccggaagaacctgttccgggaaagttccggaagaagtgtcttccggaagtaaccaaacgtcttccggaaagaacacctcttccggaagacttccggaaaacctcttccgggaactttccggaagaagtggttcatccggaagaattccggaagactcgcacttccggaagaagtttcaaacttccggaagacctttccggaagaacccttcttccggaatgtttccggaagaaccacttcttccggaaattttatgaaaaatga

SEQ ID NO: 23464 - DNA, 273 bp, Glycine max
  Peptide Sequence Number=SeqID_115149
atgactgttgcaaacagtattaagacaactctccctaaaatcgaaagtgctaaaaagtttatgtggaaaacaagacaaaacatacaaagtcaaaggaagttgcaaagggaaactcagcttcttgaaattgtgcatactgatatttgtggaccttttgatgttagttctttcggaaaggaaatgataatctttatcaccattttttgcatgattattcacgttacagttatgtctacttactgcccgagatttcttaggcaatggatgccttag

SEQ ID NO: 23465 - DNA, 198 bp, Glycine max
  Peptide Sequence Number=SeqID_115150
atgaagccacaccaagaagagatggaaatcgtgaacttgggtgttggcgaggaaaagaaagagctaaagatggcgtcggaggacatggagaagactatgttcgtcaccctgtgggaacatttgctacaaggtgatgtcctttgggctcaaaaatgttggggcaacctatcaacgagctatggtagcattattccatga

SEQ ID NO: 23466 - DNA, 346 bp, Glycine max
  Peptide Sequence Number=SeqID_115151
aacggcaaaagcaccgccggacatcagcgctgcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgatattcaggcgcataatatatggagacgctcgaaattgaactacggaagctctcgagaaatttaa

SEQ ID NO: 23467 - DNA, 93 bp, Glycine max
  Peptide Sequence Number=SeqID_115152
atgggaggagaggaagcgtttttcgcttacggaagaaccttcttccgtatgcgtgattgtctgaaaatgcttcgtgcggaagaaggttcttcc

SEQ ID NO: 23468 - DNA, 369 bp, Glycine max
  Peptide Sequence Number=SeqID_115153
atgtctcttgccactctctttggaaaacttcaagaacatgaaatggaacttatgagacttcatcaacatgaagagaatgatataaagagaaaaggaatagcactcagagcctcatcatcttttattcaagaagaaagtgacaaagaggacttaactgaaacagaagaagatgatgatgatgattcaactctttgtgaaaagggaatcaacatcaatacaaagaagaaagaagaagactcctccttagccccaacatgctatgaaagcaatcaacctaggcacatgagattcgattatcttgtctttgaaagaagaattgaaaaatccgacaagaggaatctcaaagaaaagaaagaaaagaaagcataa

SEQ ID NO: 23469 - DNA, 226 bp, Glycine max
  Peptide Sequence Number=SeqID_115154
atgaaggcagggatcaccacaacctggagctttataagggggttctataaggttcacgccccgtctaaggctcgaccgagctggtgctgttacgttaaggtaaggcttgagaaggtcagggactacggtaatggaccgctggctcttgttcatcaagtcgatccggaagaagtcagattgagtatgaaccaacgagccaaaggtttatgctcgccacgggaagcag

SEQ ID NO: 23470 - DNA, 261 bp, Glycine max
  Peptide Sequence Number=SeqID_115155
atgttgacgttgactgccacatgtcaacgtctgataggtgcaagggaaaattctgctagacatactatgtttgaagaactgaagaacaatagaccaatagaaaaacccaaagtggaattgaaggctctacttgcacacttgaagtatgtattcttggatgacaatgaagccaaaccagtcataattagcagctccttgaagaaggcagaagaggatcagctggtgcagattttgaagaagcacaaagcagcgattggatga

SEQ ID NO: 23471 - DNA, 1133 bp, Glycine max
  Peptide Sequence Number=SeqID_115156
cagaattgcaactgtggtcaagggttcagcaagaggtttggaccgcataaaacagactcggaacggcatagcgggcctaccacagaggtacctagaagacaaggcgaggggtatggccaatcaaggagactgggtcccgtttatggatgtgttagctttgctaatttttggggtcgtcctctttccaaacgtggatggtttggtggacctagcagcaatcgacgcttttcttgcctaccactatagcaaggaaagtccggtggtagctgtcttggcagatctatttgacacatttgaccgaaggggttgtattaactacaatcccgcgctcgctataagacaactagggtaccccatgaggggagcaccgacggaagaaagcatgtctcctttccttgtgagggatttcggcgcacaaaattccaagactatacaaagaatccataagcatgggaaaccccattggctcgccaagttaaaagtcgtcagcgaagagagttttgaagcaccggaaaaggacgaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagggctcgcagggaagagtatggccggaacaaatttcgcggagctctatggggtagcaatagtgaactcaagttgcgaagggaagaaagagaccagtcgcgagcacatagcatggttctgaaagaggagttaattgcttgttcaaagtccaaaagaagcttgtctcagcgtttatgcgagacggagaccaacatgctagctatcatcgccaagtaccaagaagagttaggtctagccacggcccacgagcatagaatcgcggatgagtatgctcaagtatatgcggaaaaagaggctagaggaagtgtgatcgactctttacaccaagaggcaaccatgtggatggaccggtttgctcttacattgaacgggagtcaagaacttccccgcttgttagccaaggccaaggcgatggcagacacctactccacccccgaagagattcatgggcttctcggctatt

SEQ ID NO: 23472 - DNA, 577 bp, Glycine max
  Peptide Sequence Number=SeqID_115157
atgtcctcgtcttcagaggactgcacgtccttgccttcagtggactgcacgtcctcgcctttagaggactacatgtcctcgcctttagagggctgcacgccctcgcctttagaggactacatgccctcgccttccgagcgcttcacatcctcgctttcagagggctccacatctgcactagtttcccgttatcagtcccttggtcagccccctgatctcggaggagggccaactgtgcgagcacaaccagagggaggctatcgtgcagccactatgcatactggggcaaatttctcccagccgctgcaaggagacgagggttgtgcccacaagacacccagtggacccgaaggagcccaacatggccctggggtttccagttctggttacgggcctctggatcgtgcccgcaagacgcccagtggacctggagaaggccaacagggtcttggagttgccagctctaattataggcctctgctaggtgaaacaccacagcagcctggggatggccggcagcgggcaacagacgcaccgccgccacctctagagttcacctcagctcatccacaaaaag

SEQ ID NO: 23473 - DNA, 321 bp, Glycine max
  Peptide Sequence Number=SeqID_115158
atgccaatctccccctgcagatgtaccgggatcgcgcccacaagacgccagtgggcccgaagaagtccaacagggccctggggtttccagctctggttacgggcctctgtagtcctacagggtgctcgttcccccgcgcaagggattgtgcctcaagacacccagtggacccaaagaagtccaacagggtctgggagttgtcaagctctaattatgggtctctgtcagttctacggagtgcttgtcacctccggcaagggcatcaggccccctactaatcaagctttcatcaagaagtactgcgtccccaggcaggcgtag

SEQ ID NO: 23474 - DNA, 258 bp, Glycine max
  Peptide Sequence Number=SeqID_115159
atggaaagaaccgagtatcgaacactcgggaaacttgtgttatttggaagccttcttaacaacaaacagaagaacaagatgaaagattgcaaaaataaaagtggtgaggatgtctccttcacctctagtatctcacaatcactcacaaactcatctcaagctctcaaaccggctcctgcttcaagctctggtctctgcagatcttcaaaaagcaaaatctccaaaaactctctggaacttggacgtttctctctctag

SEQ ID NO: 23475 - DNA, 555 bp, Glycine max
  Peptide Sequence Number=SeqID_115160
atgtcttccagaaaaagaaagagcattgatgcaaggcccacaactcaatatgacataagaagattccactccttcgaggcctggaccagatacacagataatgtgctaggaagacatatactagctgagaggaaggtagaaatataccatacggagttggatgagttcaaggctgaattggagaggcgtaacttccataagcgcctcaccaatttagctgacagcagcatcgacctagccttggtgaaggagttctatgccaacctttacagtcccaaggggccttcaccagaacaagtcagaatccgaggacacttgataaaaattgatgcagacagcctcaacaccttcctggagacacctgtggtactggctgagggagaatccttacccgcttactccagatactgcaggatgcccactgatatcggagagattgaggctgctttgccatcctgggaagatcctcaggaaagatctgacaactcttgctcaagttttagagtgttctctcatactccaacctggctccgacttcccacacctcggatttga

SEQ ID NO: 23476 - DNA, 447 bp, Glycine max
  Peptide Sequence Number=SeqID_115161
gcacctttggatccagataagtccaacagggccctgggatttcccgcactgatcacaggactctgccagtcattcggagttcccgttgcacctaccaaggccgcaggcgcgccaccaccacctcatcaggctggccaggctggggcatttgacatggagcagtatttacggcatttggtttgccagcaggcggccaaccaccgagcacatgtacagatccatgattgtctgtaccagatgagccttagcatgcagagccagggcttcgcttctttttcatgccctactccagaccagttcagggcagaggttgcatggcccggagattggcccgaggcccaagcaggagaggcacccccagaagctcccggcggtggagaagaggcccacgaggacgaggagatggccgatttgcttgacttcttgggagggagtggagatgcatga

SEQ ID NO: 23477 - DNA, 330 bp, Glycine max
  Peptide Sequence Number=SeqID_115162
atgggatcaagtcaaaagccttcgcttaaaaagaggttttatcaagtcaaaatcaagagcttagaggtcaccagtttacgaaagttggggcaattaatgggtcaacttcaacggcaagccttccgcaaagcctatggaggaaggaagccatatcttttctttgggttctatccctccacgacaagagttgccaaggtagtgaaaatctcagcacaagagttggaccgtgtaaagcaaaacagaaatggagtagttggagtaccaaggaagtgtttggaggaaagggcaaaggccttggaaaatcaaggcaaatgggctttcttttattga

SEQ ID NO: 23478 - DNA, 486 bp, Glycine max
  Peptide Sequence Number=SeqID_115163
atgagtcttcattcttcatctagtgttaatggtgagggttctactcctaaggaccccttgtataagatattagatgagttgagatcccttaagttgtggaaagaaaaacaagagagaaaagaaaaaggaaggcataggtcacatcttagacctcactcccataggagagaaaatgaaagaaagcctcaagaggctaacattaacctcccatacttccatgggaaggacaatgtagaggctaatttagattgggaaataagggtagagcaacaacttaaaaggaagtctacttcaaaatcttatggccctcactcttatccaaagaaagaccaaggtcaaggaatcttagggggccaagacatttatagtagccaagatgaggctactacttcaccttcctctagtaaaagtgaagaagcaaaaagggaagactctagtgaagagatctacccccaagaagaaggacaacctttaatggttaagtag

SEQ ID NO: 23479 - DNA, 53 bp, Glycine max
  Peptide Sequence Number=SeqID_115164
atgtgcggctaccttggtcatgtggctccactccctcccaagaaacctagcag

SEQ ID NO: 23480 - DNA, 522 bp, Glycine max
  Peptide Sequence Number=SeqID_115165
atggaggccatgatgagcatgaagaagataatggaagccaatgcggttgcagttgctgctaccagcgctgttgctaagatgaatccgatgcccccatctggcctcaaccaaatgaatcatccaacctcagatatggtaggcaaagatttgggaagtacggacggccccatgatgtgcaaattcaaaatgagcacgccttcctaccgtatggcttgcctcccaactatacaccacccaatgtggcatacactcctaagccgacaacctcatcacgtacatgtctctcaacccatgggggaggcacatgaaattccccaccacaatctagccgacttcgagccttgcctcggatatgccactgaagagcaagcagttgttgatatacccctacaaaacacattggagggccctcagtatcacccacaaccacacctcttgcattccacagtgggtaaaaaccctcatgctatggcagaaatgggaaagttggatcatctagaggaaaaggctcagggccattaa

SEQ ID NO: 23481 - DNA, 582 bp, Glycine max
  Peptide Sequence Number=SeqID_115166
atgaacgccgtcgaagaggacgggccatcagggacaaagaggttaggagacgtggctacttctagacgcttcatctatcaatcactgcaagcggcgtgcatggtctcccgaggtggagatgaaagggatgaatgtttgtttcaccttgggaagtcgcatgacatggaaacctgtcccgtggtggaagaattgcttcagcggctcatggattgcgagcagcttgaagtgttcataggagggaaggaagaaccacaaatttgcatgcagtcggaagagaagaaggttcctctaacccccaaggccctagtgatatgttttactagaaaagggaccggctccacacccatatacccacgggcggcgcccaagccaacgccatttgcatatcaaagcgataaggccgttccgtggaagtataccactctcgcgtccagcgaaagagttgcaaccgaagttgactccctatcagctaaggtaaccaacatcaccggccttagtggcgtaacccgcagtggtcgggtgttcgcttcccctcacctggtggaattgtcctctaaagggaaggcgcccatggtccaatag

SEQ ID NO: 23482 - DNA, 153 bp, Glycine max
  Peptide Sequence Number=SeqID_115167
atggtacatctcttgtggatcgaatttaagggagggtatccactggttgaaaggaaactgccaagggagggtacatccacttggtttcaaagcgaaacctcaagggagataaacgcaggaatggaagacatgagagagaggagacataaatga

SEQ ID NO: 23483 - DNA, 393 bp, Glycine max
  Peptide Sequence Number=SeqID_115168
atgccttttagaggcttgaaaagtgcgagaaaacgagctgtgttttctagaaaacgtgatgaactcgctaagcaagcatgctgcgctaagcgacttcatcaatactcattccacgcgctaagccgagcattcctgagccaagcacaattccttgcggcatttgctgagctgagcggcccttttagtgccgctaagcgcaacttatccttggctaagcgcaaatctatgcggctaaccttaggctttacgggctccttgccagctaagccaactttgcagacacgatggcctctaagaaacataggaatagcgattctagaccacaggatcagaatgataacaggagatttcaatcagaggaagcctggaatcgatatatcgataatattttag

SEQ ID NO: 23484 - DNA, 324 bp, Glycine max
  Peptide Sequence Number=SeqID_115169
atggcgacaccgccaagctcccctccgcagtcagatggtaatacgaaggcatcacctaagaagacaagacaaaccacacgtcttggaaggctgactttaagaactttagatcagcctagaccaactgttactgtcgatcttggaactggaagagcatcaagcccagaaaaacaaaagttctacagctatttaggggctaaatttgatatcctagaagcctcaaaggcgaagaaaaaggtcatgtccacggtggccactagattgaggcaatttaagtcttcactaaccactaaatttgtctatgctgacacagaaggcggatag

SEQ ID NO: 23485 - DNA, 306 bp, Glycine max
  Peptide Sequence Number=SeqID_115170
atgtcgcaacatgcccttttgcgggtgagcgaggcgaggctcacgggtgcacattccaaaggaggaaagatgcgcggagtcgccaccaacgtttatttgtggaaaacgtcggaaaaaccaaaggaaaccggtcataaagaatattccaagtcgacaaatgcggggctcttgctcctacgtaccctccatcaaagaggaaatcagacctacgtagttctctttaagggtgaatcaagcgattctttttacttggaaggtgatcattttaaggcgttggaccttaaaaatgatccatttacttggtaa

SEQ ID NO: 23486 - DNA, 150 bp, Glycine max
  Peptide Sequence Number=SeqID_115171
atgacgagtcccccgaagaagaacgtgggaagcaatttgacgctggttttagctaggccgtcgctcgggtatccagaagaggttgccaacattgtaccggtccgaagaaagagcgggaaagtcgaatgtgtgtggattatcgggacctga

SEQ ID NO: 23487 - DNA, 111 bp, Glycine max
  Peptide Sequence Number=SeqID_115172
gtgttgagggaaggagccccagagtatgaagaacctcaagaatttgaggtcaaaatcctttccaaggtgaagggaatgatgcaatcctaccccacaaagggcattggatag

SEQ ID NO: 23488 - DNA, 279 bp, Glycine max
  Peptide Sequence Number=SeqID_115173
atgaagagcaattgctgcttacacaagaagggggatccctcctcctcttcttggcacctcacaatcactcaaacactctctaatcactctgtcacaacctacccttcggcgggagggcgacgggggcgctcacgggtgcgtcctccaagaaaggaaaatgcgcggagtcgccaccaacgtttattcgaggaaaacgtcggaaaaattggaaaggtgtggtctacgaactttaaatgtgaaaggttcgggagttgtatttacgcacggggaaggtattag

SEQ ID NO: 23489 - DNA, 618 bp, Glycine max
  Peptide Sequence Number=SeqID_115174
atggggacaaatcaaaacggcaaacggttttatcaagtcaaggttaaaagtctagatgtcaccagcctcgaggaattgggacgattgatgggacctctcctaaggcaagccttccacaaagtgtacgggaagattctagatttgactgcagcggaggtatttacggaagctgtcgtatccctcgcccaatactatgaccagccgttgaggtgcttcacgtttggggacttccaaatggtaccgactattgaagagtttgacgaaatactaggatgccctcttgggggaagaagaccgtatcttttctccggctttcttccctccttgagcaagattgcagctgtggtcgggaattcggcaaaagagttggatcgcatgaagcaaactcgcaacggcgtagtaggcctgccacggaaatacttggaaggtaaggcaagggatatggcaagccaagagaagtggggcccgtttgcagatatactagctttgttgatttttggggttgtcctctttccgaacgtggacggtttggtggacttagccgcgattgacgctttcctcgcatatcaccatagcaaggagagtccagtggtggctatcttggcaggatttgtttga

SEQ ID NO: 23490 - DNA, 522 bp, Glycine max
  Peptide Sequence Number=SeqID_115175
cggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaagcagttcgctccaagctggactgtatgcacgaaccccccgttcagtccgaccgctgcgccttatccgggaactatcgtcttgagtccaacccggaaagacatgcaaaagcaccactggcagcagccactggtaattgatttagagggagttagtcttgaagtcatgcgccgggttaaggctaaactgaaagggacaagttttggtgactgcgctcctccaagccagttacctcggttcaaagagttgggtagctcagagaaccttcgaaaaaccgccctgcaaggcg

SEQ ID NO: 23491 - DNA, 309 bp, Glycine max
  Peptide Sequence Number=SeqID_115176
atgatgaggtcgatccggtgctgcatttctcaaccggctagaggcagagtagggctcgggagaagcaaaaccagtgcattgtatagccctattagtagtgatctggccctaagcgacgacactcatcatgctatggatcgcgagagaacgtcacgaaaaacactcgaaaacggaccgacgacaccccaggctaggagactgctgaccgttggctgccccttcccctacgcgccttcccgctccctactactagctactcctactattaaactgcctgctactacctgcccgcccatctactgcatatga

SEQ ID NO: 23492 - DNA, 468 bp, Glycine max
  Peptide Sequence Number=SeqID_115177
cgccaatacgcaaaccgcctctccccgcgcgttggccgattcattaatgcagctggcacgacaggtttcccgactggaaagcgggcagtgagcgcaacgcaattaatcccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 23493 - DNA, 381 bp, Glycine max
  Peptide Sequence Number=SeqID_115178
ggtgttacacagtggacccagagaagtacaatagggccctggggtttccagctctggttatgggcctctgtcagttctaccgggtgcccatcccccccagcaaggtcacgccatcgtgacataggtaaggatcgcgcccgcaagacacccagtgaacccggagaagtccaacagggtcttggggtttccagctctgattacgggcctctgttagttctacgaagtgtctgtcgcccccagcaaggcgcaggacgagacaccacaatagcctggggatggccgacagtggataatagacgcatcgtcgccacctccagagcccctcagctcatctacaaaggctggagcgttgcctacgacacatggctgaccaacgagtga

SEQ ID NO: 23494 - DNA, 540 bp, Glycine max
  Peptide Sequence Number=SeqID_115179
atgaagcacttcactgacacccctcatcagtgccaacatagtaagccagtatacactccgctagcgcccaatacgcaaaccgcctctcccccgcgcgttggccgattcattaatgcagctggcacgacaggtttccccgactggaaagcgggcaaatgtttggtatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 23495 - DNA, 309 bp, Glycine max
  Peptide Sequence Number=SeqID_115180
atgggagctagttccaggccgagggataatgctgattgggctggacagtggatgacttcagaacaaacacttcaatggcagaactttgtgttttgccccgttgcagatgagcccagagtatattgcagcaggaattgcatcctcaaattcaactgttaccagatggatgtgaagagatttctgaaggagtacaatgaagaactatgtggagcagccaaggggatttgtagacccaactcatccagatcatgtatacaggctcaagaaggctctctatggattgaagcaagctccaagagcttggtatga

SEQ ID NO: 23496 - DNA, 267 bp, Glycine max
  Peptide Sequence Number=SeqID_115181
atgtccccagtggagtcgccaactgtcgcaacgtgcccttttgcgggcgagcgaaggcgaggctcacgggtgcgccttccaaaggaggaaagatgcgcggagtcgccaccaacgtttatttgtggaaaacgacaaaaaaaccaaaggaaaccggtcaaaatgaaaattctaagttcgggagttgtatttacgttcgaggaaggtcgacaaaggcggggctcttgctcctacgtaccctccatcgaagaggaaatcagacctacgtag

SEQ ID NO: 23497 - DNA, 537 bp, Glycine max
  Peptide Sequence Number=SeqID_115182
atgcatgaaaaggctccgaaaaagctttcaacgaagaggtctaggagagatgccacagcagaagggtccaatgccgcccccgagtttgatagccaccgtttccgaagcgccgagcaccagcagtgcttcgaggccatcaaaggatggtcgttccacagagagaggcgcgtccagctcagggaggatgagtatacagattttcaggaggagatagctcgcagtcattggacgtcgctggtgactcccatggctaagtttgaccctgagaggagggagtgcgagacatgcgttcatgaatgccctcagccagttcctgggtcacccgctagttttggaggagggccaacagtgcgagttcagctagaggaggaccagggccgacgggttcgacgaggaggccattgcccagttgttatacacaccggggcaggatttcgcccggaccgctgcagggaggcgggtgcggatcatacgcaccagcatgaccaccttgacccagacgtgcatggcactgctgctcagcaatgtcctgcctag

SEQ ID NO: 23498 - DNA, 444 bp, Glycine max
  Peptide Sequence Number=SeqID_115183
atgccaatctccccctgtagatgtatcggttggaatcgcacccacaaagacacccagtggacccggagaagtccaacagggccctggggtttccagctctggttacgggcctctgtagtcctacagggtgcccgttccccccggcaaggtcacgtcatcatagggatcgcgcctgcaagacacccagtggacccgaagaagtccaacagggtcttggagttgtcaagctctaattacgggtctctgccagttctacgcagtacctgtcacctccagcaagggcatcaggcaggcgcagggcgaaacaccacagcagcctggggatggccggcagcgggcaacagacgcaccgccatcacctctagagttcacctcagctcatccacaaaaagattagagcgttgcttacgacccatggccgaccaagtccaaagtcaaaggtaa

SEQ ID NO: 23499 - DNA, 372 bp, Glycine max
  Peptide Sequence Number=SeqID_115184
atgccaatctcccccctgcagaagtatcagttggtttgtttcctgcccgacatggggatcgcaccccccaagacacccagtgaacctgaagaagtccaacagggccctggggtttccagctctggttacgggcctctatcagtcctacagggtgcccgtaccccccccggcaagggattgtgcctgcaagacacccagtggacccgaagaagtccaacagggtcttggagttgccaagctctaattacgggtctctgtcagttctacggagtacctgtcacctccagcaagggcatcaggccccctactaatcgagctttcatcaagaagtactgcgcccccaggcagacgcagggcgagacaccacagtag

SEQ ID NO: 23500 - DNA, 213 bp, Glycine max
  Peptide Sequence Number=SeqID_115185
atgtgccaagttcccgttcaccatggaacctttcccctccttcggcctcaaaagttctcatttgaatatttgctactaccaccaagatctgcaccggacgcccgctccgcccgggctcgccgccctgggttttgcagcgaccgccgcgccctcctaactccatcggggcttggtccttgcccccgacggccgggtataggtcgcgcgctttag

SEQ ID NO: 23501 - DNA, 492 bp, Glycine max
  Peptide Sequence Number=SeqID_115186
atggctagaacacgaggtttaggtcgtgctataggtagagttataggcagagatagacaggatgatcatgatgatgttcctgagaggcgtaggcctaccgcatcagcccgtaggcaacgagttcatcagatgactcaggatgttcctgacatgattgaggatgcccctgatatggttgaggatgcacctgagatgactgcggacgtacagggtgatgatggtgctgaggggtcacatgctgatgatgctgagggattcccaggtgggccacgtgacccatcagtgcatacatcatttgcagaccatgttgcacatgctgtttggagtggacaagtgacattgattgggaggccagtgcttgagattgaaggactggttggtgccacaggattaagtccactggtcgattgttcagttgttactggcgatcctggacttatatccgcatttgtggagaggtggcacagcgagaccagcaccttccaccttccg

SEQ ID NO: 23502 - DNA, 156 bp, Glycine max
  Peptide Sequence Number=SeqID_115187
atggcctcctatggtgtggcgtctcctctctctcttcctttctccattctgctgccattcatcttccaagaagcaaaggaatccattgatgaagaagatcctaggcctacaagctccaatggagcttgcatcattctatctcttctcattctctaa

SEQ ID NO: 23503 - DNA, 240 bp, Glycine max
  Peptide Sequence Number=SeqID_115188
atgaaaaattggccaaagattatttgtaacaaaattgaatatctttacctcagctttccagggactactcacactctccatttggagttttgtagttgtcgcaacctaccattcggcgggagggcgacgcgagggctcacgggtgcgtcttccatgggaggcaaatgcgcgaagtcgtcaccaacgtttattcgaggaaaacgtcggaaaaatcggaaaggtgtggtctacgaactttaa

SEQ ID NO: 23504 - DNA, 879 bp, Glycine max
  Peptide Sequence Number=SeqID_115189
atgggtcagctccagcggcaagctattcacaaagcttacggtaaaatctgggacttagccatggtagaagtctccacagcggccattgcctcccttgcccagtattatgatcagccgttgaggtgcttcacctttggggacttccagctatcacctatggtagaagaatttgaaaagatcctaggatgccctctagggggaagcaaaccatacctcttctcagggttctatccctcattagctagaatttccaagatagtccaaatctcggcacaggaattagaccacaggaagcaagtcgaaaatggggtggttggaataccaagaaaatatttggaggcaaaagcaagaatcttggcaggtaaaggtgagtgggccccgttcatagatattctcgcactgttgatcttcggaggagtcctctttccaaatgtggatgggttggtggacctagcagcgatcgacgcttttcttgcctatcataaccacaaggaaagcccggttgtcgctatgctagccgacttatatgacaccttcgaccgaagatgtgaaaagagcaatacaaggattgtttgctgtactccagctctttatgaaggaaaaaccagagttctattcatgcggaggatttccaaatgtcccttgatggggacgaggggttgcatcagctacaatctcgttcttgctataagaaaacttggctaccctatgagaggggcgccactagaggatgagctcgcacctgtcatttcacaaggcttcaataagacgaacgtggagacacttcagaaggcccacaaggcatgggaggtgttgcaaaaaaaggacaaggaactcaggggcagtaacaatgggcccatcggtggctatcgtaagtag

SEQ ID NO: 23505 - DNA, 336 bp, Glycine max
  Peptide Sequence Number=SeqID_115190
gtgctccagtggcttctgtttctatcagctgtcccctcctgttcagctactgacggggtggtgcgtaacggcaaaaagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaa

SEQ ID NO: 23506 - DNA, 1353 bp, Glycine max
  Peptide Sequence Number=SeqID_115191
atgtccagacggctcagaagaaccaaaatcgttaccaccctgggtccggctactgaccgcgacaataatctggaaaagatcattgccgccggcgccaacgtagttcggcttaacttctcccacggcagcccggaagatcaccaggctcgcgctgacaaagtgcgcgaaatcgccgcaaaactgggacgtcacgtcgctatactcggcgatctgcaagggccgaaaatccgcgtctccaccttcaaggaaggcaaaatcttcctcaacgtgggcgataaattcctgctggacgccaacctgtcaaaaggcgaaggcgataaagaaaaagtcggtatcgactataaaggcctgcctgccgacgtggtgccgggcgatgtcctgctgctcgacgacggccgcgttcagttgaaagtgctcgaagttcagggcatgaaagtgtttaccgaagtgacggtcggcggcccgctgtccaacaacaagggcatcaataagctcggcggtggcctgtcggccgaagcgctgaccgaaaaagacaaggcggacatcgtgaccgccgccaagattggcgtcgactatctggcggtttccttcccgcgcaccggtgaagacctgaactatgcccgccgcctggcgcgcgacgccggctgcaacgccaagatcgtgtccaaggttgagcgcgccgaagcggtctgcagcgacgaagcgatggacgacattattctggcctccgacgtggtgatggttgcccgtggcgatctcggcgtcgaaatcggcgatccggaactggtcggcattcagaagaaactgatccgccgcgcccgtaccctgaaccgcgcggtgatcaccgcaactcagatgatggagtcgatgatcaccaacccgatgccgacccgcgccgaagtcatggacgtggccaacgccgtgctggacggcaccgacgccgttatgctgtcggcggaaaccgccgccggccaatacccggcggaaaccgtggcggcgatggcgcgcgtttgtctgggcgccgagaagatcccgagcatcaatgtttccaaacaccgcctggacgtgcagttcgacaacatcgaagaagcgattgccatgtcttcgatgtatgctgccaaccacctgaaaggcgttaccgcgctgatcgccatgaccgagtccggccgcaccgcgctgatgatgtcacgcatcagctccggcctgccgatcttcgccatgtcgcgtcatgagcatacgctgaacctgaccgcgctgtatcgcggcgtgacgccggtgtatttcgacagccacaccgacggcgtgatcgccgccaatgaagccgtcaatcgcctgcgcgacaagggcttcctg

SEQ ID NO: 23507 - DNA, 746 bp, Glycine max
  Peptide Sequence Number=SeqID_115192
atggcggtaacctctacagcccaggcgtgtgacctggttattttcggcgcgaaaggtgatttggcgcgccgtaagctgctgccttccctgtaccagttagagaaagccggacacatccacccggaaacgcggatcatcggcgtcggccgcgcggagtgggataaaaaagcctataccgaagtggtcaaggaagcgcttggcaccttcatgaaggaaaaactggatgacgaactctgggccacgctgagcgcacgcctggacttctgcaatctggacgtcaacgacagcaagaactttaccaaattgggtaaaatgctggatcagaaacaccgcaccaccatcaactacttcgccatgccgccaagcaccttcggcgccatctgcaaagggttgggcgaagccaaactgaaccatgagccggcgcgcgtggtgatggagaagccgctgggcaccgatctggcgtcttcccacgtgatcaacgaccaggtggcggagtacttcaacgaatcccaggtttaccgtatcgaccactatctcggtaaagagacggtgctgaacctgttggcgctgcgtttcgccaactcgctgttcgcatccaactgggataaccgcaccatcgattcggtgcagatcaccgtggcggaagaggcgcgcatcgaagggcgctggggttacttcgaccaggccggccagatgcgcgacatgatccagaaccacctgctgcagatcctgaccatgatcgccat

SEQ ID NO: 23508 - DNA, 157 bp, Glycine max
  Peptide Sequence Number=SeqID_115193
ttgacatcctgcccttcattctcggttacaaggaagattacccttggcataagtatattgtgatgcaatcctatcccgcaagggcattgggtagcagactccaagtagattgggctagagatccaagggaaggccctagggttctcatgagccttag

SEQ ID NO: 23509 - DNA, 387 bp, Glycine max
  Peptide Sequence Number=SeqID_115194
atggttgcgtctcgagggagaggaagcggccgcaatagtagaggaggtcgcggtggaaggggtggacgtcctcattgcacctattgcaagaggataggtcacacccaagagagttgctattcattacatgggtttcctgacaaggtcgcacaggtttctaaatcagagaaagcagagtccagattctctgatgaggagtatcaggagtatttgaagctcaaatccgagaagcccagcaatcaagcacaaccctcgtctgtaccatgtttttcaacagcgtgtatctctcaatttattgaaggtcacagcccttggatactcgactcaggtgcctctgatcatatttctggaacatgggacggggcgactgattggagaaggatatga

SEQ ID NO: 23510 - DNA, 204 bp, Glycine max
  Peptide Sequence Number=SeqID_115195
atgacagtgagttgggctaagtgcgcatccaccactaagcgcagcttcaacatgcttatcatgatagaagaatctggcagagcatcaatatcaaggtcgcgcgctaagcgcgagatcagtgcactaagcgcagcagttatcttcagtcaggctcaacgcatgactggcgctaagcgcaacgtcacggattcagagcctatttaa

SEQ ID NO: 23511 - DNA, 297 bp, Glycine max
  Peptide Sequence Number=SeqID_115196
atggcttacgaacggggcggagatttcctggaagatgccaggaagatacttaacagggaagtgagagggccgcggcaaagccgtttttccataggctccgcccccctgacaagcatcacgaaatctgacgctcaaatcagtggtggcgaaacccgacaggactataaagataccaggcgtttccccctggcggctccctcgtgcgctctcctgttcctgcctttcggtttaccggtgtcattccgctgttatggccgcgtttgtctcattccacgcttgacactcagttccgggtag

SEQ ID NO: 23512 - DNA, 738 bp, Glycine max
  Peptide Sequence Number=SeqID_115197
ttcctcattggaggatacgtaggagcaaaagcctcgcttttgtcgaccacactgctttctgttaccatgacccaagagctggtagcccgcggagacaccttacggttatccgcacctcgagtgtgattgataagcggaggccaatatggtcatctggccctttccggagatgtaggcatcttctgatggagactttttcaagtctcacaagttatctagaactacgtaggtctgagttcctcattggaggatacgtaggagcaagagccttgctttgtcgaccgccccatatctttgtcatactgaccctgaggtcaaagacaaaatttggtcattctgcacccttgtatcatccagaggcggcgggcccgatgatacgcggagataccttacggttatccgcacccttttgtcatccagaggcggcgggcccgatgacaagcagagacaaaatttggtcattctgcacccttgtatcatccagaggcggcgggcccgatgatacgcggagataccttacggttatccgcacccttttgtcatccagaggcggcgggcccgatgacaagcagagaccaaaggcggcgggcccgatgacaagcagagaccaagtttggtcattctgcacccttgtatcatcaagaggcggcgggcccgatgatacgcggagataccttacggttatccgtacccttttgtcatccagaggcggcgggcccgatgacaagcagagaccaa

SEQ ID NO: 23513 - DNA, 209 bp, Glycine max
  Peptide Sequence Number=SeqID_115198
actttgatggctatggacttgaacttctcttcgactacccgggctctttcaagccacttatgatagccgccgatgatcccattactgcttcccctaagctctctgtcctttcttcacgccgcatcccatgccttgcgaactccttggagtaccctcaggttgtggtcactgaaaccccgtgcgatgaaaggcgtgatgctttcgtctga

SEQ ID NO: 23514 - DNA, 69 bp, Glycine max
  Peptide Sequence Number=SeqID_115199
atggaaggcttggatgactctttggaggtcccaactggctctgcacttagtctacacggtttacactaa

SEQ ID NO: 23515 - DNA, 345 bp, Glycine max
  misc_feature (42)..(42): n is a, c, g, or t
  Peptide Sequence Number=SeqID_115200
atgagtggttcccacgagtttgtgatcaagggttactcactnacgaaaggaatgggcattgggaaatacatcgtgagtgagactttcatagtgggagggttccaatgggccatatactttttccctgatggtagggaccccaaagataatgccgcttatgtctctgtcttcgttgcactccattccaagagcaccaacgttcgtgcgttgttcgatctcacgttgctcgacctatgcaagaaaggagagcacaaggttcatagccacttcagtcactccctcacgattgggccttacactctcataaaccatggcagcatgtggttagtaaaatcaagatattga

SEQ ID NO: 23516 - DNA, 345 bp, Glycine max
  Peptide Sequence Number=SeqID_115201
atgacccaagagctggtagcccgcggagacaccttacggttatccgcacctcgtcattcagtgaccccaagtgtgattgacgagcagaggccaatgtggtcatctgcgccctttccggggatgtcagcatcttccgatagagacttttcaagtctcacaagttatcaagaactacgtaggtctgagttcctcattggaggatacgtaggagcaagagcctcgcttttgtcggccaccctcacaagttctgtcatgctggcactggagtcacgtgacatgcggagatacccgagtggttattcgtatgaacattcttttttgctatctgtaagacgaaaagcctga

SEQ ID NO: 23517 - DNA, 255 bp, Glycine max
  Peptide Sequence Number=SeqID_115202
atggttcttcaattgattgcatcaaaccaagaagtatcaagcgctttaaaatcaagggtttaccaagtaattagagaagcatcatctttaaacagcgctcgtgagcaatctttacatattcctactttcagggaatcaatctcgctagctgttgaaatgcagcatactcacgcccttgcagaagtgctgactgttgtaacgagtgaagatatgcttgagcccaaccttgctaaacatgttttagagcatatctaa

SEQ ID NO: 23518 - DNA, 84 bp, Glycine max
  Peptide Sequence Number=SeqID_115203
atggcaggcaggcttatatttcttagtttcacgataggactccttacgaaagttaagcatctactataccaggaatatcaatga

SEQ ID NO: 23519 - DNA, 276 bp, Glycine max
  Peptide Sequence Number=SeqID_115204
atgccttatctcaatttgcatcccaatattggcaccttagatggtttccaagttgatggagaggttggtggcaatgagggaggggttgatgacttcaacaaagggatagatgttgaacaaggtgtcattggatttgatggagtagaaggtgttagcataggaaagggactcaaacgtggcattggcattgctgggtttctttgttgctgcaaaggaggtggagggagcaagggagaaatggataaggagagaggggaagaaaaggaagaggaatag

SEQ ID NO: 23520 - DNA, 336 bp, Glycine max
  Peptide Sequence Number=SeqID_115205
atggtgcacaaagccaacccgcatcaattagactttgcacctcatgcttcagggtcatacaatgctcaacagaatgccccagaactcctccatgataattacatgttgcattcgagtcgtatcctcggaaaaatggaggttgaggaatcttggctggggttatggctaccattgcattatcgagtagatatgggagtgtcataccctaatttcgtccgggaattattacttgttgacatgcaacctctggttagccgctttgagatacttggcgtcctttgttgcacaataaatgaagtcccgagacgtgtcataaatcaaaaggaagcaggctag

SEQ ID NO: 23521 - DNA, 81 bp, Glycine max
  Peptide Sequence Number=SeqID_115206
atggataagagcttaaaggtaggagaagataagtggagggagaaggagagaagtagcacgaaattttgtgcctcaaatgag

SEQ ID NO: 23522 - DNA, 45 bp, Glycine max
  Peptide Sequence Number=SeqID_115207
atggtcaattatttcagcacgaaatacagaaagatcttcagatgg

SEQ ID NO: 23523 - DNA, 207 bp, Glycine max
  Peptide Sequence Number=SeqID_115208
atgcctcaaaatgttctttacgatgccattgggatatatcaacggtgggtgcctccagtggcttcctgtttcttatcagctgtccctccctgttcagctactgacgggggtgggtgcggtaacggcaaaaagcacccgccggacatcagcgctggcaagtgtagcgggtccccgctgcgcgtaaccaccacaccccgccgcgcttaa

SEQ ID NO: 23524 - DNA, 853 bp, Glycine max
  Peptide Sequence Number=SeqID_115209
gtctgagttcctcattggaggatacgtaggagcaagagccttgcttttgtcgaccacaccaccttttgctgtcatgacccaagagctggtaacccgcggaggcaccttacggttatccgcacctcgtcattcagtgaccccaagtgtggttgatgagcagagaccaatgtggtctgagttcctcattggaggatacgtaggagcaagagcgttgcttttgtcggccgcccaacaagatcttcgtgtccgatggcacgcagagacaaaatttggtcattctgcacccttttgtcatccagaggcggcgggcccgatgacatgcggagacaaaatttggtcattccgcaccccttgccattccagacacagtcgtgtccgatggcacgccgagacaaaatttggtcattctgcacccttttgtcatccagaggcggcgggcccgatgacatgcggagacaaaatttggtcattccgcacccctttgccattcaagacacagtcgtgtccgatggcacgcagagacaaaatttggtcattctgcacccttttgtcatccagaggcggcgggcccgatgacatgcggagacaaaatttggtcattccgcacccctttgccattcagacacagtcgtgtccgatggcacgcagagacaaaatttggtcattctgcacccttttgtcatccagaggcggcgggcccgatgacatgcggaggcaaaatttggtcattccgcacccctttgccattcagacacagtcgtgtccgatggcacgcagagacaaaatttggtcattctgcacccttttgtcatccagaggcggcgggcccgatgacatgcggaggcaaaatttg

SEQ ID NO: 23525 - DNA, 540 bp, Glycine max
  Peptide Sequence Number=SeqID_115210
atgatacgcggagataccttacggttatccgcacccttgtgtcatccagaggcggtgggcccgatgatgcacggagataccttatggttatccgcacccttttgtcatccagaggcggcgggcccgatgacaagcagagacaaaatttggtcattctgcacccttgtgtcatccagaggcggcgggcccgatgatacgcggagataccttacggttatccgcacccttgtgtcatccagaggcggcgggcccgatgatacgcggagataccttacggttatccgcacccttttgtcatccagaggcggcgggcccgatgacaagcagagacaaaatttggtcattctgcacccttgtgtcatccagaggcgaggcggcgggcccgatgacacgcggagataccttacggttatccgcacccttgtgtcatccagaggcggcggggccgatgatacgcggaatacccaagtggttatccgtataaactttcttttgctatctgtagacagaacgcttgatagcatgcagagactgacatag

SEQ ID NO: 23526 - DNA, 809 bp, Glycine max
  Peptide Sequence Number=SeqID_115211
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggcgcatcgatctacgccaccgccaaggcggcggtgatgaccttcacccgtgccatggccaaggaactggggccgaagatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 23527 - DNA, 619 bp, Glycine max
  Peptide Sequence Number=SeqID_115212
atggagagaagtatgattgatgctgccagtggtggagcccttggagacatcacccctgctgaagccaggaatttaattgagaagatggcttccaactcccagcaatttagtgccagaaatgatgctattgtcattataggagtgcatgaacaatctggagcaattgaacagcctaaagcttatgctgcaaacatctacaatagacctcctcaacctcagcagcaaaatcaaccacaacagaacaattatgacctctccaacgacaagtacaatcccggaccagatgttcctccaccaatccagctacaacaacaacaacagaagcagcaacagccccagaaacaacaaatagttgaggctcctccggaaccttcccttgaagaacttgtgaggcaaatgactatgcaaaacatgcagtttcaacaagagaccagagcctccattcaaagcttaactaatcagatgggacaattggctacacagtcgggaaagcagtatcaaggacctcaactagtagcatcttcctcatctgcaaatgaacctgcccaacttcactctactccagaaaaagaggatgacaaaaatttaaaaagtaagttgcctatcaatttctatgcag

SEQ ID NO: 23528 - DNA, 474 bp, Glycine max
  Peptide Sequence Number=SeqID_115213
atgagttttcttgggtccaatataaaggatttgaagaacacctacccagacgtgcatatagagacatggagatttggtctgcatgtgaagctacaatttggactacaacaagatatccctgttgatcccatgaatcttgatctacttcaccaaattgacatgcgaggcaatcattacattgattggatggaataccatgcggaatggattaatatctggaaaaacaaacgcaatgatgttttagctggacaatgggttgaaggaatagtgacacatacaccagcgtacatggaatggtataggaaaaacactactttgttcttgtctgttgcacaacaactacatgatccatgcacaacgattacccataatgttgcagggctaggtgttgaacaaacacattttgaaatttcacatcctcagccaatgtattctactcccttcacttgttcatcaaacttttggccacactag

SEQ ID NO: 23529 - DNA, 727 bp, Glycine max
  Peptide Sequence Number=SeqID_115214
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatcattgcttttggggtaaggatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcgagatttcctggaagatgccaggaagatacttaa

SEQ ID NO: 23530 - DNA, 474 bp, Glycine max
  Peptide Sequence Number=SeqID_115215
atgataaggccacacgtagtaaaaatatgcgcgctatcgcgacccgcgatacggcaattgagaagcggtctggcggcgctgctaacgcaggccggattcacttttcgcgttcaggaggcatcgctaccggggcggcctgattttctgctgtctgactaccgctgcgttattttcacccatggctgcttttggcatcatcatcactgttatctgtttaaagtaccggcgacccgtaccgatttctggctgaaaaagattggcgctaacgtacagcgcgatcgccgcgacctggcgatgttgttagcacaaggttggcgggtgcttattgtctgggagtgcgcgctccgcgggcggcagaaattaagcgatgatgctttatgcgatcgtctggaggagtggatctgcggcggtggaaattgcgcgcagatcgacactcagggcattggttttatcgatccgattgacaaggcgtaa

SEQ ID NO: 23531 - DNA, 207 bp, Glycine max
  Peptide Sequence Number=SeqID_115216
atggaggattgccttgagggtcctcacttagccattcatgaacacagctccaaactcgaaagtggaggacacatgaacaggcctaggccaataacattaatggggctcgaaaaaagctccaaactcgaaagtggaggacacatgaacagccctaggcaaaacattcatggagctccggaaaaacctgagaatggagaattgccttga

SEQ ID NO: 23532 - DNA, 2063 bp, Glycine max
  Peptide Sequence Number=SeqID_115217
atcgagctggtgacgcgctgctgcgcgatttctacggccaggaagtggtgcggtactcggccaccaagcccgcgaccaggatctacgagaccaacgtggtggaggccacgagctatcacagcgtcaaacgcctcactgccgctgggaagcctggcgatctggctgtgcaagtcgataccccgtacgtgtccatcgtccctacctccacggctgaaaccccggtcagtgacgttctggccggcatgggcaccatcagccaggtcccgtccggccctgccggcagcctcggccagaacttcaatgcgagctttgctgctggcgtgccggtcagccgatacctcggtactgggttggtggtgggcgcaataagggttgtcgcaggcagtgtcgaacttaccgacgacggtactggcgggctcgcttccgccgtggcgacgccctggagcggtacggtcgactatcagggtggggtcgttgccttgacgcatgcgagtggcgtcggcagtaccagtatcagcatcaccgcgtccccggcgggttccatccccatgcagggcttcaccgacgagattgaggtgacgcagaacaaccagggcatggtctggctgttccaactgactccgttgccggccccaggaacggtggtggtcggctaccgcgccctggggcgctggatcagattgaccgacaacggccgcggccgtctgattggcaagccgggccaaggcactgggacgatcaactaccagaccggctccgttgtggtgaccgctggcgcgctgccggatctgaagagcagcatcatctccaactggggcactcccatcatcgcggaggcccgggttggtgatgctgccatcctgccgccggcgctccgctttgtgctgggcgagggctcggcggtaccggagacggtgcaactgacgctgcgtgtcggcggctccaatgttgtggtcacagataacgggaacggcggcttgctgattggcgggcaggttcgtggacagatcagctactcgaccggtgagatttcgctccggccgctgagtctgcctgatgcggacagtcagctctcgatcgcctacgactgggggcagccgctacacgcagcgccgcagcctgttccggacgcggccgggatcgtctcgttcaccctgccgcagggaccggtgaggcagggcacagtgcttctcgactggcttgtgagtgtgcggcgcgatcgcgatgacctgtcgtcggcccctcaggcgatgcgggttatcgccaaggatgatggcgcaggcaacctggtgggcgtttcggttggggatacggccttcagcacagtgctgggcgccgtgaactacagcacgggcgcggtctcgctgcaggcggggaagttcatggtccgtcaggtttcctatcccgtgtacgagatccgctccgggcgtctgaaggtggttggctacgagcgcctagacgtgctggcgcagttctccgccggcagtatcgtttcagccggttggatgctcgccggcgaggccgcccagtctgcgcaggaggccatgccgctgcctgcggtccagctgcagctcaccccgacgatcagcgacagcatcgttccgggcagcgtccgcttcgcattccgtgggcgaacgtacgtagaccgtagcggcggtctgtatcactccatcgatcccgccaccggctcgggcatctacgcaggcacgatcgactacgcggcgggtgtggtgaacctggtgcagtggctggcaggcggcgagaacactgtccagatccaatccctgctgacccggatcgccgacccgggcgtggccgtcagcttcttccgtgcgcccggttcaccgctgcgccctggcatgttcacgctgcgcgcgacccgcatcgatggtgagttgctcacggtgactgcggatatcaatggtgtgctgtcggctgcggaaattcgtggcaaggtcgattgggaaagtggtgtggtcaaggttcagttcggccagctggtgcccgtggccgggaacgagggcaagccttggtttgatcccgatcaggttgagggggatcag

SEQ ID NO: 23533 - DNA, 276 bp, Glycine max
  Peptide Sequence Number=SeqID_115218
gtgctccagtggcttctgtttctatcagctgtccctccctgttcagctactgacggggtggtgcgtaacggcaaaaagcaccccccggacatcagcgctggcaagtgtagcggtcccgctgcgcgtaaccaccacacccccccgcgcttaatgcgccgctacagggcgcgtcccattcgccattcaggctgcgcaactgttgggaagggcgatcggtgcgggcctcttcgctattacgccagctggcgaaagagggatgtgctgcaaggcgattaa

SEQ ID NO: 23534 - DNA, 613 bp, Glycine max
  Peptide Sequence Number=SeqID_115219
atggttatgggagatttcatcagcagactctccttccccgaaaacaccgagactttttcaagtctcacaagttatccagaactacgtaggtctgaattcctcattggaggatacgtaggagcaagagcctcgcttttgtcgaccacaccgccttttgttgccatgactcaagagctggtagccgcggagataccttacgagaccaagtttggtcattctgcacccatgatacgcggagataccttatggttattcgcacccttttgtcatccagaggcggcgggcccgatgacaagcagagaccaagtttggtcattctgcacccatgatacgcggagataccatatggttattcgcacccttttgtcatccagaggcggcgagcccgatgacaagcagagaccaaagaccaagtttggtcattctgcacccatgatacgcggagataccttatggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaa

SEQ ID NO: 23535 - DNA, 105 bp, Glycine max
  Peptide Sequence Number=SeqID_115220
atggtgctatcaagggtcttgatgatgctccacaacctaaatcaaaggcttctgctaggtggattgtcgtcatggagtaattacatgacccgtaaggttctgtaa

SEQ ID NO: 23536 - DNA, 315 bp, Glycine max
  Peptide Sequence Number=SeqID_115221
agagatcgcgctttacggtgtccttaccaaacgtgtgtcaaagctagagtgatgcgcgaaatagaggaggtgcaagagcagatgaaggccgacatggaggccatgaaagagcaaatgaccacaatgatggaagccatgatgattatgagaaaaatgatggaggtcaagacggctatagtcgttgttgcaagtaccgccactaaggtggacctgactcacccatctggcctcaatcaagtaaatcgtccagtctcagatatggtaggtcagggaggtgaagcgttgggaagtgtaggcggcccccattttgtgcag

SEQ ID NO: 23537 - DNA, 153 bp, Glycine max
  Peptide Sequence Number=SeqID_115222
atggaccgctcaacgtgcattagtggattttggcttagcgcttgcttttcttgctcagtagatgaagtgaagcgattcttcctcgtgctcagccaagagaatggtgcgctcagcggatggctcgctaagccagcagatgggcttagtaagtag

SEQ ID NO: 23538 - DNA, 285 bp, Glycine max
  Peptide Sequence Number=SeqID_115223
atggatcgggttgcatcgctgcttcgtctactgccaaacacatttaggactgttgatgtccttgttacttccagtttcacattgacaaaggaggtgcaagagcagatgaaggccgacatggaggccatgaaagagcaaatggccacaatgatggaggccatgatgagcatgaagaagataatggaagccaatgcggttacagttgccgctaccagcgttgttgctaaggtgaacccgatgcccccatctggccttaaccaaataaatcatccaacctcagatatg

SEQ ID NO: 23539 - DNA, 339 bp, Glycine max
  Peptide Sequence Number=SeqID_115224
aacctcctatcgaagaaaagtcgaagaaaaccctacactgttgttggaactgtgggtcgaagaaaaccctacactgctcttggaactgtgggtcgaagaaaaccctacattgctcttggaacagtcgtgggtgctcaaagctcaaagctttctacgctgccagttaacaagttgattgtgctttacgtggttttcaagcttgacgagagttacacgccgagcaaagtttccatccgtgccggtgatggttttcacaacttgaaggagattaagaccgtggaactcgtgaagccaactgggtgggtttatctatccttgtctggagctgatcctaggtaa

SEQ ID NO: 23540 - DNA, 240 bp, Glycine max
  Peptide Sequence Number=SeqID_115225
atgggttgtccctgtgtgcctatccctcgtaagattattgaggccacaaggtccaacaacaactcccaccgaatggatccacaggcgtcccaacaggcagctgtaaggggggttaatatccattatttgaaaggtaacctgacaggtgtgagggcctacctgtaccgagaggtcgatctctcccctaacctctcggagggtgccgtcgaaggcacgaactaccatggagcttggctttaa

SEQ ID NO: 23541 - DNA, 126 bp, Glycine max
  Peptide Sequence Number=SeqID_115226
atgaaaatacagaaaaaggtgttgagggaaggagcccagagtatgaagaacctcgggattttgaggtcaaatcctttccaaggtggagggaatgatgcaatcctatcccgcaagggcattgggtag

SEQ ID NO: 23542 - DNA, 1323 bp, Glycine max
  Peptide Sequence Number=SeqID_115227
atggtttgttttgggtttcgggaggggtcccttttttcttctgttgttgccaatgtaactcaaggccccccctgggggggccccctcaaccccgacccccaagggaaggtttttttttttctttttgcagaaactttttttggcccccgggaattttttccggaggttgagaaggaagaggaagattttgagcaaatagcgaaagaccttgaaaatgcatctcctcttgaaattatggatagggccctcgagaaatttgggaacgacatcgctattgcatttagtggtgctgaagatgttgctttgattgagtatgcacatttgacgggtcgaccctacagagtgtttagtcttgacactgggagactgaatccagaaacctacaaattttttgatgcggttgagaagcattatggaattcacattgagtacatgttccctgatgcggttgaggttcaggcattagtaagaactaaagggctcttctcattttacgaggatgggcatcaagagtgctgccgagtaaggaaggtgaggcccttgaggagagcccttaagggtctcaaagcatggatcactggacagagaaaagatcagtctcctggtactaggtctgaaatccctgttgtccaggttgatcctgtttttgagggactggatggtggaattggcagcctggtgaagtggaacccggttgcaaatgttaatggtctagacatatggagcttccttaggaccatggatgttcctgtaaattcattgcattcccaaggatatgtttcgattggctgtgagccgtgcacaaggccagttttaccgggtcaacatgaaagagaaggaaggtggtggtgggaggatgccaaagccaaggagtgtggtcttcacaaaggtaatataaaacatgaagatgctgcccagcttaatggaaatggggcctcccaagcaaatggatctgccactgtcgctgacattttcaactcccaggatgtggtcagcttgagcaggtctgggattgagaatttggcaaaattggagaaccgaaaagaaccctggcttgttgtgctctatgcaccatggtgccgcttctgtcaggctatggaggaatcatatgttgatttggcagaaaagttagctgggtcaggagtgaaggttgcaaaattcagagcggatggagaccagaaggaatatgcaaagactgaactgcagttgggaagcttccccacaatactactcttccccaaacactcttctcaaccaattaagtacccttcggaaaagagagatgttgattcattgacggcattcgtgaatgctttacggtga

SEQ ID NO: 23543 - DNA, 624 bp, Glycine max
  Peptide Sequence Number=SeqID_115228
atggcaggtgtcgaacctctcgacgccagcctggaccggctcgaggcagccatggccaacctcgccacagtggattccgatctccatgcatctcaccttcgtttagatgcgttccacacttccatgctcttcaaacttgatctccttagccggaaactggataccatgatttttcgccaacgtttcctgtttccttcatcggtgctgccaccatcgccgccgttgttgtcgccaccactgtttccttcttcggcacagccaccaccgctgccgtcgctgccagctcctccgtcaaatgcttcttcttaccaccccagccagtaccctcctccacctcgctctcacgtgcctccttccatggctggacaacgagatggtcctgttattggaatcgattctagcactatcgacttccccgtcagcgtgtggcagcaccatcgtgtcacaatcaaccaccacttccagtccaaccaggtgttgcctttgccactccgcaccgaccaccgtcgttactataagatcccctacaacaatgacatcatcctgcacggggaccccgtcgtcgcgcaccagattcatcagcgttggatttgggtttttttcacttttgagactcagcgttga

SEQ ID NO: 23544 - DNA, 852 bp, Glycine max
  Peptide Sequence Number=SeqID_115229
atgaagaacaagaagggtgaagctctgagtgagacttctctcccaccttcaaccatgtcttcttcctcctcttctcttgtcaccactcttgttgataataataaccctactcaaccttctcagttaagagcggcacgccgtcgtttcacctctgatcatcaccttcctgagataagcctcaaaacccctatggttaggccttatgttcgatcaaaaatgcctaggcttcgttggacaccagatctccatcgttgcttcgtgcatgcagttcaaagacttggaggagaagacagggccacaccaaagttggttttacagctcatgaatgtaaaggggcttactatatctcacgtcaaaagccaccttcagatgtacaggagcatgagacacgagcagatgagtcaaggtgcaaagaagaataatatggctccggatttcccagcttccacactcgcaactcttggcccaaggcaacagaaacctcacaaaagaagctgcacggaagagcttgttcccacccaagctcaatggaatcatgatgagcaagagtgttacaatggaaaccaagggggtgaatcgattataatttgtaacggcaatgaacagaaggtgcactcctacatcatcttcgagggtcttctgagaggccagtctgtccaagagaataaaactactactactgaaaaggtgtcactaggtgatgccggttacgaaagcgaccatcaaagattccaagacacaactctgtccctttcaatgagctcaaggccttcttcacattcgttcttgaatcggagccacagtactggtccagatgcgaatgatgtctctcttgagctcacgctctcttag

SEQ ID NO: 23545 - DNA, 300 bp, Glycine max
  Peptide Sequence Number=SeqID_115230
atgcagatttttggagccgcttatcttggaccctttggacacttttttcatttaatactggataaaattttcaaaggaaagagagattcaaaaactgtggctaagaaggttctgattgaacagttaacatccaatccttggaacaatttgcttttcatgatttactacggattagttgttgaaggacaaccttgggtgaatgtgaaagctaaagttaagaaggattatctatcagtgcagtatacatcatggacggggagtattcttgaaccttcgagcacgatctatggcattgattaa

SEQ ID NO: 23546 - DNA, 2355 bp, Glycine max
  Peptide Sequence Number=SeqID_115231
atgtcttccttacgagcttcgccgctacttattgataaccctttacattcttattcatgttcttcttctttgaagagaatcaattgttctatcaatgccccaaaactacctagagtttctttttctcttccaaaagcatcatctaggagaagtctggttgaagacttagataaattcacctcagagaaaaacccattaagtgaaaagaatgactccatcaaaacactacatgatggtgttctatatgagtccgcaaattctaaggccattattcagctctatgcaatctcggaggctgtggctgacagaattgaaatgcataaaaacgttggagaacaacgtgtgaattggaacacgctcctattaaactccatcaacatgctaaccctcacggcttcaaccatggctggtgttgcaggtagtggtgaaggtgcaccacttttggctctaaaactatcatcaacacttttgttttctgcagccacagggatgctacttgctaccaacaaaatccaaccctcacaacttgctgaggaacaaagaaacgctgcaagactgtttaagcagcttcagacacagatccaaactaagatcgccattggaaatcccagtgaaggtgatgtgagggatgcaatagagaaggttttggctctagacaaggcttatccactccccttgttgggtggtgcaatgcttgaaaagtttccagcaaagtttgaagcagctagatggtggccagaaagttatagattgagcaatggcaaagagaagataatggagattaagagcaacaaaaataataatggatggaatgtggagttggaagaggaaatgagggaggttattgaagtggtgaagagaaaagacatggaagactatgagaggttagggaacattgcactgaagataaacaagggttttgctgtttcagcacctttgctcacaggaatagcagcactagggtctgtgttttcaggagatggattagttcctgcccttgcgggggccttggccacagtggttaatgcttttgagcatggaggccaagttggcatggtgtttgaaatgtacagaacctgtggtggattttttcagctgttggaagagactattgaggccacacttgaagagaaaaacttggagaaaagagaaaatggggagctttttgaaatgaagatggctttgcaattgggaagaagtgtgtctcagctgagagaacttgcctcaaaatctgcttcatgtcgtttagaagggagggagattgatgaattctccagcaaactcttctacaacaacaacaacaacataacctcaaaagctaccattcaactttatgcaattctagaagccgtagacgatagagtggagatgcatcacaacataggcgagcaacgtgacaactggaacacccttctcttaaactcaatcaacatgctcactctcaccgcaaccgccatggcaggtgtcgccgccaccatcgccaccggtgacgcgccacttctggctctaaaactatcctccatgctcttattctccgcctccacggggatgctgatggtgatgaacaaaatccagccctcacaactggccgaggaacaaagaaacgctaggaggttgttcaagcaaattaagtcccacatcgaaacaacactagccattggaaaccctaccgaggaagatgtcaaggacgcaatggagaaggttttagcacttgacaaagcctacccacttcctttgttaggagccatgattgaaaaattccctaaaaaatttgagccagcagtttggtggccttcaaagagaaacaattccaaatatcatgaaacaaatcagcaacaacaacatggtaagaacaatgggtggaatgaagggttagaaatggaaattagagatgttttgaaagtggtgaaggaaaaggacatgaaggactatgagaggttagggaacttagttttgaagatcaacaagagtttggccattgcagggcctttactcactggcgttgcggctgtgggatctgcatgtttgagccaagattcatcatggggagcaatagtgtcggttttgggaggggcattagcgaccgctgttaatgcttttgagcatggtggacaagtggggatggtgtccgaaatgtacagaaactgtggtggattcttccaaatgttagagaattcgatccaagagactatggaggaagatgaagaacaaagggaaaatggagagttgtttgaaatgaagttggcgttgaaattgggaagaagtttgtcacaactcagagatcttgcaagaaaatcggcttattctcgggtagagggaataaccaccgatgaatttgctagcaagctcttctaa

SEQ ID NO: 23547 - DNA, 933 bp, Glycine max
  Peptide Sequence Number=SeqID_115232
atgttgagatgcgcctcttggtttaaaaagaacagaaacaggggaagcagagagtcgagtagttggggcccatggcaacgttttccatttcccaataaggtttatatacgcggaagatcggtggtgacggtgagtgaggcaaatggcagcatcgtcacaatcgccgccactgaaggcggtgctggagcggaatgtggaagagattcgtgtagtggcggcgagctcaccgtgaggtatacgacgccggccgcagatgcttcggcgagaactacgttcaggaaatccttcataaagcaccacaggttacttacttacttacttcaaacttcaatctcattattaatctcttgcttttggtattcgctcatcaatgcttacattcctttctcaattgcagcttcccgacgacatcgaatggcatttaatctaatcggcaatttgcagagcaacaaagtcaagcctcttatcgctgctgttcccaaccttgcttgtgtacaaaccgtggatgatgagaagatagcaaatcttcttgatcgtgctgtagaaaatgttggcaggaaatcattgaaggttttttttcaagtgaatacaagcggagaaacatccaaatttggcgttgaaccagctcagtgggtggatcttgtaaaacatattacaaactgcccaaaccttgagttttgtggcctaatgacaattggcatgctggattattcatccaccccagaaaactttaagacgttatccaattgcagaagtgaagtttgtaaagcaattggaatatcagaaacacaatgtgagctgtctatgggcatgactggagactttgagcaggctctaactctaattttgaagattgagatgggaagtacaaatgttaggaatggaactgccatatttggatcccgagaatacccaccgaaagaagaggagtag

SEQ ID NO: 23548 - DNA, 1545 bp, Glycine max
  Peptide Sequence Number=SeqID_115233
atgaatgcgcaacagaacgcgaggagtcaaatgcagcagcagcagcagaattccctcccaaacggatcgccaggtgatggaaattcagcgcctaatgactccggcaactccgacagagagtttaagagtgtccgcgcctcaatgcactctgccatatcaatgaacaaaacagaagttttagatgatgtgcttaataacttctcggagggttatttaagcctttctcgtgaaaaccgtcgcaagttgctccttgtccttgctagagagtatgatctcaataggtcacaagtgcgtgaactgataaagcagtaccttggacttgaacttcctgctgacaaagctcaagtgagtggctctgaagacgaaggcttgttttcttctttctatcgcgttgagaggaatttgaggcatgcccttcagccggtttatgaagttctctttgagcgtctaaacactcatcctggagggttgaggaccttatccattcttcgagaagatatcctctctattctcacagaggaaaatattgcatcgctgagagcattggattcatatttaatggaaaaatttattacgtggcttagtcctgctgccttagagcttcaccagattacatgggatgaccctgcttctttgctggagaaaattgttgcctatgaagctgtgcaccctattagcaaccttctagatcttaagagaagactgggaattggccgtcgttgttttggatatttacatccagctattcctggtgaacccctaattttcattgaagttgcactactgaaggatgttgctcagactatacaggaagttttgtgggatagtcctcctatacctgaaggtgaggcaacatgtgccttgttctactccatatcatcaactcagcctggcttagcagggatcaacttgggaaaatttctcatcaaacgggtcgtaacacaggtgaaaagagagatgccacatatttctacctttgcaaccctaagtcccatcccgggattcatgtcgtggcttttatccaagttagcatctcaaagactgcttgctgaaggagacaatttgtcacaaccacaagcagagggatccagttccactttctatgagaatatacttaagcccaaggaagaagaagcacttatgagtttacccaaggatattgctacaggagaaaatggaatggatgtgatgttcaacttgcttacttctacatcctataagtggatccattcaccagaacttctgtcagcattaaaatcccctttgatgcgtttatgtgccaggtaccttctgcaagagaagaaaagaggaaaagctttggactctgtagcaaattttcacttgcaaaatggagcgatggttgaaagaataaactggatggcagatcgttcagataaaggtctttctcaaagtggagggatcatggtgaactatgtgtataggttggatcacatagaagaatatgcccattcttacttcagcaatgctgaaatccatgcctcaagtgctctccatcactgggttgatgtaacagatactgcttag

SEQ ID NO: 23549 - DNA, 789 bp, Glycine max
  Peptide Sequence Number=SeqID_115234
atgacaatccagaacgagtacatgttcttcaactgcagccaagacagcctatgttctgcatgtgagcacttttctgaacactgtgattcctcgtgtgacagtgctagctatctctgcagccacttgccaggctcctcttactatcccaaagccactcagtctctgaggttgatgcttaagtattgtgctacttatgctagcgtttattggaagaatgttggtgctcctatgccttatgatcaggatggaaactccactactcattgcaaagcctatttctatgttattgagaccgctggtccaacaaagatgagattgggtactccttacaaggccaaccttgcttggtttgcaatcatgaattttaatgccatgcatgataacatggctaacaccttgtattgtaatgcaaggcctatttgctatctccactttagcacctcttccatcaatggtcttgtagctattcatgataagctcattcttgagcctaataaccatatctttggcaaaaatgatacaaagggtttgtttttggatcacaccataatgaagtgtgcctgtctttgggcttatgggccaccaactgcatctttgccaaagccaattgcacaattagccatggcttggcgatttgatgcccaatttgatttggcacgccagcaagagtctatcctgtttagaattgcactttctgttgaatatgcaaggtgtagtatgaagcatgaaatcaagagtagtgtgggagaagtggccttgcttgtgaggttgaggctacatatggagtga

SEQ ID NO: 23550 - DNA, 2364 bp, Glycine max
  Peptide Sequence Number=SeqID_115235
atgttttcatacaaaccaaagcagagtccaagtggcctaaaacgttgtgttgtctcactaccacacccagccaccaccaattcagtcaatgccactatcaaccaccattcaacccaaggtgcacaccaccaagttcttgccacctatgcatctatgctcaaaacccatgtcccttctgacgcctacactttccccagtcttctcaaagcatgctcttttctaaacctcttttccctcggtcttaccctccatcaacgcatcctcgttagtgggttgtccctcgatgcctacattgcctcttctttgatcaacttctacgctaaatttgggtttgctgatgttgctcgtaaagtgtttgactatatgcctgagaggaatgtcgtaccttggaccaccattattgggtgctactcgcgcaccggtcgtgtgcctgaggccttttctttgtttgatgaaatgcgtcgtcagggaattcaacccagtagtgttaccgtattgagcttgctgtttggagtttcggagcttgctcacgtgcagtgtttgcatggttgtgcaattttgtatgggtttatgtctgatataaacttgtcaaattccatgctgaatgtgtatgggaagtgtggtaacattgagtattctaggaaattgtttgattacatggatcacagggacctggtttcatggaattcgttgatctcagcctatgcccagattgggaatatatgtgaagttttgttgcttctcaagacaatgaggttacaaggttttgaggctggcccacagacttttgggtccgttttatctgtggctgcatcaaggggtgagttgaaattgggaaggtgcttgcatgggcagattttaagagctggtttttacttggatgcacatgttgaaacatcattgattgtagtgtacttaaaaggtgggaaaattgacattgcatttagaatgtttgaaaggagttcagacaaggatgtagttttgtggacagcaatgatctcaggccttgtgcagaatgggtctgcagacaaagcactagctgttttccgtcagatgttaaaatttggagtgaagccatctactgctactatggccagtgtaatcacagcttgtgcacaactagggtcttataatttggggacatcgatccttggttacatattaaggcaggaattacctttggatgttgctactcaaaactctcttgttaccatgtatgcaaagtgtggtcacttggatcagagttccattgtatttgatatgatgaacagaagggatttggtttcctggaatgctatggttactggatatgctcaaaatggctatgtttgtgaggccttgttcctttttaatgaaatgaggtctgataatcaaacacctgattcaataaccattgtctccctcctccaagggtgtgcatccactggacaactacacttaggaaaatggatccacagctttgtgataagaaatggccttaggccttgcatcttggttgacacttctttggtagacatgtactgcaaatgtggtgatttggatactgcccaaaggtgtttcaaccagatgccaagtcatgatttggtctcatggagtgccataattgtgggatatggttatcatggcaaaggggaggctgcattgaggttttactcaaagttcctggaaagtggtatgaaacccaaccatgtgattttcctctcagttctatcttcttgtagtcataatggactagtagagcagggcttgaacatatacgaatcaatgaccaaagattttgggattgcaccagatcttgaacaccatgcttgtgtagtagatctcctcagtcgtgctgggagggtagaggaggcatataacgtgtacaagaaaaagttcccagatcctgtacttgatgttttaggcataatccttgatgcttgtcgagcaaatggtaataatgaacttggtgatacaattgccaatgatattctcatgctgaggcctatggatgctgggaattttgtacaattagcacactgctatgcttcaataaacaagtgggaagaagtggattgcatgaggcaagacccagaggagagtgaagaggttgggaagagttttacggatcttttagccgaagaagtaaagcaaaaggaagctgaagctgaggaaaaacaaagaagtgtagacacgaaacttttggaggctaagaaattagcatcacagtatcaaaaggaggctgacaagtgcaattcagggatggagacatgtgagcaggccagggaaagagctgaggcagcacttgaaaaccagatgaaagaaactgctttgtgggagcttagggctcgccaaagaggatggaacaaaaagatgcttcaatga

SEQ ID NO: 23551 - DNA, 159 bp, Glycine max
  Peptide Sequence Number=SeqID_115236
atgcagagtatcatggaggcgaaagaagaagtagaagtagaagtagaagtagaagcagtagttgagtttcagatcgcgactgtcaaggtgggtccctcaacttttttcccctctggggttttggattttctggcttccgtttccacattctcattctaa

SEQ ID NO: 23552 - DNA, 264 bp, Glycine max
  Peptide Sequence Number=SeqID_115237
atgtctgagttctacggtaaaagtgaacgtcttctagggaaagtgttatcgcttgcgaacactcttcctaatggtgctattatatttctggatgagattgattcttttgctgctgctcgtgacaatgaaatgcatgaagctacacgtagaatattgtcagtcttgttgcgacagtttaatcttgttggttactgtttaagatacacagaatggcatgttatataccttttgtctatagaaattgattgtgtgctagagttttag

SEQ ID NO: 23553 - DNA, 1611 bp, Glycine max
  Peptide Sequence Number=SeqID_115238
atgaagaccgaatcgcgttcgaaagaggaaacaaagacgtatcaggaatggtttaatttggcagattcagatggagatggtcgaatctctgggaacgacgccacaaagttcttcgctctctccaacttgtcgcgctcgcaactgaagcaactctgggctctcgccgatgtcaaaaggcaagggtttttgggcttcacagagtttgttactgcaatgcagttggtttcgctagcacaagcagggcaggaacttaaatcagatatcctcaaaacgcaaagcaagtttgacaaggaaaatattaaacctcccgtattggaaggactcgatgctttagtagcacaaatgagtttaacaattagtgccccgccggaagtaaatgggactcctcagcctcaagtgttcccaactaaccggtggtttggttcaaaatcttcaaagaaattatctctgaattcagttacatcaatcattgatggcttaaagagattgtatattgaaaggttaaagcccttggaagttgcttatcaatacaatgattttgtgtctccattgttgaccaacactgattttgatgctaaaccaatggtcatgcttcttggtcaatattcaacaggaaaaactacatttataaaacatttgttaaaatgtgattatccaggagcacatgttggaccagaacctaccaccgatagatttgttgttgtcatgtctggacctgatgagagaagtattcctggaaatactattgctgtcgatgctgacatgccttttggtggcctgacaacatttggaggttcatttttatctaagttccaatgctctcaaatgccacaccctttgttagatgaagtaacatttgtggacactcctggtgtcctatctggagagaaacaaaggactcaaagaagctatgatttcactggtgttgtatcttggtttgctgcaaaatgtgatctcatccttctcctatttgatcctcataaattagacatcagtgatgagtttaaacgtgtaattgcatctctacatggtaacgatgacaagatacgagtggttttgaacaaggcagaccaagttgatactcaacaagtaagagaatatcaacataggttacctgcttatgagagtttatggagcattgatgtggtcactggctcatttaatgataagcctatggatgaaggcttcgtcagtccattaggacaggatctctttgagaaggaacaaaataatctgcttgctgatttgatggatattccaaagaaggcatgcgatcgtcggatcaatgaatttgtgaaacgtgcaagatctgctaaaattcatgcatatataattagccatcttaagaaggagatgcctgctataatgggcaaagccaaggctcgacaaagacttcttgataatcttgaggaagaatttgcaaaggttcaaagggagtttcatctaccagccggtgattttcccaatgttgaacacttcagagaagttctaaatggttataacattgacaaatttgagaaactaaagcctaaaatgattcaagcagtagatgacatgcttgggtttgaaataccagagcttttgaagaaattcagaaatccttacgattaa

SEQ ID NO: 23554 - DNA, 270 bp, Glycine max
  Peptide Sequence Number=SeqID_115239
atgtatgaggccaacataaatgaaaggcctcctctgccagctagttgtcaaccagcactagcacatctgataaagcgttgctggtcagcaaacccctcaaaaaggccagatttcagtgatattgtgtctactttggagaagtacgatgagtgtgtgaaagagggcctgccactgagtcataatcattcagggctagtcagcagaaatgtaattattgaacgcctaaaaggttgtgtatcaatgagctcctccatacctgtacatgcttga

SEQ ID NO: 23555 - DNA, 939 bp, Glycine max
  Peptide Sequence Number=SeqID_115240
atggcaaggattccagtgaggtttcagagagtggcagcggcgtttgacgctgacgtggcacgcgtgaggctctgcgagagcagcgggagcgagcactcgccggagagtttgaccgatttgtcggatctcgtgaagtcctttatggagaagaacgagacaacaaccaccggggaaaaagaagaagaagaagaagaaggtggtggtgttcatgaagaagagttagaaaaaactgagtggtctgattcggagaagagggaaatgctgcagagtttcttgtatgggaaagaagatgagactgatgaggatgaaagggacgccaaagaaaaaattaggagagaggttgaagttgcatttggacttgttgggaacaattacaaacgcaggttgatctctctgttaagggagaaaggttttgatgctggtctttgcaaatccaagtgggagaaaaatggaagattaacagctggtgattatgagtacattgatgtcaattttaagggaaaacgctacatagttgaaatttcccttgctggcgagttcgaaatagctcgtcccacagatcaatattcttccttgctagatgtgttcccattgatatttgtgggtaaagtggaagagatgaagcaggttgtgaggctgatgtgcactgctatcaagggctccatgaaaagaatgaaactgcacataccaccatggaggagaaatgtgtacatgcaagccaagtggttcggtgcttacaaacgaacaaccaatgcagttgcaactaaaagggtatcattgcctttgtcttctgatgagtctttgtttcctaaaaggtccattggatttgaagtgagacctgtgaaagcacacaagtgcagggatgtttatgccactaatactggcttcagaactggtcatttgactgctgtgtttaattctgatagccttggtgcataa

SEQ ID NO: 23556 - DNA, 723 bp, Glycine max
  Peptide Sequence Number=SeqID_115241
atgggttttgatgagaaagtgaaagacaatgatggtgcaggggatgatgatgcctctcatcgggtgcacgcggcaaaagctggtacggatcatgaaagtggacatgaaggaggagggaccttcagcagatacaggagtgagagttccattgctgctaccgaggatgaagatgatgaggaggagaggaagattgaattaggtcctcagtgcactttaaaggaacaactcgagaaggataaggatgatgagagcttgaggaggtggaaggagcagcttcttggaagtgttgacataaattctgttggagaaactctggagccaaatgtgaagatccttagccttgcaattaagtctgctgatagacctgacattgttcttgcaataccagagggaggaaatcccaagggcttatggtttactttgaaagagggtagtcgttataggctaatgttcactttccaggttgagaataacatagtttcaggtctcaaatacaccaacactgtgtggaaaactggtgtcaaagttgacagcagtaaagaaatgatcggaaccttcagcccccaagcagagccttacacacatgagatgcctgaagagaccacaccatctgggatgtttgctagaggacaatattcagcaagaagtaagtttgttgatgatgacaacaagtgctacttagagattaactacacttttgatatccgaaaggaatggcagtag

SEQ ID NO: 23557 - DNA, 391 bp, Glycine max
  Peptide Sequence Number=SeqID_115242
atggatgaagacaaacccgagacccacgatggaaggcccaagagaagtaccaagcgatctgagttcccttgccctcgaaatgaaggaccattgtcctctgcttgtatcaggaagccatcagagctgaagcccaatgtttcgctgtctggtgttaaggtcgtgactgatttggtagtggtctttgatgatgtggagccatgtctgattggctctgttcgatttcttggaacaaaattcgttgatagtgatagtgatgtcctagttattgataagtcatttggttttgacgctgctgttgaagaggcacaaggagccataaactttgcttatgtggaagcagaaagcactgagaatggtaacgatattgtcaagcttatcggtcgttacagtg

SEQ ID NO: 23558 - DNA, 324 bp, Glycine max
  Peptide Sequence Number=SeqID_115243
atggagtactttgttgatgataaaagacatgatgtcaactttcaggtgggcgattgggtgtttgtgaagttaagaccgtgtcgtcaagcttcagtaacgagagcttcatattctaagttgactaaaagattttttgggccatttcaaatactgcggaagtatcaccttgaggacaaggtgcttttcgaagagcatgataatgttagggaaggaactaaacaaccttcaccagaagcacaaaaaacagaatcacagctagcaaacacgaatcaaaggccaaagaggttggtgaccaagccacaatacctgaaagatttcatttaa

SEQ ID NO: 23559 - DNA, 573 bp, Glycine max
  Peptide Sequence Number=SeqID_115244
atgaaagtaaggaaccatttgtttccaaccactaggtgtgactcaatcggaaaaattgagctcaaggttaaagatacattatactattataggtattcaaaacccactgaagcaccttatgctcggggccaagacaacattccaatgcttggggagagattagactcatacccaaaggatcaacaaaagcaaccatggcaatatgagatccaccattcatgtaaatataggaaacagaaaatctacaacagtcaagcatatgtcagcgagagtccatacttcataggacatacacagaccttccaagaccttactcggttggggtcttctgcaaggcttgacctcaaagttgaccatatcagaccagagaatcgagaagaaggaagtgagaacagagcaaaaggagaagctttgggagataaagctgagaactttgggttgagaagggacttcatggcgtggaaggggtttaagggttttgcaactgggaacaaagatttcgcattttatgctatgctgtttgagttggagggtaatctccactctccagggaaccagactcatactgcttaa

SEQ ID NO: 23560 - DNA, 648 bp, Glycine max
  Peptide Sequence Number=SeqID_115245
atggttccttactttcatcttttggaaagcaaggaaagaaacaaactaaatggtttagcaatagcatcattcataagaaatgtagcaataattaaatcaagcaaggatacaagatatggattagactcaattgttacacacgatggtgcagaattaccatgttgggcactggaaaacttatcttcattcaagcagaagtttggaattgatgcttatgagaagctggatgtgattggtattgatgaagctcaattctttgatgacctttatgaattctgtcttcaagctgctgatcatgatggaaaaacagtaatagttgctggactagatggttatggttggattttacattatcgcgtccacgctgaaggtgtttctacatttactggcaggaggagctttggttccgtccttgatataattccccttgctgattcagtaaccaagttaactgccagatgtgaaatctgtgggaagcgtgcttgctttaccctgaggaagacacaggataagcagattgagctgattggtggtgttgatgtctacatgcctgtgtgtcgccagcactatgtcagtggacaggtagccatggaagccacaaggcatgtccttgaatctcacaaggttgaatgtgcctcccatacataa

SEQ ID NO: 23561 - DNA, 1032 bp, Glycine max
  Peptide Sequence Number=SeqID_115246
atgaagggtctcttcaagtccaagcctcgcactcctgcagatgtagtgcgccagaccagagatcttctgctctttgttgatcgcagccccgaaacccgcgaaagcaaacgtgaagagaagttgttcggttttgcgagtataattgagcttgacatgccatcatcaggcattatacgagcagtagtagaatttatgtccgagctatttaaaaatatcagggagctaaagtcaatcctgtatggaaatagtgaatctgaaccagtgtctgaagcctgtgcgcagttgactcaggagttctttaaggaggatacgttgcgactgcttatcaagtgtcttccaaaattgaatttggaggccagaaaagatgccactcaagttgttgcaaatttacaaaggcaacaggttcagtttaagttgattgcatctgattacctggagaaaaatatggatcttatggatattttgatagttggctatgaaaaccaagatatggctttacactatggtgcgatgctgagggagtgcataagacaccagattgttgcaaaatatgtcctgaactcacctcgtatgaagaagttttttgactatatccaacttccaaattttgacattgctgcagatgctgcagcaacctttaaggagctcttgacaagacataaatctactgtggctgaattcctttccaagaattatgaatggtttttcgcagaatataacactaagctgttggaatcttccaattatattacaaggcgtcaagctgtcaagttgttgggagatatgttacttgatcgttcaaattcagccgtaatgacaagatatgagtcaagcaagagcatacagattgaagcatttcatgttttcaagctatttgctgctaaccaacataagccagctgatatcgtcggtatatttgttgcgaacaaaagtaagatgctgagactgttggaagacttcaaaattgacaaagaggatgaacaatttgaagctgacaaagctcaagtgatgagggaaattgaagctctttaa

SEQ ID NO: 23562 - DNA, 291 bp, Glycine max
  Peptide Sequence Number=SeqID_115247
atggctggaggcgttgacgccagacgcacgatgaccaacgacggtgactacaatggcaaggagcgacgccaatggctacaatggcaagaagtggcgcaacggagtcaaccatcaacctccaccaacccaaacatgtgttataagccttctttatccaatattgactccctagtaggcaatgacgatgtgcgtcaaaataggcaattttgtgaaagaagttggactcaattgaaatctcggtggaacaggatccaccctccagttcaaaagtttaatgggtgctacaaataa

SEQ ID NO: 23563 - DNA, 1017 bp, Glycine max
  Peptide Sequence Number=SeqID_115248
atggacctcttcgccggcgaccacttccctgtccccgaccacgtcgctccgttccccgattccggcgacctcgtcttcgccgccgacctcctctcccaccgccccaacccccagaagctccgccctatcaggtccgtccccgccgcccccattgcccaccctcctccgccccctctctcgcacgatccgattccctccgggtcgggtcacgccccatgccacgaatccagctcgtctttagatgctgaggatgaagacgatgacgacaattcatcagcaagtacggaaggacatggccctataaagaagaggagaaagacggtgaggaagctcgaagattttttgaaggatttgatggcgaaggtgatggaaaagcaagagcagatgcacgaacagttattggaaatcatagaaaataaggaaagggaaaggataaagagagaagaagcttggaagaacgaggagatggagagaatcagaaaagatgaagaggctagagcccaagtaaattctcgaaatttggccctcatatccttcattcagaacctgttgggccatgaaattcaaatcccccaacaaccagtagaaccatgcagcaaaagagaagaggatgaagttgaggtgagtgctagaaaggatttgaacaatgatccaagtgacaataatagatggcctgatgttgaagtgcaggcactgatcactgtgagaacttcattggagcacaagtttcgtttcatgggatcaaaagggtcaatatgggaggagatatctgaagcaatgaatggcatggggtacaaccgctcttcaaagaagtgtaaggagaagtgggaaaacattaacaagtactataaaaggacaatagggagtggcaagaaaaggcgtcaaaacagtaaaacttgcccttactttgatgagttggacattttgtatagaaatggtcttctaagtattggaaatgccttgagcaataccagcgatgttccccagattgaagtaaaggagttgactgaaacttga

SEQ ID NO: 23564 - DNA, 706 bp, Glycine max
  Peptide Sequence Number=SeqID_115249
atgacgactcgaattgcgcccggtgtgggagccaatttgctgggtcaacacgccgccgagaggaatcaagacgccactgcttatgtcggcaatctcgaccctcagataagtgaggagttgttatgggaattgtttgttcaggctggtccagttgttaatgtctatgttccaaaggatagagtcaccaaccaacatcagggttatggatttgttgaattccgcagtgaagaagatgctgactatgccatcaaggtgcttaacatgattaagctttatggcaaacccatccgtgtcaataaggcatcccaagataaaaagagcttggatgttggggcaaatcttttcattggcaatctagatcctgatgtagatgacaacctcaaccaaattcaagacttatacatgagtgtcaccaaattatacacgaagtcgtcgacaacctcaaccgtggaattgccaccaccaatctcagcctcagaagcccttatagtcaacacattatgcgcgcttggcttggccttcgccttctggattgcgaacactgtctactccatcgaactcgttactcatccttctctcacactcttcttcatctggattacagagctccccattgtgacccttctatacagtcgatatcgacaaaatcggaagcaatgcacgtacctgcgagctgttgggagaggggttctaggagtgcctgttg

SEQ ID NO: 23565 - DNA, 1230 bp, Glycine max
  Peptide Sequence Number=SeqID_115250
atggagcttgatttgaatcaggagccattggaaccaactcatgcttctccagatgaatttgattctttgttggaagaactggaatccgcccatgaacatgtgcaggaccgtattaggcgccttgaagcgataacttccagagccaggcagtatcagaggcggccactgtttcacactccgatccaaataaccaacttcacaggacaaaccagcacgccagctgatgctcgtgaagaagaaatgcagagccaggaagttgaggaaagagtcgttgaaagtgggagagggtgcaaaaggaaaggtgcccatttaatagctaaggcattggggaggactgaaaccgatgccagtaaggaagggggaagcactggaaatttctatgattgcaatatatgcttggacagggcaagagatccagtgttagcctgctgcggtcacttgttttgttggcaatgcttctatcaggtgcaaattgtctattcaaatgcaagggagtgccctgtttgtaaaggagaggtcactgaaactggcattattccaatttatggaaattcgagtgctgatggcagtcgtgagtcaggattaaaaggagctggtatgagaattcctcctcgacccgccgcacccagaattgagagttttaggcagcagctaataagccagggagcttcttcttctgtaatccaaaatatctggcggtttcatcaccttattggtgggttaggagcgcgggttcagtcacaatcacaaacccccaatgctgcaactgatagaaataatggtttgcttgctcaatctcgcctgcagacaggcaatgatcgtggtactggttcctctcagactccgatttcaaccttgttagtgcaaggagctgcttcgttttcatccctttcatcagcattaaattctgcgatggattctgctgaaagattagttgaggaccttgagtcatatattcataatcacccaacaaatggtgtcaatacaaattcaactcatgatgggaatgttgctgcaactgattccacacctgcagcttctacatctcattttagtaggaatgttgacaccactgctgatattggcttagaaattcagacaacagatagtaacatacagactgagactagtccattggacccttcttcttcttcatctcacagaggaagcactcgtgtttcaacttcaaggcaagtttcaaatgatcgcagaagaaggagatcaaggtga

SEQ ID NO: 23566 - DNA, 228 bp, Glycine max
  Peptide Sequence Number=SeqID_115251
atggcgatcataatcgtgatcctcattttcgcccagtttctaatgggtttcttctccatttacatccgccactgctctgactctccctccaccaacatccacaaccaccccggatcctccaagaggtcacggcgtagctctcgcaagctcgaccagacagtgatcgacacgttctcaatttatcatcccatggaaggaaggttcaaaaatttgggaggtctactgtag

SEQ ID NO: 23567 - DNA, 3078 bp, Glycine max
  Peptide Sequence Number=SeqID_115252
atgtcgctgaatatgaaaaccctaacccaagcattggcgaagaccgcggcggtgatcgagaagacagtgcagacgacggtgcaggaggtgacgggcccgaaggcacttcaggactacgagctgctcgaccagatcggctccgcggggcccgggctcgcctggagactctattcgggccgggcccgtgatccctcgcggcagcaccagtatccggtggtgtgtgtatgggtgttggacaagcgctctctttccgaggcccgaatgcgcgcgggcctcaccaaggccgccgaggattcctttctagatttgattcggacggatgccgccaagctcgtccgcctcaggcatcccggcgtcgttcacgtcgtccaggccctcgacgagagcaagaatgcaatggctatggtcaccgaacccttgtttgcttccgctgccaatactcttggcattgtcgacaatattcctaatcttcctaaagatctcaggggaatggttgctgatgaaagagcctttgctttgcaggaaatgggaattttggaggtgaagcatggtttacttcaaatagcagaatccctcgactttctccacaaccatgctcatcttcttcatcgagctatatcacctgagaacattctgatcaccttgagtggagcttggaaactcgctggatttggttttgcagtttctgctactcagacctctggtgactcatctaatctgcaacccttccattatgctacacaaatttctgcttctagtaaccttatatacttctgccagcagaagtctctacattttgtaatcatacctgtgcggttattcttcctggaatatgatgttgaggactctatcttgccacttcaaccatcacttaattacactgctcctgagctggcgaggagcactgcgtcttcagctgggtgctcatctgatattttcagttttggatgtcttgcctaccatttaattgcccgcaagcctttgtttgactgccacaacaatgtgaagatgtacatgaataccttgacttacttatccagtggcgcattctcatctatcccatcagaactggttcctgacttgcaaaggatgctttctccaaatgagtcttccaggccatcagcaatggattttacaggctcaccattttttaggcatgacactaggttgcgtgctctacgcttccttgatcacatgcttgaaagagataacatgcagaagtcagagttcttaaaagcattgtcagatatgtggaaagattttgattcacgtgtattgcgatacaaggtccttccaccactttgtgcagagcttaggaatgtggtgatacagccaatgattctaccaatggttctaaccattgccgagtctcagtggagcagctcttggcttctcttgaatgcttatagtggcacactttgctgttgtggctgggttgtgaccaagagaagctccaataagaaaaatggatcaaggctttgtttggaagagcttatgtacagcttatttggacttatatcttatgatataagcacttgtgacaagaatgattttgagcaatcaacacttccagcacttgtccctgtctttagttctgctgctggtgagacactattactgcttgtgaagcatgctgagtttataataaacaagactagtcaagaacatttagtttcacatgttcttccaatgattgttcgggcctatgatgatactgatgctcgtttgcaagaagaggtcctgaaaaaatctgtatcccttgccaaacaactagatgcccagctcgtgaaacaagtggttttgccccgtgttcatggattagcacttaaaacaacagttgcggcggttagagtcaatgcattgttgtgccttggggacatggttagccgacttgataaacatgctgtcttggacatcttgcaaactattcaacgctgtactgctgttgatcgctcccctccaacccttatgtgtaccctaggggttgcaaattctattttcaagcagtatggagtagaatttgtagctgagcatcttcttccattgcttatgcccctgctgactgctccacaattgaatgttcaacagtttgccaaatatatgctctttgtcaaggatatgctccacaaaatagaagagaaacgaggagtggctgtgactgattctggaacgccagagataaaacttgctcccatggttaatggccatcaatccgaagccatgcggacaagcagcagctctatacctgcttcaactaaaagcagctcttgggatgatgaagattggggtcccaaaccaaagggcactgcctcttctatccagaattctattgatgtaaccagtcaatctatggcaggcaaccctgtgggtcaagtaacatctttacaaaagcatttgtccttagcggctttatctgctaagcaaacaaccaagccatgtccctcagtggatgtagaatggccacctcgtgcatcttctggtgttaccctacaatttggtgatactgaaacgcagacaatagcagcaggaacttcatccccatctaatcttgaatctgatgatccttttgctgattggcctccacgtcctaatggctcagtatcaggtggatctggaatatccaacaatggtactttaggaatgccactgaacaaagttgggtttaattcaatgagaagcacttcaagcaatatgggtccccaaactagcaacagttggcctgttaattcccaaagttctgcagagtccattagtttgaactcaaggaatcctatttcaacaatgggtagcctgaatagtggtggccttggacaacagaaatctcttgggtttgtaaaacaaggccaagctttcccagcatcaattgtttcatataataatgttcagtcaacagcaacagatcttggatcaatattttcttccaacaggaatgaacaaattgcacctaaacttgcaccacccccttcaaccactgtgggtagaggacggggaagagggaggggagctgcttcaaccactggttcctctcataccaagtcacacgctgagcagccaccccttttggatttgttggggtag

SEQ ID NO: 23568 - DNA, 1587 bp, Glycine max
  Peptide Sequence Number=SeqID_115253
atgtgggttaaggttgttcttcttctccttgcagcactttctctttttcacttagccgcagcttctcttaatcgtagcagtttttcagcagatttcttctttggaacagcttcttcagcttaccagtatgaaggtgcagcacgtgaaggtggcaagggacctagtatatgggacaccttcactcatagccacccagatagaatagcagaccacagtaatggggatgttgccattgattcataccaccgctacaaggaagatgtggccatgatgaaggatattggattcaatgcctacaggttctccatctcttggccaaggatactacctcgtggaaacctgcagggaggagttaaccaagaaggcatcacatattacaacaatctcataaatgaactgatagcaaatggacagcagccctttataactctatttcactctgatttccctcaagctcttgaagacgaatatggtggttttcttagtcccaaaattgagcaagattttgcaaattatgcagaagtatgcttcagggaatttggtgacagggttaagcactggattacattaaacgagccagtgctatatagcaatggaggttatggaagtggtggatccccacccaatagatgctccaagtggtttgctaactgcactgctggtgattctactaccgagccctatttagttacacaccacctcattcttgctcatgctgcagcagtaaaggtctacagggagaagttccaggcttctcagaagggtcaaattggggtaacactgaattctgcttgggttgtgccactttctcaatcaaaagaggacagagaagctgcatatcgaggtcttgcctttatgtatgactggttcatggaaccactttactctggaacatatcctgctgtaatggttaacagagttggaggtcgtttgccaaagtttaccaaaagggaatacttgatggttaaagggtcctatgatttcatagggttaaactattacacttcaacttatgcaactagttctccttgcccacgtgaaaggccaactgcctttacagacgcctgcgttagatttactagtaagtcattctatgtgaagctcttacacactttcctattaacttctattgaattttcctcattcacttgcttacccacgattcattttgttgcacttgcatcagctgtaagaaatgggcttctcattggtccaaaggcagcctcagactggctctacgtctatccaccaggaattcaaggtctactagaatacactaaggagaaatttaacaacccaattatctacataacagaaaatggaattgatgaggttaatgatgggaaaatgttacttaatgacagaacgaggattgattatatcagtcaccatcttttgtatcttcaaagggccataaggaatggagtgagggtgaaaggatactttgcatggtcattgttggacaattttgaatggaatgcagggtacagtcttcggtttgggctcgtgtatgtggattacaagaatggactgaaaagataccgcaaaagatcagctttgtggttcaaaatatttcttcaccaatga

SEQ ID NO: 23569 - DNA, 615 bp, Glycine max
  Peptide Sequence Number=SeqID_115254
atgaagcttctgtggattcaggttcctgaaatgggctttataagcacctttatagacctcagtcagggaatgttgtttgtagaatctccacgttgtgaagaaagattgcaaattcggcttgagtcagatgtttatggtgttatagaggagattgaactatatggacagaggtacgaggtatatagttatgacaatgagaccaattcatggtttagtgaagccatcggtaaaacttgctctttgttacggtattctagtttcgatcaggattttatgttaaataagatcaaaggtgcagccacatgtagagatccgaagaacaaacttaattttgccaatgaagcacagttcttacttgtatctgaggaaagtgtttctgacctaaatagaagattaagctcagatgtacagaagggcatatatggaaaagtgatgcaagtcagtgcaagtaggtttcgtcccaatcttgtggtatctggaggtaggccttatgctgaagatggatggagatacattaggattggaaacaagtatttcagtgtaagtgcaaataaccttctcaatgattcgatagaacaagtttcttcttattgtgcaattggacatagtagatag

SEQ ID NO: 23570 - DNA, 510 bp, Glycine max
  Peptide Sequence Number=SeqID_115255
atgctcttggccatgaggcatggcaatggatctagtgtctgcatcctctatggacaccataattcaatgaaactgtgtcatgaaatgggtccaataatttcattcaacttgaaacggcctgatggctcttggtatggataccgtgaagtggaaaagctggcatcactttcaggaattcagctaaggacaggatgcttctgcaatccaggtgcatgtgcaaaataccttggcttgtctcatttggatcttatttcaaatactgaggctggtcacgtttgttgggatgatcttgatataatcaatggtaaacctgttggagctgtaagaatatcctttggctacatgtcaacatatgaggatgtcaaggaagtttgtttaactgatatcaaagattttatgctgttgtttatttttcttttatgcgagggcaaggcttggtgcaatggtaaattgttgccttgtggtttggaggtcatgggctcaaatcctggaaataacctctgcttgtag

SEQ ID NO: 23571 - DNA, 402 bp, Glycine max
  Peptide Sequence Number=SeqID_115256
atgacccttcgatcgcttttcgaagaacccagaaatccagggctaagagatctgaggccccaattattcagctccccctatctcagctctttctacctttcctctccctccaacaccagcagctccagtccttccggatccttctgcttcgagctcagagcattccttatctatgttgtagagcctgcatcagggccagctcctgatcatgcaaagtctgcaggatgtggtccaccaacggccgagccctccccacctgagccatttatttttgaggctgatctagagccatctcctcaacctgagccagagccatctgcaccagtgccagacttgcctatttctcaggatccaccatctgcaccagcattggacctgaatgacgctgcacaggatgattga

SEQ ID NO: 23572 - DNA, 138 bp, Glycine max
  Peptide Sequence Number=SeqID_115257
atgaatgtgattttcaagaaaaaatttcaaaatctatgcggaatggaggaggagaaagatgattggagacgccacttcaaggagaagatgagtctagaagaagctcacaaccataagaagccatggataagagcttga

SEQ ID NO: 23573 - DNA, 561 bp, Glycine max
  Peptide Sequence Number=SeqID_115258
atggagacagtaggtggtgaaggctctggttttcatgttctgaagctgtgtaattcgtgtttggcctctggtaatcgattaccaaggctgtgtaatcgattaccagagatgaaaagccttgagatcgtgatggcggcgcaagtaatccatgatcgagtggagatggagtgcctagagggagcttgggagaccctcgaaggcaatgcgaggtgccgatttcggggcacgattcgattcatggctacttcattggtgcatccagaggaactcgcgcgcacgcttcagcgcactgtggagtggatactacccacgcccacaccatatcgtctagtggagccagtccaagtgatcgaggtgacgtcatctgaggaagaccctgaggaagaccaagaggagctacctcctgagcctgctgtggatgctcttgacttcctagagggtgatgaggacccactccttgaggtggattctcccgaggtcgtcatgtcggtatctgaggcagactctacggaggagagcggccctggagagatggcgactagtggaggctattcatcatag

SEQ ID NO: 23574 - DNA, 237 bp, Glycine max
  Peptide Sequence Number=SeqID_115259
atgttgtcatctccggaaagggtgcaaatgaccacattggcctctgcttgtcaatcggacttggggtctccgaatgacgaggtgcggataaccttaaggtctctctgcatgctaccggactctcgggtcatgatagcaaaaggtggggtggtcgacaaaagcggggcttttgctcctacatatcctcaatttgtgatgaggaactcagacctacgtagttcttgcaaagcggtgtga

SEQ ID NO: 23575 - DNA, 499 bp, Glycine max
  Peptide Sequence Number=SeqID_115260
atgggtctaggcaaggactgcctcgggaatgctgacgtggtcgatatcaagggaaatccatacaaatatggattagggtatgaacccgggatgccggggaggaggaacgtgccgtcaagatttcgggcggataggatatggcccggccgtattagccagtgtttcaccagcgctggaatggtgtccggggaggaggtggccgcgatagaagaggagttccctcaagacccaccaagttttgtgcaaccatgccaccccgattcccaagtggggaactggcgcgtgataagccagtcagaagtctataccgccgattcaatatgtgagggtcgattctttgaggaacctaacaacgagggtttgacaatcgatttcgatcgagatataagccaaacgataaacaaggaagaggaagaggacgtcctgtcaccagagttggagaggctggtcgctcaggaagaacgtgaaatgaagcctcacacaagaagaaaccgaattg

SEQ ID NO: 23576 - DNA, 264 bp, Glycine max
  Peptide Sequence Number=SeqID_115261
atgccaatctccccctgcaaaagtatcagttggtctgtgtcgtcccgacatggggatcgcgcccacaagacacccagtggacccggaagagtccaacagggtcctagggtttccagctctggttacgggcctctatcagtcctacagggtgcccgtaccccccccccccccccgacaaggtcacatcatcatagggattgtgcctgcaagacacccagtggacccgaagaagtccaacagggtcttggagttgtcaagctctaa

SEQ ID NO: 23577 - DNA, 544 bp, Glycine max
  Peptide Sequence Number=SeqID_115262
ggacgctttaaatcagattgcttctgaggttgaccgtctacgttatctcgacaacaatccctcttcttgtggttgtgtgatgagaagcatgcacggtcttccttgtgcataccaaggattatgtgaggcggaagtcagcatcaagaaagagatagagaccatatctaaaaggtttgacaaacttgatgtgtctggcaaatatgttgatgcttttcattctgttcaaagcaacaactctccagtcaaacgtagtgcatcatgttctgaaccgcctcagccaacaaggatcatcccgatgttggatcaatttgcgccattcattcaaggtttcattcgtgacgttgtagatgtgaaagcggacggtaactgtgaatatcggtccattgccgctttattaggtatgggggaagattcgtggccgttagtgcgtaacgaattgattaaagaacttggcaggtggttgcatgagtacatgaacctcttctgtggcacagagagatttgaacaattaaatttgtccctacttgttgatgggttttcgaag

SEQ ID NO: 23578 - DNA, 214 bp, Glycine max
  Peptide Sequence Number=SeqID_115263
atgtccaagaacaaggtgttgaaagagcataaagggactttcctaagttggtttaaagaaacaatctttgcttatgataatgcttctgaaacattaagaaatgaagcaagtatcttggtctcaagacaagccacggcaaaaaagagtcacatctctttacgggaatactccccaccagcgatatacaacaaacaagtcgttcttcatggcagaa

SEQ ID NO: 23579 - DNA, 387 bp, Glycine max
  Peptide Sequence Number=SeqID_115264
atggctgccaaagttctatacgaggagaagttcaaagttggccacctacacacattcggaaggagtccgggttacgggaagagaagcaattatccaagagctctcttgaacaagagtaccagggccctcgccaaggacatgagtaggccggggaatggaacattcgctggggctctatgggacagcaatagtgaacctcaagtctgcgagggaagagagggaccagatcgcgagcacactcagcactggtctcaagaagaggcatattgcttgctcccaatgtccttgaaaagaagcgcccctcaacacctgacgagtcacggagaccctcaagacatgctcgaagggatgtcgagttctatctcgccagtaccaagaagggtctag

SEQ ID NO: 23580 - DNA, 1044 bp, Glycine max
  Peptide Sequence Number=SeqID_115265
atggcagagccatcgaagaagagaaagggatcatcctccaccgctgctgctgctgcccatcgccgccatggcccatccggagcacccacagcacctattcctccttctttgtcatctccaagatcatcaacattgttttcatccgatgatcaacgtctacggtacctttctcagttttcttcaagaataatcttagaccctaagtacctagacgtagagttctttaatgatgaaacgtttgattgctatcaagtgtttcaaaattctggtcttgttgatttcatgtcattaaaattgccatattatcctgaacttgtaaaagtcttctactgcaatttaaaaattcaggatggtatcattatgtctgaggtgcatggtacttctatggtcattgatcagtcactattcttttctttgactcatttacccagtcaaggtgcaccttttgagggcaccattgttgatgactggaaattcgattattcgagtcatgatgctcgtcgcatggtctgcaatgatcaagctgaaatgaccggtagattgctggccggatttgattctatgtgggcttttcttaccggtcgtcagatcgactgggcccatttggttcggtaccgaatgcataaggcattacgggctaaggcacctcttccttatccacatttgattactctgtttttgcgtcattttcaaattccgcttgatgatgaaccgtttgttcaaatcaagcgttcctttgcaattggtgctggtgcagtgaccttctttgggtatcgtaaagatcggaatggtcaatggctgaagaaggatgcactccctcctcaagatgaacgtactccttcacctcctcctcaacgtgaagattccgcactcatgaatgaagtcctctccgaattacggggtcttcgttcttatgttggtgaccgcttcgactcgttagatacacgcttttccggtatggacattcgcctcacacagcttgaagaggatgtcggatacattcgtcagagtttcgatcttccaccaccacctccgtcttcttag

SEQ ID NO: 23581 - DNA, 396 bp, Glycine max
  Peptide Sequence Number=SeqID_115266
agacgaaagctaggcggagcgaatgggattagataccccagtagtcctagccgtaaacgatggatactaggcgctgtgcgtatcgacccgtgcaatgctgtagctaacgcgttaagtatcccgcctggggagtaccgaagaaccttaccagggcttgacatgccgcgaatcctcttgaaagagaggggtgccttcgggaacgcggacacaggtggtgcatggctgtcgtcagctcgtgccactgccggtgataagccggaggaaggtgaggatgacgtcaagtcatcatgccccttatgccctgggcgacacacgtgctacaatggacgggacaaaggatcgcgatcccgcgagggtgagctaactccaaaaacccgtcctcagttcggattgtag

SEQ ID NO: 23582 - DNA, 198 bp, Glycine max
  Peptide Sequence Number=SeqID_115267
atggagaattggcaaacagcgctggaaaaaattcgcggggctccagactcgtgggtggaggatgcatcgttaggcaataaattcatggggctccggaaaaagatggagaatagagaattggcgaatagtgctaggcaacaaattcgcggggcttgcagactcgttggtggaggatgcatgaactgcgctaggcaataa

SEQ ID NO: 23583 - DNA, 235 bp, Glycine max
  Peptide Sequence Number=SeqID_115268
atgcttgctaagccagcagattggcttagcgagaaggtgtggagtgttctctcgtactctaacctggctcctacttcccacacctcggacctgacagtagatcgagataggctgatctttggcctagtctctcagatgaacatgaatgtgggagctctcatctctggtcagattacatctatggcccagtctaactcttctagacttgggttccctgctcttatcaccgctttat

SEQ ID NO: 23584 - DNA, 432 bp, Glycine max
  Peptide Sequence Number=SeqID_115269
atggccaccgctgaagccttggacgagaaacaagaagcccgaaaggaagacacgtgccagcaaagttttgaggggctttatagggcagcaatattaaccgagactgaagggaatatgtgggccgtcatcgataagtgcaaagagaagctaaatttagcgccgactcacgagcaaaggctagaggatgagtacgccaagatatcagcagaaagggaagcaaggaaaagggtaattgattcattgcaccaagaggcaacaatgaggatggaccgatttgctcttactttgaataggagtcaagaacttccccgattgctagccaaggccaaagcaatggcggacacctactccgcccccaagaagatccacagacttctcagctattgtcaacatacgatagacttaatggaccatatgattagaaaccgctag

SEQ ID NO: 23585 - DNA, 741 bp, Glycine max
  Peptide Sequence Number=SeqID_115270
atggatcagcacgttacggcggtttttttgccacccgaccagcgaatgcggagaacagcgcgcaacgtgttcttgagtcaatactgcctgccgccagcctgtacggtcctttcattaatggagataatgatgaaacggaccaccttaacaacggctctctcagcccctgcgctacttctcgccatgcatgcggcacacgctgcgccacaggctcatgtcgtctgcggctactcccatacccttggcgatgatgccattatgatgtttggcaggcccaacgaggccatgctgcatgacttcttcggcaacacgcacaccgatgccagctcgaccagggaaaccctgcgcaagctggaagaaaccacctgcgataacaaagcggatagctcggcatactgggcaccttcgctgcggctgcctgacggcactatcgtaaaacctgcgtatcaaaaaacctattatcaggcgtcgaatgtggagacctggccgctgcagcctttcccggcggggctatcactgctggcgggggatcaccatggatctgcgcctaacccgcatatcacgttcttgtgtgcaaacggcaagggttacacgacaaaaacaggcgaagtgtgcggattacgcaaggcgggagacgccgtgcagtttaatatcggtattcagtttcccaactgctgggatggcgtgaacctcaagcccgctcacggcgttgctaatgcgacatacgatacgaaagggtaa

SEQ ID NO: 23586 - DNA, 219 bp, Glycine max
  Peptide Sequence Number=SeqID_115271
atgtttgcttattcaactttcaaagttgaaccacacatgggcaacccttccccttgtgttcaggaatcctctacaacaagagacccacggtctcttgcccttttcagaaataagaagaagagacctgcggctctcttaaagagatgttgtacaataagactgttcaatcagagattccttattgaatatgcaagtggtggtgaccaaggaatcttttag

SEQ ID NO: 23587 - DNA, 439 bp, Glycine max
  Peptide Sequence Number=SeqID_115272
cgtgccgatcaacgtctcattttcgccaaaagtggcccagggcttcccggtatcaacagggacaccaggatttatttttctgcgaagtgatcttccgtcacaggtgctccagtggcttctgtttctatcagctgtctcctcctgttcagctactgacggggtggtgcgtaacggcaaaaagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttgggtaacgccagtgttttcccagtcacgacgttgtaaaacgacggccagtgaattgtaa

SEQ ID NO: 23588 - DNA, 375 bp, Glycine max
  Peptide Sequence Number=SeqID_115273
atgaccgaccctctcaatgagtcaatctcttgctttctcataagggtggacccttgggcagtagtaccctcaccttcaaaggactacacgtccttgccatcagagggctgcatgccctcgccttcaaaagactactcgtcctcgccttcagaggactacccgtcctcatcttcagagggctacgcgccctcacctttagaggactacacgtcctcgccttcagaggactacccgccctcgccttcagaggactacacgtcctcgcctttagagggctacatgccctcgccttcaaagaactacatgtcctctccttcagagggctacattccctcacctttagagggctgcacgccctcactttcagacgactag

SEQ ID NO: 23589 - DNA, 474 bp, Glycine max
  Peptide Sequence Number=SeqID_115274
atgaataacttagatcataaatctttaacctttttttctcagatgacagaccaacaagcacaaatttataaccgaattattcaggttgtcaatcaaaataaaggtgggatgtttttcttatatggatatggaggaacaggaaaaacatttatttggaaaacacttgcagcctcattgagagctgacaataaaatagttgttatggttgcttctagcggcatagcttctttgttattgcctggaggaagaacaacacattcaaaattaaaaattcctgtttcgatatttgaagactcgacatgcaatattcatcaaagaacacaattggctgaattattgaatgaagcaagtcttatcgtatgggatgaagcccccatggctcacaaattctgttttgaagcacttgatcaaagtctaagagatgttattaaggcaaaatcaagttctgataaaatctttggtggtaaagttatg

SEQ ID NO: 23590 - DNA, 522 bp, Glycine max
  Peptide Sequence Number=SeqID_115275
atgtgtagaaactgccgaatcgtcgtggtatcactccagagcgatgaaaacgtttcagtttgctcatggaaacggtgtaacaagggtgaacactatcccatatcaccagctcaccgtctttcattgccatacgaaattccggatgagcattcatcaggcgggcaagaatctgaacggtctggttataggtacattgagcaactgactgaaatgcctcaaaatgttctttacgatgccattgggatatatcaacggtgttggaacctcttacgtgccgatcaacgtctcattttcgccaaaagttggcccagggcttcccggtatcaacagggacaccaggatttatttattctgcgaagtgatcttccgtcacaggtgctccagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 23591 - DNA, 322 bp, Glycine max
  Peptide Sequence Number=SeqID_115276
tagtcatgactcttgcaagagtttaagtgaagaacttagcgactattgtagagggcgtcattgttcacatactaaacatcattcccaaagaagagaaaaggatagaaggcctcaagaggttaacattagcctcccatatttccatggaaaagataatgttgaggcctacttagattgggatatgaaggttgaacaactctttgcttgccatcatattagcgaagagagaaaagttccattggctaaggctttcaagggtatgtcctctattggtggacttcccttgttagggaacaaaggatcatgtgggatcctccaatag

SEQ ID NO: 23592 - DNA, 480 bp, Glycine max
  Peptide Sequence Number=SeqID_115277
atgcaagctggcacgacaggtttcccgactggaaagcgggcaggaacaaaagctggtaccgggccccccctcgaggtcgacggtatcgataagcttgataataaaacgcactgtggtgcggctgatgttgtacatttccgccagcgcactttgcgatggaagtggggaagggatatgaccccgcgccatatcatcaatgacctgagcggccgccaccgcggtggagctccaattcgccctatagtgagtcgtattacaattcactggccgtcgttttacaacgtcgtgactggggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtggtggtggttacgcgcagcggtga

SEQ ID NO: 23593 - DNA, 204 bp, Glycine max
  Peptide Sequence Number=SeqID_115278
atgcgtctcccggggaaggagagtctgctgatgaaatctcccccaaccataaatgagattttggatgttagcatttcgtttctaaatgatcatttagaggaaaccctgggttcgaaaaaaatagaagaaatctactcaaagtgtatcaatctcgcacagtgcggggcgaaagaggtcgctagcgcacgggattttggttggtaa

SEQ ID NO: 23594 - DNA, 153 bp, Glycine max
  Peptide Sequence Number=SeqID_115279
atggatcgtctcaagtggtatggcctaggatcttcttcatcaatggattcctttgcttcttggaagatgaatggcagcagaatggagaaggaagagagaaaggagatgccacttcaaggagaagatgagtctagaagaagctcaccaccatag

SEQ ID NO: 23595 - DNA, 237 bp, Glycine max
  Peptide Sequence Number=SeqID_115280
atggcaggagctggtgatggtggtggtgattatcatcaattggacggatctcagtgcttattactggacgcgatgactacacaaatgcaacaattgctaaatcgtaacaatgaagagctctacagacgaatagaaggactagagcaccaaatgaacccaaatgctgggagaccttatggtaggaacaaaagggtcaataatggaccgaaccgaatagaaagggcaagacagaattga

SEQ ID NO: 23596 - DNA, 306 bp, Glycine max
  Peptide Sequence Number=SeqID_115281
atgattttgagggggagtagtatttgtactgctgctgctgctgatgatgatgataatattcacttcacagcagcaagagcatggagacagggggagcagaaagctgatgtcacgaaagctggagttgctgcacatgatgtccaacattatgtcaaggaatcagattgggctgcacaatgcacaaggcaagataaaatgtcaaatgaagaattgaagctgcaggatccacgatgtcggatacaatgtccaggacatcctgcccgcaaatactggacacataaatctgttatatctttaacagattaa

SEQ ID NO: 23597 - DNA, 597 bp, Glycine max
  misc_feature (21)..(21): n is a, c, g, or t
  Peptide Sequence Number=SeqID_115282
gtttggattggctcccgagtntgagaaccgctaaaagggaggaagttgaggcaccagaggaagacgaagaggagaatgccgaactgagagatataaatatagctaccaccaaggctttggaacaagagaccaagagggcttgtagggaagaacacggccggaacaaattccgaggggctctatggggtagtaacaacgagcttaagctccggagagaggaaagggaccaatcacgagtcgacagtttgatcttgaaagatgaattgaaggcttgctcgagatccaaaagaagtttgtctcagcggttatgcgagacagagaccaacatgttagctatcatcaccaagtatcaagaagaactaaatctagccgcgacccacgagcatagagtggcggacgagtatacccaagtgtacacggaaaaggaggctagaggaagggtgatcaaatctctacatcaagaggcaacgatgtggatggaccaatttgcccttaccttgaacggaagtcaaaagcttccccgactactagctaaggccaaagtgatggtggacacctactccgcccccaaggagatccacaggcttctcagctatt

SEQ ID NO: 23598 - DNA, 210 bp, Glycine max
  Peptide Sequence Number=SeqID_115283
atggagggggattcaatcatacacacagtggcatatgcagatgatgttgtcaggcatccacaacgtattccacacaacgaggatgcacatgtgccgaagccggctaatgtgaacgcagatgatccgttgcgtgaattgatgaagtacagtttcgatctttacgacaagccacttcaatcagctttgatgggaggatttctgggattgtag

SEQ ID NO: 23599 - DNA, 629 bp, Glycine max
  Peptide Sequence Number=SeqID_115284
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgaaagttggcatcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 23600 - DNA, 285 bp, Glycine max
  Peptide Sequence Number=SeqID_115285
atgttggccatcatcaacaagtacaaagaagaattaaatttggccaccacccacgagcacaaagtggcagacgaatacgcccgagtgtacgcgaaaaaggaggctagaggaaggagaagcacaccggggcatatcagcaacccccatccggggtacaaccgaggtgcttacccctacagtttaccacctaactacacaccaccagccatacatgaagacatgggtcacgttcctcccctcatcctcgaaggggagcctctttggcatcctgacggggtccactaa

SEQ ID NO: 23601 - DNA, 138 bp, Glycine max
  Peptide Sequence Number=SeqID_115286
atggagaattgcactaggcaatcaaactacgcatggctccaactcatgggtggaggatgcatgaacgaaatcaaattcatggggctccaagaaaattcaggggaacacttactcggttacagctggaactgggaataa

SEQ ID NO: 23602 - DNA, 313 bp, Glycine max
  Peptide Sequence Number=SeqID_115287
atggggatcgcacccacagagacacccagtggacctgaagaagtccaacagggccctgggggatcgcacccacagagacacccagtggacctgaagaagtccaacagggccctggggtttccagctctggttacgggcctctgtcggccctatagggcgcccgttccccccaccaagttcatgtcatcgtggcatagggattgtgcccacaagacacctagtggacccgaagaaggccaacagggtcttggagttgccagctctaaatacgggtctctgtcagttctagggagtgcctgtcgcccccagcaag

SEQ ID NO: 23603 - DNA, 291 bp, Glycine max
  Peptide Sequence Number=SeqID_115288
atgaacaaattcttcagatacactttgttaaaccagattcgtaaaagatcttctaaaaacatcgctcaattcttggattcgtttccaagctgtgtagattacttgcgtaaaaaaggcgctaaagtagctgctaggcaaaagatcgcgactctaacgattatcatcgctaaagctgacctgctgatggaaatcaggatcgcaaagattgaagttaccactacgcaaactgaattcgtagctaaaaacgcagacttcgtagctttcgcgaaaaaattgcagatcttgcattaa

SEQ ID NO: 23604 - DNA, 153 bp, Glycine max
  Peptide Sequence Number=SeqID_115289
atggtgtggcgtctcctctcaactcttcttcttctctattctgctgccattaaaattcaagaagtaaaggactccattgatgaagaagatccaaggcctacaagctccacatatggagctacatcatgtggtatcaagaacatcttcatctag

SEQ ID NO: 23605 - DNA, 300 bp, Glycine max
  Peptide Sequence Number=SeqID_115290
atgggtgccaaatacctcgaagtggtcaaacgagggttgcatcccaacaacagatggtccccagacgaaattaggaaaacactcaagaaattcattatatgggaaatcaacagcgacaaagggtatactcaaggaggattttttggctttcagcagggtccttataatcaacaaggacagtggaggtcgcaccctggtaatcagttcaacaaataccatggtggaccttcgaacaggccaatccaacaagggcctaacatctttcagaggactactaagctgaatgagactttgacttaa

SEQ ID NO: 23606 - DNA, 280 bp, Glycine max
  Peptide Sequence Number=SeqID_115291
tgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacaccccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 23607 - DNA, 516 bp, Glycine max
  Peptide Sequence Number=SeqID_115292
atgacattgctacttagcaacattctgcccagcgaccgcattgccaatctccccctgcaaaagtatcagttggtctgtgtcgtcccgacgtggggatcgcacccacagagacacccagtggacccgaaaaagtcaaacagggccctggggtttccagctctgggatcgcgcctgcagacacccagtggacccgaagaagtccaacagggtcttggagttgccagctctaaatacgggtctctgtcagttctagggagtgcctgtcgcccccagcaaggtcatcaggtcccccctaccaatcgagctttcatcaagaagttctgcgtctccaggcaggcgcagggcgaaacaccacagcagcctggcgatggccggcagcgggcaacagacgcaccgccatcacctctagagttcacctctgctcatccacaaaaaggtttgagtattgcctacaccacatggccgaccaataggcgaccaagtccaaagccaaaggacgcacctagttgctcatga

SEQ ID NO: 23608 - DNA, 171 bp, Glycine max
  Peptide Sequence Number=SeqID_115293
atgtctccttacttgaggctttctttaacctcagctcagattatgggagtgaggtctaaaggatgtgaccatcccttgatagtcacgaagtttttcttcctcattcctcttatctttctagttagttgtcttgtccacactgtgaagggatttgaggcaacacaaatttaa

SEQ ID NO: 23609 - DNA, 479 bp, Glycine max
  Peptide Sequence Number=SeqID_115294
acgatggggaaggagatacccatcttggccccctgctccacctcaaagatccgtccccgcatgaactaccccagccgaacatagtccgccatatcccggcctcacccacacccgtaaaagaatctgttccctttgcggaagataagggaaagattgaggcgcttgaagagaggttaagagcagtcgagggcctcggtaattacccattctcggatttggcggatttatatcttgtgcccaacatcgtcatccctcccaagttcaaagtaccggactttgatcagtacaaaggacgacatgtccgaaagggcatcttcggatgtattgtcgaaagatggggggcatattctgcggacgaaaagctgttggtccattttctttcaaagacaggcttggccgggagcggctgtggcatggtataccaatctggaagcttcccagatccgatcatggaaagacttggcgacttccttcattag

SEQ ID NO: 23610 - DNA, 618 bp, Glycine max
  Peptide Sequence Number=SeqID_115295
atggctaagctaacgaccaaaaatcagcaacactatttaaagcctgaaatcataaatggaaaggagttcttaatttttggcgttttctctattcttggaagcattcatctgagtggcagagagaacttctggtgtgaagatcctaagggacagcagagattgaagacgaagttatcttgcaaagtattggatgagagtttgagtgattgtgaggtttctagagagaagcttcctagctatggagagctaaatcctcagttggttcttcctacgagatggaggaagaatgctatggtattacaaacacctggggagaaagaatttgaatatgtgacagaatgccttgtcaatgaagatggaggaagaatgctagcttatattaaaaagctgggggatccaaatgatgaatctattggtcatgtgatgtttgaagaattggaaaacaatagacataaagaaaagcccaaagtagaattaaagacccttccagcgcatctaaagtatgtattcttggaggacaatgagaccaaacctattataattaacatctccttgcagaagaaagaagaggatcaattggtacagattctgaaaagtcacaaagccactattggttga

SEQ ID NO: 23611 - DNA, 261 bp, Glycine max
  Peptide Sequence Number=SeqID_115296
atgatgacaaaggtgatgaacaaaaagctcaaaagatcaaagaacaactcaagtgaatcaaagaacatctcaagtgaatcaagaacaagtcaagagttcaagaatcaagaagaattcaagactcaagaagaaagcctacaatcaagaatcaagattcaagattcaagattcaatatctcaagatctcaagaatcaagatcaagattcaagactcaagattcaacaatgaagaaaaaactcaatcaagataagtattaccaa

SEQ ID NO: 23612 - DNA, 282 bp, Glycine max
  Peptide Sequence Number=SeqID_115297
atgtataaagagagggatgttgttataactgtcatagcctgtgtggtatggcacccccgtggtagggatcagaaccgtgatgtcctcgaccgcatcaccgctgtgctggaaactctagtgcaggaacgtgatgtggagccggcagagtatcggggactcatggctttccgtaagaactacccgccaaagttcagtggagactatgatccggaaggtgctaggttgtggttagctcagacggagaagattttcgaggcgatgggttgccgtgaggagcataag

SEQ ID NO: 23613 - DNA, 276 bp, Glycine max
  Peptide Sequence Number=SeqID_115298
atgtcaggatttacacgcgattctcctcaaatttcagccagcccgcatcaattagaccttgcaccttacgcttcagagccctacaatgctcaatggaacgccccggggcttctccgtgacaagcacacgttgcgttcgagttgtattctcggagaaatggaggttgatgaaccttggctagggttatggccaccattgaattatcaagtagatatgggagcaagtcagcataggacactggaattggggtggtgtttagcattggtcgtgtcgtag

SEQ ID NO: 23614 - DNA, 852 bp, Glycine max
  Peptide Sequence Number=SeqID_115299
gtggccaaagatcaactaactattaaagataagagggatggggaagaaaaactagaaaaacaaaagaaaaagaaggatagtaaggccttgtcttcaaagtccaaggggaaggaaaaggattcctccaagaagattgttaacaaggaaaatcattttgtaacaaaatgtgatattaaaatagcactctttcttaaacaatctttctaccttctcctatcacgggaaacatcccttagcaccgccatacctcttgagcttgaggttattcctcaagtaaaggagttgttggatgagggtttggttcccaagagcttaaatccttgtactttgttagtgcctaaaataggtattattaggcaccaaatccctatgataggtggtatgatgaatgtgtcgtgtggtgcaacactcttttgtaaaatcactcatgcaccaaccaccttcatgatttgtgtacatagggactcattaggtaggaataatcaacatgaaaataaagaaaaaggtatgttttattccaatacttttcttaactttttaaatactgatcaagggcttcccatggaccctaagagaataaaggtcattcctgagtggcctactccaacatcaccactcattgagttggtgaggaactatgttccctcatgggaagatgcccaggaaaggggttttcagtccttaccctactctaacatatccaacatcactaatacatatggggagggaatgatgcaatcctaccccctaagggcattagttagaagactccaagaagattgggccagagatgcaagagaaggccctaaggttctcatgagccttaggatagattttgggcccatgagctaa

SEQ ID NO: 23615 - DNA, 357 bp, Glycine max
  Peptide Sequence Number=SeqID_115300
atgattattgaagaatccattcatgtttcttttgatgaatctaatgcaattttgccaagaaaagatatactagatgagatttcagaatcattagaagacatgcatattcatgtagaagaacacaaaggaaaaggagatggaaataatgaagatcctcaaattgatgaaatcaaaacaaacgatgatcttccaagagaatggagagcttctagatatcatcctcttgacaacatcattggtgatatatcaaaaggggaagagttaaagcaatgtgaaagaaacaatgtttgggagttggttgagaaacctgaaaattacccagttattggaacaaaatgggtatttaaaaacagttag

SEQ ID NO: 23616 - DNA, 135 bp, Glycine max
  Peptide Sequence Number=SeqID_115301
atggcgtctgtgccatatacccttagacatatcgagtctagtgtgcatggccttaaggatgactttgttggttgcctctgcttgaccgttggtctagggatgttcaacagaggttacgaggtgctttatgcctag

SEQ ID NO: 23617 - DNA, 297 bp, Glycine max
  Peptide Sequence Number=SeqID_115302
ttggcccaagagcttcccggtatcaacagggacaccaggatttattttattctgcgaagtgatcttccgtcacagtggcttctgtttctatcagctgtccctcctgttcagctactgacggggtggtgcgtaacggcaaaagcaccgccggacatcagcgctggcaaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 23618 - DNA, 235 bp, Glycine max
  Peptide Sequence Number=SeqID_115303
atggagttgcaaagactaaatcaacatgaagtaaacgacaaaaggaagaagggaatagcactcaaagcttcatcttctattcaagaagaaagtgacaacgaagacttggaagaagatgaagatctcagtctttttgtcaaaagatttaacaagtttcttaaaatgagaggaaatcaaagatgtcagaacttcaaaccaaaaaggagaactgaagaatcatctcaaactttaagat

SEQ ID NO: 23619 - DNA, 456 bp, Glycine max
  Peptide Sequence Number=SeqID_115304
atgaccgtaccgatatctgcgccgagtttattcgccacgaacagcgcggccggatgcggcggcaccacgcaatgcaccgccatcagcgcggtacacagggggatggtcagcttcagcagcgaggtattggtttttttggcaatggagaacgccagcgggattagcagcaccacgccgacttcaacaaacagcgtaataccgcagatcaggccaaccagcaccataattacgtccgccgacaaccagcgacagcgctgcagcgccaggccgatgcgttccgccgcgccggagacttccatcatcttcccgaggatggtaccgagaccgatcaccgccgccaggaaaccaagcgtaccgccaataccgctctcaatggcgttgaccatatccagcggccccatgcccatcatcgcgccgacgaaaaagctcgccagcaggagcgccagaaacggatga

SEQ ID NO: 23620 - DNA, 243 bp, Glycine max
  Peptide Sequence Number=SeqID_115305
atgttttcttgtatgcaaagaagatctactgcaggtgatttgatccccattgatttggagattaacgccacttgtagaaggcgtaatcaagagagaattagaaaatttttgcaggatttagaagtagcagcaattccagagaaagaacctcaatcttctgaggcatcttctagttttcctattgcagaacattctcatttagacctatcaaagaccacatcatggctgaaggggatcctctag

SEQ ID NO: 23621 - DNA, 734 bp, Glycine max
  Peptide Sequence Number=SeqID_115306
gacttccaaatggtgtcgactatgaagagttgaggaaatataaggatgccctcttggggggaagaaaaccgtatcttttctccgggtttcttccctccttgaacaagattgcagctgtggttggagattcggcaaaagagatggatcgcatgaagcaaacttggaacggcgtagtgggcttgcctcggaaatacttggaaggcaaggcaagggatatggcgaaccaagagaagtggggcccgtttgcggatatattagctttgttgatttttggggttgtcctctttccgaacgttgacggtttggtggacttagccgccattgatgctttcctcgcatatcaccatagcaaggagagtccagtggtggctatcttggcagatttgtttgacacctttgaccggaggaagagtcgattgggaccaacatttggctggataggaggcaacgcaatcaattggtttcctcattggaaggaaggcaaggaaggagttcttttctcgtgtggggactaccctaatgttccattgatagggactaggggttgtattaattataatcccgcactcgccataagacagctagggtaccccatgaggggaacgccaacagaagaaagtctctcgcctttccttgtgagggatctaggcgcgcaaagtctcaaggtgatacaaagagtccacaaggcatggagaagtccgttgaggaaagacaaggagcttagaggcatctaa

SEQ ID NO: 23622 - DNA, 843 bp, Glycine max
  Peptide Sequence Number=SeqID_115307
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgacagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacgggcggagatttcctggaagatgccaggaagatacttaa

SEQ ID NO: 23623 - DNA, 162 bp, Glycine max
  Peptide Sequence Number=SeqID_115308
aacagtggagctttcgatcaagacgttctcgcctcccctgtttgggctctcgctcgaatcggaacctttatgcgttggaaggagtttgactgctgggatggggtcggatcctactcgaagcactccaccatgaataagaatcttcgggtggataggcagtag

SEQ ID NO: 23624 - DNA, 132 bp, Glycine max
  Peptide Sequence Number=SeqID_115309
atggactcaggaaggttccaagttagtataccagggacgactgccccagtggttcttggggcaagtagtccccttgtacttatcgaattctggcaccttgaacttcggaggaatgatcacgtcaagtactag

SEQ ID NO: 23625 - DNA, 273 bp, Glycine max
  Peptide Sequence Number=SeqID_115310
atgccaatctccccctgcagatgtatcgggatcgcgcccataagtcacccagtgggcccgaagaagtccaacagggccctggggtttccagctctggaatcgcacccacaaagacacccagtggacccggagaagtccaacagggccctggggtttccagctctggttacaggcctctgtagtcctacagggtgcccgttccccccggcaaggtcacgtcatcatagggatcgcgcctgcaagacacccagtggactcgaagaagtccaatag

SEQ ID NO: 23626 - DNA, 174 bp, Glycine max
  Peptide Sequence Number=SeqID_115311
atgggggtgcaaatagcacccaggcccacttcgacgttcttcatcgttcttcgatcttcaacggaatcacttgataagaaagaactacgtaggtctgatttcctcatcgcaattgaggaatacgtaggagcaaagggaaacacccttgtcgaccacaaaaagagaaaaatataa

SEQ ID NO: 23627 - DNA, 201 bp, Glycine max
  Peptide Sequence Number=SeqID_115312
atgccatgcaagcatgtgctcaatgtgtcatcagctcgcctagctagtcatctgtctcttctggcgcttagcgcgtctggctcgcttagccaaagatcacttactcacgttaagtgcgaaaatggcgttaagcaagccttcaaggatagaaagccctttttaaagcctgaagtgaaagaaaagagagagcttggcggatag

SEQ ID NO: 23628 - DNA, 297 bp, Glycine max
  Peptide Sequence Number=SeqID_115313
atgcttaaaggaagtgaacggattagcatgggcagaaatgtctccgcattgattggtaaatctgttcctcaaattcttgaaaaatgcaaagattcaggccccttgcagtcaactgatgtggtaattcatttagctaatagaagtgttgcctaccctgttggtttcatagaagatgtcttagttagagttggtgaactgattttccctgttgatttttatattttgaatatggaagatggattttctcaaggatcagttcccatcattctagggcagaccctttatgaaaactactag

SEQ ID NO: 23629 - DNA, 465 bp, Glycine max
  Peptide Sequence Number=SeqID_115314
atgttgctgcgcggggtgtatgctgacctcccgcgagcacccgcctcgtggttggttgaaatctgggttcatggccgacttcgccgtgataaaatggtggatgagccacgctcgagaccaatcacgtgcgagccggtcagttctggacccatcgacgaccctttgcgtgcacgcacgctcccaacgagacctcagaagcgtcctcagtggcggaccgggcccaagtcccctggaaggggggcgccagagagggtgagagccccgtcgtgcccggaccctgtcgcaccacgagggcgctgtcgggcgagtcgggttgtttgggaatgcagccccaatcgggcgggaagcggatgggggccggcgatgtgtcccggtcggatgtggaacggtgagagccggtccgccgatcgactcgggacattgaccgacgcggattgcgatggtggcccaagcccgggctgttga

SEQ ID NO: 23630 - DNA, 384 bp, Glycine max
  Peptide Sequence Number=SeqID_115315
atgcagctggcacgacaggtttcccgactggaaagcgggcacggccgccaccgcggtggagctccaattcgccctatagtgagtcgtattaaaattcactggccgtcgttttacaacgtcgtgactgggaaaaccctggcgttacccaacttaatcgccttgcagcacatccccctttcgccagctgggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggccgtggctgtttgccgttacgcaccaccccgtcagaagctga

SEQ ID NO: 23631 - DNA, 371 bp, Glycine max
  Peptide Sequence Number=SeqID_115316
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatggccaaaatacaagacccaaaagaaagaaaacttattctaatatttacaaataagggtggacccaaccttggtccatgggctcagaaatctatcctaaggttcatgagaaccctaggatag

SEQ ID NO: 23632 - DNA, 384 bp, Glycine max
  Peptide Sequence Number=SeqID_115317
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcgtaaccaccacaccccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaa

SEQ ID NO: 23633 - DNA, 174 bp, Glycine max
  Peptide Sequence Number=SeqID_115318
atggggatacaaaagaattctcaggcgggagaagggagacacaaaagaattcaggcgggagaagagatgaaaagaatgaatagcacaagttttcaaggtttagaaaaaccagaaaactcttggaaagcttttggcacaaagaaagaagaagaagttcaaagagattcaaggctt

SEQ ID NO: 23634 - DNA, 105 bp, Glycine max
  Peptide Sequence Number=SeqID_115319
atgaaaattctaagttcgggagttgtatttacgcttgaggtcgacaaaagcggggcttttgctcctacgtaccctccatcgaagaggaaaatcagacctacgtag

SEQ ID NO: 23635 - DNA, 204 bp, Glycine max
  Peptide Sequence Number=SeqID_115320
atgtctcctccacctctagaaacctcacaatctctcaaaacctcgtcaagctggtcgaacccagcaagtgcactagatctcgcaagtagtataaaacggaagggaccagtcactagagccatgagcaagaggctccaagaggattgggctagagctgctgaagaaggccctagggttctcatgaacctcagggtagatttctga

SEQ ID NO: 23636 - DNA, 450 bp, Glycine max
  Peptide Sequence Number=SeqID_115321
atggaatcgagagctccaagtgggccatttttgcctgcccaccctggaaacggctcagccggaggtagggtccagcggctggaagagcaccgcacgtcgcgtggtgtccggtgcgccccccggcggcccttgaaaatccggaggaccgagtgcctcccacgcccggtcgtactcataaccgcatcaggtctccaaggcaagggaagtcggcaaaatggatccgtaacctcgggaaaaggattggctctgagggctgggcacgggggtcccagtcccgaacccgtcggctgtcgggtggactgctcgagctgcttccgcggcgagagcggttcgtcgcgtgccggtcgggggacggattgggaacgggctctttcggggcctcttctccgggcgtcgaacagtcaactcagaactggtacggacaaggggaattctgactggtttaattaa

SEQ ID NO: 23637 - DNA, 474 bp, Glycine max
  Peptide Sequence Number=SeqID_115322
atgaccaccttgactcagatgtggatgacgttgctgctcagcaacgtcccgcccagcgatcataactctgacctccttttgcggaagtgtcagctagtgtatgccatcctgacacggatgagcgtccatgtggctcagtttaccgctgatgccatttatttatttgtaggtatgccacctaccaagcaccctttagacccggataagtctaacagggccttggggtttccagcattgatcacggctctctgccagtcattcggggttcctgtcacacctagtaaggtgattcgaccgccgatcacccgggccttcattgagaagtgttgcacggctagacaggcgcagggtgatgcaccgcaggccgcagacgcaccgccaccgcctcatcaggctgatccagttgggtcatttggcatggagcggtatttacagcacttggttcgccatcaggcagccaaccacagggggcag

SEQ ID NO: 23638 - DNA, 231 bp, Glycine max
  Peptide Sequence Number=SeqID_115323
atgagcaaaaggctccaagaggatggggcaagagctgctgaagaaggccttagggttctcatgaacctcaggactcatcttctccttgaagtggtgtctcctctctctcttccttctccattctgctaccattcatcttccaagaagcaaaggagtccattgatgaagaagatcctaggcctacaagctccaatggagcttacatcagaagctgagttggcaacttactga

SEQ ID NO: 23639 - DNA, 132 bp, Glycine max
  Peptide Sequence Number=SeqID_115324
atgtctacccaaggtgcagaggggatgggtaaggaaaaggatgggaaattggcaagattcaagggttgggtagtggctaatttccagggtcttaataaggtggatcttggcataaaatggatgaatgggatg

SEQ ID NO: 23640 - DNA, 195 bp, Glycine max
  Peptide Sequence Number=SeqID_115325
atggtcgcatggcccgaagattggcccgaggcccaggcaggggaggcgcctgcaggagctcccgacgatgcagaggaggcccgtatggataaggagatgatggacttgctcggtttcttgggtggaagcggagccacggtgaatgctgtgaaagttttcccgaacacccaaaaatggactcggatgaatgcctga

SEQ ID NO: 23641 - DNA, 159 bp, Glycine max
  Peptide Sequence Number=SeqID_115326
atggcaccaaaccacaagacaatggaggagatacatggagaaaacgatgaagaacaagaaattaaatggaatggaaaaggaggaatggtgattggagatgccacttcaaggagaagatgggtcaagaacaagcttaccaccataggaggccatgaataa

SEQ ID NO: 23642 - DNA, 819 bp, Glycine max
  Peptide Sequence Number=SeqID_115327
atggaagaaagcatgtctcctttccttgtaagggatttcggcgcgcaaaatttcaaggctatacaaagaatccataaggcatgggaaaccccattaaggaaagatcaagaacttaggggcattcgtaacggcatcattggtggttatcatgaatggctgaaagttcatgtacgagtttcgaagcaccggaagagacgaagaagtccaagctctcaaaacgagttaggaaaggcgaaacttgccaaggagaagttcaagttagccgctacacacatccggaaagaatgtgccggattacgggaagagaatgcaactaccgcaagagcccttgagcaagagaccaagagggctcgcaaggaagagtatggccgtaacaaatttcgcggagctctgtggggtagcaacaatgaactcaagctgcgaagggaagagagggaccagtcgcgagcacatagcatggtcttgaaagaggagttagttgcctgttcaaggtccaaaaagagcttgtctcagcgtttatgcgagacggagaccaacatgctagctatcatcgccaagtaccaagaagagttaggtctagccacggcccacaagcatagggtcgtggacgagtatgcccaagtatacgcggaaaaagaggctagaggaagggtgatcgactctttacaccaagaggcaaccatgtggatggatcggttggctcttaccttgaacgggagtcaagaacttccccgattgttagccaaggccaaggcgatggcagacacctactccgccccgaagaaattcatgggcttctcggctattgtcagcatatga

SEQ ID NO: 23643 - DNA, 237 bp, Glycine max
  Peptide Sequence Number=SeqID_115328
atggcagcgcaagctcgacaggtgttttatgtagaagatccatgcgactctagatgggcagtggttttgcaagggagaacaatttgtatcggtcacgatgttgatggattaacacttgatgtcactgacatgccatctttctccaaagatattccttcaactactgttgaacaagaagaggatgatggccatggcaacaccaccaccgtccccgccacaatcataaaaccctcctga

SEQ ID NO: 23644 - DNA, 178 bp, Glycine max
  Peptide Sequence Number=SeqID_115329
gcgtaacgaatacggggaggccacaagcagccatgtgaccattgggtaccctgggtatacgttttatccagggagcatagcgactgataagtcgattaaagttctccttaatcgaaccaaccagccccaccacctcgtcaatattatcgggtggggatattatactagaaaacgttga

SEQ ID NO: 23645 - DNA, 800 bp, Glycine max
  Peptide Sequence Number=SeqID_115330
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggttttcgttgctcttgatcatgattttgaccctaaagtggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 23646 - DNA, 405 bp, Glycine max
  Peptide Sequence Number=SeqID_115331
atgatcaagagcaacgaaaactggattacaaagacattagtaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 23647 - DNA, 94 bp, Glycine max
  Peptide Sequence Number=SeqID_115332
gttgcttcaacaaacaagcattgcttcaagattaagcttttgcctcaaaacaaagtgtttccaagagatcaaggctctggtaatcgattaccag

SEQ ID NO: 23648 - DNA, 396 bp, Glycine max
  Peptide Sequence Number=SeqID_115333
atggataatgaagagggcgtgcaggaacagatgaagaaaaccatagaggataaagccacggcaaccgcctccagtacagttagggaagcggagccggtgctgcagcccgccttgaatccgggcctagacagaaacacggccgttttcggtcgaaggtatagtccacaagcttatccttatggcttgcctccggatttcactccccgtgccaccccgaaagatctaagccaagcccctacttttgaggggcaactcccgccttatgacgactatcccggacaagacgatggggaaggagatacccatcttggccccctgctccacctcaaagatccgtccccccatgaactacccccaccgaacatagtctgccatatcccagcctcacccacaccc

SEQ ID NO: 23649 - DNA, 456 bp, Glycine max
  Peptide Sequence Number=SeqID_115334
atgatgacaatgatagtagacacattaccagtattctactatggaaaatggtgggctatgcaccttcaaagctttgaggatttggtctttgccagtgaaaggatcgatgtgggtctaaaaaaaggcaaatttagtcatcctgcttggacgaatgagaaaactggggcaaatgaagagggtgagaaagagggagaaacccatgctgtgactgtcattcctatacggccaagtttcccaccaacccaacaatgtcattactcagccaataacaaacctcctccttacccaccacccagttatccacaaaggccatccctaaatcaaccacaaagcctgtctaccgcacttccaatgacaaagaccacctttagcacaaaccaaaaatacaccaacaaaaaggaattttgcagcaaaaagcctgtagggttcaccccaaattccgttgtcatatgctaa

SEQ ID NO: 23650 - DNA, 174 bp, Glycine max
  Peptide Sequence Number=SeqID_115335
atgggggaagatgtggccgaggagttgaaactccagcatgcaaacaacttccaaggtgtcaccctacgttgggaggcaaatcacatgatcgaggaagtccatgagggctcgtttggaacacacgccaacgggcatgctatggccaggaagatcctaagagcaggttattactag

SEQ ID NO: 23651 - DNA, 357 bp, Glycine max
  Peptide Sequence Number=SeqID_115336
atgcggtacgactttgtggctgcgagtcttccctccatattccttaatggacttcagctctcgttagtcatgagccctgaagcaattcttccgtcgggaccagtttccgtattcgttgcagtgattgatccggatgcaagctgtctaaagaaatgtcgaccaacaacttctcgtttgcccgcggaatacgcccccatctttcggcaatacatcgaagatgcccctcggacatgtcgtacctttgtacttatcaaagtcctggtcgcgccgggggctgtattattaactggccggggtgcggctggagctgtgcgttgggccggcgctctttctgcagcgggtggttcttttacttga

SEQ ID NO: 23652 - DNA, 360 bp, Glycine max
  Peptide Sequence Number=SeqID_115337
atggtggaggatgcacaacagcgcttggcatttcgcggactcaatggtggaggatgcatgaacgacaatcaattcatggggctccgaataagacttgatgatcggggatgcatgaacagggctaggcaatcaaatcgtcgggtttcggattcaatggtggaggatgcatatggtggaggatgcacgaacagcgctacgcaatcaattcgtggggctcctaataagatggtggaggatgcacgaaaagcgataggcaataaattcgtggggctccgaataagatttgatggtgaaggatgcacgaacagcgcttggaaatcaattcgtggggctccagactcagtggtggaggatgcatga

SEQ ID NO: 23653 - DNA, 669 bp, Glycine max
  Peptide Sequence Number=SeqID_115338
atgggtgatcaagaggagacgcaggaacagatgaaagccgacatgtcggctctgaaagaacaaatggcctccatgatggaggccatgttaagtatgaagcagctcatagagaagaacgcgaccaccgccgccgctgtcagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccgtcttgcaagaagatgcgggccacattgcttctcccgtccatgaaagagagcctcctcagcagcccgacgaagtccacaaagaccctcaagattatgctcgaagggatgtcgagttctatcccccgatccccgaagggccggcaccaggcacgttgcctcaacccaacatcgcagcaccaccaatagttttgtccacggaagggccgccctcagcaactgaagaaaggaggaagctcgatctccttgaggaaagattgagggccgtggaaggatttggggactatccgttcgcagacatgacagatctttgcttagtaccgatgtgtatcccccgaagtccaagtgccggacttcgacaagtataa

SEQ ID NO: 23654 - DNA, 570 bp, Glycine max
  Peptide Sequence Number=SeqID_115339
atgcggagtggattaatatctggaaaaacaaacacacccgatgttttagctgggcaatgggttgaaggaatagtggcacatacaccagtgtacatggaatggtataggaaaaacactactttgttcttgtctgttgcacaacaactacatgatccacgcacaacaattacccataatgttgcagggtcaggtgttgaacaaacgcattttaaaattccacatcctcagtcaatgtattctactccttcacctgttcatcaaacttttggccacactggcgagtcagtcaccgcaaccacccatgaatggataaccgatttatttggcgttgatttcaatacaccaaattcagcggcatcatatttagctactttacaacaattcgatgcaccgcattcatttggagaacaaggtcaaagttcttcagctgcaacaaccaacattgaaaatactaacatagaacaacaacatcatcatgacgtgggagacccagtcatactggaaagaagaaatctgagacgtaatcgacgtccaccaccttgtgggactggtcattgtcttggtcattga

SEQ ID NO: 23655 - DNA, 564 bp, Glycine max
  Peptide Sequence Number=SeqID_115340
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaggctgcaccggtgcgtcagcagaatatgtgatacaggatatattccgcttcctcgctcactga

SEQ ID NO: 23656 - DNA, 402 bp, Glycine max
  Peptide Sequence Number=SeqID_115341
atgcggccgctacagcggcgcgtcccattcgccattcaggctgcgcaactgttgggaagggcgatcggtgcgggcctcttcgctattacgccagctggcgaaagggggatgtgctgcaaggcgattaagttgggtaacgcccagggttttcccagtcacgacgttgtaaaacgacggccagtgaattgtaatacgactcactatagggcgaattggagctccaccgcggtggcggccgctctagaactagtggatcccccgggctgctggaatttggtgtcatattgtctcgataagcgcgactgtgcactaagcgagcaatacgaattgtgcttaaaagtaactgctagttgtcgcaacctacccttcggcgggagggcgacgcgagggctcgcgttgtaa

SEQ ID NO: 23657 - DNA, 439 bp, Glycine max
  Peptide Sequence Number=SeqID_115342
gaagcttttgccagagaggaacgtggtggtctactatacagagttcgatgagttcaaggaggaactcgaaagacgccattgggacaaggagttaactgactttagggatggcaacattgatgttgccattgtgaaggaattctacgccaacctctatgaccccgaggacaaatcacctaagcaggagttggctgctaagctttgtatcccgggaaggggattcgagcttaatgctgatgggcagcccctgaagattttgaggaaaaacatgaccaccttagctcagacatggagtgttctttccttctctaacctgattcctacctcccacacttctgatgttactcttgacagggccagactcatttatggcattattatgaagatggatatgaatgtggggtacctcatttcccaccagatctcccttactgcttag

SEQ ID NO: 23658 - DNA, 207 bp, Glycine max
  Peptide Sequence Number=SeqID_115343
atgacaccggtaaaaccgaaaggcaggaacaggagagcgcacgagggagccgccagggggaaacgcctggggggcggagcctatggaaaaacggctttgccgcggccctctcacttccctgttaagtatcttcctggcatcttccaggaaatctccgccccgttcgtaagccatttccgctcgccgcagtcgaacgaccgagcgtag

SEQ ID NO: 23659 - DNA, 327 bp, Glycine max
  Peptide Sequence Number=SeqID_115344
atgaacgagaagatcgatatcgcctatctctccggcggtgacgcctatttcggcccgaatttcggcggcgcagaggtttatacgcttgcccgcaccggctggccggaaaaatgccccaacgcggcggcgctcttcaaaaacctgaagttcgatatcgccatggaaaataccctcatgggttcgattctcggcggagaggattccaaagccgcggcagcggcctgggtgaaggccaaccccaaagcgctggatggctggcttcagggcgttaccacggcggatggaaaaccgggtgcggatgccgttaagggcaagcttggtctctga

SEQ ID NO: 23660 - DNA, 277 bp, Glycine max
  Peptide Sequence Number=SeqID_115345
agggtacatctacttggagattgttacactgagaacaagagagggtacatctcttgtggataagttcaagtggagggtacatccacttggggattgctatactgagaacaagagagggtacatctcttgtggttcagttcaagtggagggtacatccacttggttttttaaagagaacaagggagggtacatcccttgtggatcttgggcttgtaaaggattttacaaggttgaaagaaatctcaagaaccgcaggttgtttggggactggatgtag

SEQ ID NO: 23661 - DNA, 1010 bp, Glycine max
  Peptide Sequence Number=SeqID_115346
ggccaacacatgatgagattgatttcgagtttttgcgaaacctaagtggggacccttatattctccgcacaaacgtcttcacccaaggcaaaggtaatagggagcaacagttctatctctggttcgaccccaccagaaacttccacacttattctatcatttggaagccccagcacatcatacctacgttttggaaaataaagaagcatggatctagggaagatttctcgagccttccttacatttgcacattgcttaattgctccttatggacttactatggaatcataaaggctagagagtacctcgtggctactgtcaatggctttggcattgtggtggagacaatctatgttattctatttctcatatatgctccaaaagggataaggggtaggactgccattttggctgtgattttggatgtggcaatttcggcagaagcagtagctacttctcaattagcattgcaaggagaagctcgtggtggtgctgttggtgttatgggagcaggcttaaacattgttatgtatttctcacctccctctgccatgggtaaggctgcgtacaacatccctcccccataccttcgcatagcgaagagcctctgggcaatgggatgcttgaaaggccaagttaactctgtcataagggaaaggagcttttgtttttactgcaacaaaaatcttgggcatgatatggacatctacatgtacagtggcacagaagttatctggggccaagaaacttcagttagaagggtacttcttttcatggcgaatgccgagggagatttcgacgagcttgtagatccactgaaggtggaggacaagatcggtgttgtgcctcatggcctttcaaccaattcagatgttgtcaagagatgtgcgttttttggttgcgggaaaaatttgcaaatggaagaaatgaaggttgatttagacttgttggtgggtgaccctgcttcactggagaagaaaattgatgcaattcgtttcggtggtccctag

SEQ ID NO: 23662 - DNA, 131 bp, Glycine max
  Peptide Sequence Number=SeqID_115347
atggaaaaaatatggggcatccccttttatctcggaactgctggccaaacccacgccctaacatatgtcatgtccagccgttctacaagctttgagccgaaatcccaacttaccataaaccttgacccaag

SEQ ID NO: 23663 - DNA, 513 bp, Glycine max
  Peptide Sequence Number=SeqID_115348
atggcttctatgatggaggccatgttaggaatgagacaacgcatggagaataacatagccaccgctgccgttgttagttcggctgccgaagtaaacccaactctcccagctaccgcgcaccatcctctcccaaacgcggtaggacgagaaaggagcacactagggcacaccagcaacccccatttgggatacaaccgggtggcttatccttatggattaccaccaaattacacgccaccagccatgcgtgatgacgcgggtcatgtcccttcccccatccttgaaggggagcctcctcgacaggccgacgaggttcatgaggatcatcgagagtatgcccaaggagatgtcgatttctaccccccggtccccgtcgaggggccggcacccaatgtattgcctcagcacaaccccacaacacagccaatattcttgtccacggagggaccaccccccggcggcggaagaaagaaggaaactcaatctcatcgaggagagattaagagctgttga

SEQ ID NO: 23664 - DNA, 282 bp, Glycine max
  Peptide Sequence Number=SeqID_115349
atgtggggcagtaacaacgagcttaagctccggagagaggaaagggaccaatcgcgagtagacagtttgatcttgaaagatgagttgaagtcttgctcaaggtccaaaagaaacctgtctcagcaattatgcgagacagagaccaacatgttagccatcatcagcaagtaccaagaagaactaaatctagccacgacccacgagcatagagtggcggacgagtatgccctagtgtacgcgaagaaggaggctagaggaagggtgatcgactcgttacattaa

SEQ ID NO: 23665 - DNA, 477 bp, Glycine max
  Peptide Sequence Number=SeqID_115350
atgaagcacttcactgacaccctcatcagtgcccaacatagtaagccagtatacactccgctagcgcccaatacgcaaaccgcctctccccgcgcgttggccgattcattaatgcagctggcacgacagaagaatcctaacagagcaaccggaggaggagctctagagagcaccagaaacgccacaattgcttacagaaaatgcttgagcgactacattgagcccgggggatccactagttctagagcggccgccaccgcggtggagctccaattcgccctatactggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 23666 - DNA, 157 bp, Glycine max
  Peptide Sequence Number=SeqID_115351
atggctcaacctccaccttgtgagaggactcttagggagatggcggcacctgattttacttatgaaagcttgcgcattcaatatcctgatgagggtgttccatatattctcaagactgaactaatacatttgttgcccaagttccatggtcttgcag

SEQ ID NO: 23667 - DNA, 723 bp, Glycine max
  Peptide Sequence Number=SeqID_115352
atggctcgcaccaagaaaacttgccaaatgacatctgaggattccatagaggagcaggcctcacaaggttcctttgtcacccatggacgtgtactaactgttgccattgggcgaccagaacaccctggtcgggtgtgtattgccagagccggtatcacgatcaaacaatactttggaccggctccaaggacctcccgcacgtcttcttccatggctctcgaagacctggagcagctgacacaaaatattagggaccagctggaggagacgatcacaaaaaaagtgactcaacaattaatgttgtccttcagccaaatggagtcccagtttcaatcgcagatgcaatcacatggactcatactacctcctgagcctgaggttggtccttcagctactcgtgtcagcacaaagaagagttgtgttgatccctcagggaacgacccagacacgggtgactcagagaaagacgagttgtacgtcgaggaaaatcctccccacctggttgccctggcaagactttataaggggtcgacaatcgttcacaacatccctttgcacaatgatcaagtcaaggttggtgttgaggaagttagagaaatagatgctctcattcttgtacccactcaagaggttcagttagtggggcagacacttaacaccttcgttgcttggccaacacatttagttaagcatttatcagaacaggcatttcactgtcattaa

SEQ ID NO: 23668 - DNA, 622 bp, Glycine max
  Peptide Sequence Number=SeqID_115353
ggacctcatcaaggctgctggactactgaagacagtcaccaagttgggagactgttatgaaggtctagtcagggaattcattgtcaacattccctctgacatatcaaacagaaaaagtgatgattatcaaagagtgtttgtcagaggaaagtgtgttagattctcccctgctgtgatcaacaaatatctgggcagacctactgatggagtgatagatattgctgtttctgagcatcaaattgccaaggaaatcactgccaaacaagtccagcattggccaaagaaagggaagctttcagcagggaagctaagtgtgaagtatgcaattctacacaggattggtgctgcaaactgggtacccaccaatcatacttccactattgccacagaatctcctctatccctgcattacaaactgtttgaggggacacatgtcccagacattgtctcgacatcagggaaagctgctgcttcaggtgctgtgtccaaggatgccttgattgctgaactcaaggacacatgcaagtgctggaagcaaccatcaaagccaccacagagaagaagatggagtagatgtgatcaaaggcttcagagagtggcattgatgatgaagaagcagtga

SEQ ID NO: 23669 - DNA, 306 bp, Glycine max
  Peptide Sequence Number=SeqID_115354
atttcagagctctttttgagcacaaaatttcgtgctcttctctccctctcccttcattcatctccttcttcctccaagctcttatctatggcctcctatggtggtgagcatgatgaggacatgaccaagagcaagggcaaggatccacttgaaggacttggaggacctatgacaagggctagagcaaggaaagccaaggaagctcttcaacaagtgctgtccatactatttgaatacaagcccaagtttcaaggagaaaaatccaaggttgtgagttgtatcatggcccaaatggaggaggactaa

SEQ ID NO: 23670 - DNA, 159 bp, Glycine max
  Peptide Sequence Number=SeqID_115355
atggattggcagtctccaaatcaaagatcaatctgttccaaactagaattagattccttggtcataacatatatcaaggcattcaaaattgttgaaacagatgcatcaggcataggctatggtggttgtgacaccctctacccctcacatatatactaa

SEQ ID NO: 23671 - DNA, 159 bp, Glycine max
  Peptide Sequence Number=SeqID_115356
atgtgtcttgttggcatggcttttgcaagtggagatgctactccaccatctccaaaaaccgcaaggctcatggcggagatgattaaacttggtgatcaaatgagaaaaatgagttatgacaatgaagaaaatgatggagagaatgagaaaggagaatga

SEQ ID NO: 23672 - DNA, 249 bp, Glycine max
  Peptide Sequence Number=SeqID_115357
atgacggtaacagagtacagcacgtatgtatggggacctgctgtgcgtgcttatttatatagagagatgtgcagcgccaccgattacaaaactaaatcaatcggagggtgtccttcgcaacccttgaatattcatggcataacgctgaaaggcaaacaagatgaaaattgggagcaactgttcaccccaatgatcggtcaatggaacaagcaagttgattttagggtcgacggttatcctcgacaagag

SEQ ID NO: 23673 - DNA, 695 bp, Glycine max
  Peptide Sequence Number=SeqID_115358
atggtgaaagttggaacctcttacgtgccgatcaacgtctcattttcgccaaaagttggccagggcttcccggtgctcccagtggcttctgtttctatcagctgtcccctccctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 23674 - DNA, 552 bp, Glycine max
  Peptide Sequence Number=SeqID_115359
atggaaaacggctttgccgcggccctctcactttccctgttaagtatcttcctggcatcttccaggaaatctccgccccgttccgcccaatacgcaaaccgcctctccccgcgcgttggccgattcattaatgcagctggcacgacaggtttcccgactggaaagcgggcagtgagcgcaacgcaattaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 23675 - DNA, 666 bp, Glycine max
  Peptide Sequence Number=SeqID_115360
atggtcttgaaagaggagttagttgcctattcaaggtccaaaaggagcttgtctcagcgtttatgcgagacggagaccaacatgctagctatcatcgccaagtaccaagaagagttaagtctagccacggcccacgagcatagggtcgcggacgagtatgcccaagtatacgtggaaaaagaggctagaggaagggcgatcgactctttacaccaagaggaaaccatgtggatggaccggaaaaacaccataactaaacgcgccacaggcatccctatcgcaccagatccaaatctagaacgatgggtgatcaagaggagacacaggacagatgaagccgacatgtcggctctgaaagaacaaatggcctccgtgatggaggccatgttaggaatgaggcagctcatggagaaaaacgcggccaccgctgccgctgtcagttcggctgccgaagcagacccaactctcttggcaactgcgcaccatcctccctcaaacatagtaggatggggaagggacacaatggggcacgatggcaaccctcatctgggatacaaccgagcggcttacccttatggattgccgcccaactactcaccacccgtcttgcaagacgatgcgggccatgttgcttctcctgtccttgaaagagagcctcctcaatag

SEQ ID NO: 23676 - DNA, 399 bp, Glycine max
  Peptide Sequence Number=SeqID_115361
atggtggcccgagtgatgttggggaatggttacgagcccggaatgggtttaggcaaggacaacggcggcagaaccagcctgataagcgccagaggaaaccgtgggaagtttgggttaggctataaacccacacaagcagacataaggaaaagcattacaggaaggaagagcggaggtcaaggttcgcgattgggacaagaagtcgaaggaagcccgccctgccacatcagtaggagctttataagcgcgggtctaggacacgaaggccaagtcgttgcgatatgcgaagatgattctccgagtggatcggatttggtacgaccatgtcctcctggtttccgactaggaaattggcgagtggacgagcgcccggatatttatgcgacaagcataatgtaa

SEQ ID NO: 23677 - DNA, 276 bp, Glycine max
  Peptide Sequence Number=SeqID_115362
atgaatgagaaaaacgagcaaagtacaatcacttcatcaggaatgaaacacccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccacagttgcgcagcctga

SEQ ID NO: 23678 - DNA, 354 bp, Glycine max
  Peptide Sequence Number=SeqID_115363
atgagtaaggcattgcgatcaaatgctcccttaccctatcctcatcttatttctctctttcttcaccatttcgaggtacctcttgattctaaaccttttgttcaaatcaagaagtccttctccattggggctgcaatggtcgcctccttcggttatcgcaaagagcgtgatggctcttggagtgtcatggataggtttgacaatcttcagacctatgttggagagagatttgactccttggagagtcaagtagacattcgattcggagagatggattctaggatcacgaagattgaaggcaacattactttcatcagagattgctttgaccttccaccgccaccatccacttag

SEQ ID NO: 23679 - DNA, 318 bp, Glycine max
  Peptide Sequence Number=SeqID_115364
atgaagatgaaagaagaaaataattttaaagcaaagaatataattatttctacattaggcattgatgagtattttagagtctcaaatttaatagcaattgcagaatcaaaagatctcaccaacatgtctctagccactctctttgggaaacttcaagaacatgaaatggaacttatgagactctatcaacatgaagagcatgacaaaaggaagaaaggaattgcactcaaagcctcatcttcttctattcatgaggaaaatgacaaagaagactcaaatgaaaagaacttagaagaagataatgatttcagtctctaa

SEQ ID NO: 23680 - DNA, 285 bp, Glycine max
  Peptide Sequence Number=SeqID_115365
atgtcaggatttacacgtgattctcctcaaatttcagccagcctgcatcaattaaaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagtaggctttgtggttgatttagggattgcctttgtggataactgggcggtgggtaaggagaaggaatggcagtcatag

SEQ ID NO: 23681 - DNA, 472 bp, Glycine max
  Peptide Sequence Number=SeqID_115366
ggatcacacccacaaagacacccagtggacctgaagaagtccaacagggccctggggtttccagctctggttacgggcctctatcggccctatagggcgctcgtccccccagcaagctcatgccatcatgacataggtaaggattgtgcccgcaagacacctagtggacccgaagaaggccaacagtgtcttggagttgccagctctaaatacgggtctctatcagttcaagggagtgcctgttgcccccagcagggtcatcaggccccctaccaatcgagttttcatctagaagtgttgcgtctccaggcaggcgcagggcgaaacaccacagcagcctggggatggccggcagcgggcaacagacgcaccgccatcacctctagagttcacctcagctcatccacaaaaaggttagagcgttgcctacgacacatggccgaccagcaggcgaccaaatccaaagccaaag

SEQ ID NO: 23682 - DNA, 583 bp, Glycine max
  Peptide Sequence Number=SeqID_115367
attgaacgctggcggcaggcctaacacatgcaagtcgagcggtagcacagagagcttgctctcgggtgacgagcggcggacggccacactggaactgagacacggtccagactcctacgggaggcagcagtggggaatattgcacaatgggcgcaagcctgatgcagccatgccgcaagaagcaccggctaactccgtgccagcagccgcggtaatacggagggtgcaagcgttaatcggaattactgggcgtaaagcgcacgcaggcggtgtagcggtgaaatgcgtagagatctggaggaataccggcgtggcttccggagctaacgcgttaaatcgaccgcctggggagtacggccgcaagagaactttccagagatggattggtgccttcgggaactctgagacaggtgctgcatggctgtcgtcagctcgtgttgtgaaatgttgggttaagtcccgcaacgagcgcaacccttatcctttgttgccagcggttcggccgggaactcaaaggagactgccagtgataaactggaggaaggtggggatgacgtcaagtcatcatggcccttacgagtag

SEQ ID NO: 23683 - DNA, 654 bp, Glycine max
  Peptide Sequence Number=SeqID_115368
atggttggtttcacacttatttcgccaagagatgagacacgtttgcccgctagaaggccaccgctcatgcaccgagaaaaaagagggacaaggggttgcatcaattacaatcccgtcatcgctataagacaacttggttaccctatgagaggagcgccatcaaaggaaggcctcataccttttattatacgaggtttcaatagcaccaactcgggggtgcttcagagggtccacaaggcatgggaaatgttgcaaagaaaggacaaggaacgtaggggaagtagcaacaggcccgtcgacagttaccgtaggtggttgaaagcctacacacaagatctggattggctcctgagtttgagaaccactaagggggtggaggttgaaactctggaagaagacgaagaggtacaggccctcaagacagaacgtgagaaagcccaaacaatcaaagaaaagttcaagtcagcagctgttaggatccgaaaggagaacgccgaactgagaggcatcaatatagccaccgtcaaggccttggagcaagagaccagagggcccgtagggaaaaacatggccggaacaaattccgaggggctctgtggggtagtaacagcgagcttaagctccgaagagaggaaagggaccaatcgcgagtag

SEQ ID NO: 23684 - DNA, 702 bp, Glycine max
  Peptide Sequence Number=SeqID_115369
atgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataaagcactgggcagaaatcacattgcgtcaacatccgcagggaccatcgcaatgctttgttttaattaaaacagtcgggattccccttgtccgtaccagttctgagttgactgttcgacgcccgggggaagaggccccgaagggcccgttcccaatccgtcccccgaccggcacgcgacgacccgctctcgccgcggaagcagctcgagcagtccaccgacagccgacgggttcgggactgggacccccgtgcccagccctcagagccaatccttttcccgaggttacggatccattttgccgacttcccttgcctacattgttccatcgaccagaggctgttcaccttggagacctgatgcggttatga

SEQ ID NO: 23685 - DNA, 243 bp, Glycine max
  Peptide Sequence Number=SeqID_115370
atggcaagcagagaccaagtttggtcattctgcacccaagatacgcggagataccttacggttatccgcacccttttgtcatccagaggcggcgggcccgatgacaagcagagaccaagtttggtcattctgcacccaagatacgcggagataccttatggttattcgcacccattctcttgctatctgaacgacaagtcacggtcacccgcgactctcgtcaaccgagaggagcgaaattag

SEQ ID NO: 23686 - DNA, 105 bp, Glycine max
  Peptide Sequence Number=SeqID_115371
atgaaacacagctccaaactcaaaggtggaggacacatgaacgaaaacgctggcaattcatggagctccgaaaaaaggcccccccctgccccgattgccttgagg

SEQ ID NO: 23687 - DNA, 386 bp, Glycine max
  Peptide Sequence Number=SeqID_115372
gctttgtggttgatttagggatggcctttatggataattgggtggtggggaatttcatgtgtctcccccatggtttaagagacatgtgcatgataagtttgaggttgttggctctcaatgagcatagaagtggagttattgacattctcattgggagtgtgcgccacattgggtggtgtaagttgggaggcaagccatatggcgggaaggcgccagatgggggcatcgggttcactttagtaacagcgctggtagcggcaactgcaaccatattatcttcttcaagctcatcatggcctccatcattgtggccatttgctctctcatggcctccatgtcggccttcatctgctcttgcacctcttttacttcacccattactctag

SEQ ID NO: 23688 - DNA, 798 bp, Glycine max
  Peptide Sequence Number=SeqID_115373
atggaagacaatgcggttgcagttgctgctaccagcgctgttgctaaggtgaacccgatgcccccatctggcctcaaccaaatgaatcatctaacctcagctagggtaggcaaagatttgggaagtacgggcgacccccattatgtgcaacttcaaaacaagcatgccttcccgccatatggcttgcctcccaactatacaccacccaatgtggcatacactcctagtgagaatgtcaataactccactcccatactcattgagagccaacaacctcaatctgatcatgcacatgtctctcaacccatgggggagacacatgaaattccccaccacaatctagccgacttcgagccttgcctcggatatgccactgaagggcaagcagttggtggtatacccctgcaaaacactttggaggggcctcaatttcgcccccaaccacaacccttctatggaaaaatggtggattacacaccttcatgctttgtggatttggtcttcgccagtgaaaggatcaaagtgggtctggaaagaggtaaatccgatcatcctgctttgataaatatgaaaactggggaaaatgaagaggatgagaatgagggagaaacccttgctatgactgccattcctacacggtcaaatttcccatcagtccaacaatgtcattactcagccaatatcagcccttctcattacccaccacctagtcatccacaaaggccatccctaaatcaaccacaaagcctgcccgccgcacatccggtgccaaaacaccaaccaaaaaggaatttgtag

SEQ ID NO: 23689 - DNA, 758 bp, Glycine max
  Peptide Sequence Number=SeqID_115374
gcaatttagttcctctggacttggagattaaagctacgttgagaaggaacagagtcgagaggagaagaaaattactgcaagacaggagagtagcgtcaattcttgaggaagaaactcatttttctaattcttcatcatccaactcaccatcatcaagggaatctgcggcttatttactagaagccatttccatggctgatgatcaccagcaaagagttacccttgaggactattcaagcagttcaatgccacaattctttaccagcattgcacgtcctgaaaagaatccaagaggtggcctccactcatttaagggtaacagtctaaaaacctgggaagaagttgttgaaaagtttctaaaaaaatatttcctagagtcaaagactgtggaaggcaaagctgcaatctcttcatttcatcagttccctgacgagtccttgagtgaagcgttagagaggtttagagggggggaaataaagttgaagacccctgaagaggaaattgagctaattaagaatatgtcagccagcaatcatgccattttgcgcaacagagttcatcaacccacaaagaaaagcttgttagaactatcatcacatgatgctttattggcacaaaataagttgctttctaggcaacttgagattttaacagaaacacttggtgatgttgtcgcaacctacccttcggcgggagggcgacgcgtgacttgtgggtgcgtcttccaagaaaggaatacgtgcggagtcgccaccaac

SEQ ID NO: 23690 - DNA, 50 bp, Glycine max
  Peptide Sequence Number=SeqID_115375
gagaaagggagctcagcggcagaggattgtaacatgagagaagcaaggag

SEQ ID NO: 23691 - DNA, 213 bp, Glycine max
  Peptide Sequence Number=SeqID_115376
atggattcaaagctagaattgttcaatatgtctgtcctaaattgcaagtgcaaaagtcacaaatacagatggcaagatgttgaattttggttcgggatatcgatgaaaaatgtgatggaagggtcattgctttttggaggctgtaactggcggcaagttaagtggtttgggaactgtggagcattgaatgttacgtccaaagattggtcgtga

SEQ ID NO: 23692 - DNA, 369 bp, Glycine max
  Peptide Sequence Number=SeqID_115377
atgtctgatttcctcttcgatggagggtacataggagcaagagccccgcttttgtcgacctcaaaaataaaaagggaaataaaagttagggaaacacaatttcacacaattctaaaaataaggctgttgtcctttgagacaaacgtgagaggtgctaaaccttcctcaaacataaatacaactcccgaacttagaatgttctttttgaccagtttccttcggtttttccgacgttttccacaaataaatgttggtggtgactccgtgcattttcctccttgggaaaacgctcccgtgagcctcgcctcgctcgcccgcaaaagggcatgttgcgacactgagttcgatactcagttcattccgctttaa

SEQ ID NO: 23693 - DNA, 417 bp, Glycine max
  Peptide Sequence Number=SeqID_115378
atgcatggatgtgctcttgggtctaacttttgtctatgtgctgagagtgtggaaatcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 23694 - DNA, 336 bp, Glycine max
  Peptide Sequence Number=SeqID_115379
gctactgacggggtggtgcgtaacggcaaaaagcaccgccggacatcagcgctggcaagtgtagcggtcacgctgcgcgtaaccaccacacccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggggcgaattggagctccaccgcggtggcggccgctctagaactagtggatcccccgggctgcaggaattcgatatgcatgattttgggttcgagtaccaatga

SEQ ID NO: 23695 - DNA, 231 bp, Glycine max
  Peptide Sequence Number=SeqID_115380
atgggtgagccctgctcaagttatggacatcatgagatggctctcaaaggaaagatcatgaagggaaagctgttcatgatcggactttctgagtcgagagtgaacaaaagtatctgcagaagaactatgcatcaaagtgagaagattcatcagcaagaagcacaactgaagaaggtcattgcaaatctggaggctgagaaggagcacatgaagaggagatctctgacttaa

SEQ ID NO: 23696 - DNA, 261 bp, Glycine max
  Peptide Sequence Number=SeqID_115381
atgcttccaaaatgttttcgtgaggaattccatggttttcaattcatttcttgctttgcttgctttcatcttcatctcgtcactttcaaatccggagaagtccaacagggccctagggcaccacgacagcctgaggacggccagcagtgggcaacggacgcactaccacaacctctagagtccacctcagctcatctacaaggttggagcattgcctacgacacgtggccgactagcaggcaactgcgtccaaagccaaag

SEQ ID NO: 23697 - DNA, 348 bp, Glycine max
  Peptide Sequence Number=SeqID_115382
atgttactgaagcattatggaagctccggatgccatttttcaacaaaatgggtgaggtggttgccgcccagacgagctaggttgcttcgacctgaagcaagaaaaactggagttgctgcacatgatgtccaacgttatgtcaaggaatcagatcgggctgcacaatgcacaaggcaagataaaatgtcaaatgaagaattgaagctgcaggatccacgatgtcggatacaatgtccaggacatcctgcccgaaaatgcacaaggcaagataaaagaattgaagctgcaggatccacgatgtcggatacgatgtccaggacatcttgcccgaaaatactggacacataa

SEQ ID NO: 23698 - DNA, 180 bp, Glycine max
  Peptide Sequence Number=SeqID_115383
atgggagccaagtacctcgaagtggtcaaacgaaagttgcatgccaccaaacaatggtccccggacgaaattagggtgaccataagatatctccgcatgcaactgactcgctgtccctggatgacaaaggcgcagaattcgtctatgcgcgtttaccacccaacttgctgctctgaatga

SEQ ID NO: 23699 - DNA, 468 bp, Glycine max
  Peptide Sequence Number=SeqID_115384
atgggtgaagtagaggaggtgcaagagcagataaaggccgacatggaggccatgaaagagcaaatggccacaatgatggaggccatgataagcatggagaagataatggaagccaatgcggttgcagttgccactaccagcgttgttgctgaggtgaacccgatgcccccatctggccttaaccaaatgaatcatccaacctcaactaggacacatgaagggcaagcagttggtggtatacccatgccaaacactttgaagggccctcagtttcgcccacaaccacaacccttgcattttgcggtgggaagagcccctcctgctatggctgaaaagggaaagttggatcaaatagaggaaaggctcaaggacatagaaggaggcgaagattatgccttttctaacctagaagagttgttcttagtacaagaacatggtcattcccaagttcaaggtgccggactttga

SEQ ID NO: 23700 - DNA, 291 bp, Glycine max
  Peptide Sequence Number=SeqID_115385
atccaacttatgcttttatttctgagtggtgcaggatcctatccatgctcagttagcaattctttgaaggcttctaaattgactattaatcagccagtggcaccaattgaagaattcaatctgaagctttcagaattgggcattgagatccattcagttttgacacgtcgttctcagtggagttcacagccttcaagttctcctcagttatcatcaaaggaaacattcattttgaagtcagaggcaaagaccatttctgagataaacaaccttggtgaagagtttgtttaa

SEQ ID NO: 23701 - DNA, 543 bp, Glycine max
  Peptide Sequence Number=SeqID_115386
atgattatgaggggccaagacatttatagtagccaagatgaggctactacttcaccttcctctagtaaaagtgaagaagcaaaaggggaagaatctagtgaagagatctacccccaagaagaaggacaacctttaatggttaaggaggagtgtaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttaatcctcaagtaaaggagttgttggatgagggtttggttcgcaagagattaaatccttgtgctttgttggtgcccaaaataggggttcccatgaaccctaagagaataaaggtcattcctgagtggcccgctccaccaagtgtaagaaaaatttggggcttccaagacttaacaaacttttacaaaagtgttgaggaaaaaagcccagagtttcagaacctcggatttgag

SEQ ID NO: 23702 - DNA, 327 bp, Glycine max
  Peptide Sequence Number=SeqID_115387
atgtggatggatcggtttgctcttaccttgaacgagagtcaagaacttccccgcttgttagccaaggccaaggcgatggcggacacctactccgcccccgaagagattcatgggcttctcggctattggaaaaacaccataactaaacgcgtcacaaggcatccctatcgcaccagatccaaatctagaacgatgggtgatcaagaggagacacaggaacagatgaaagccaacatgtctgctctaaaagaacaaatggcctccatgatggaggccatgttaagtgtgaggcagctcatggagaagaacgcggccaccgctaccgct

SEQ ID NO: 23703 - DNA, 321 bp, Glycine max
  Peptide Sequence Number=SeqID_115388
atgggaaaagtatttactcttaatggcattgaagcttcgaaatccaaagatataatccaagtgagtaaggatgaaatgtttatttctgccaaccaagttttgacatctttaaaagaatattctcaagtgtacatgatcttgcctaacctggatgtagagactaaggtttccatgtgtgacctccctattgtcatagagtttcttgaagtgtttcctaaggatgtatctagtttaccacctgcgagagagataaaatttttcattgacctgctacctagtgttggacccatatccatagcccttataggatgtctcctatag

SEQ ID NO: 23704 - DNA, 99 bp, Glycine max
  Peptide Sequence Number=SeqID_115389
atgccacgtgatatgaatggcagcagaatggagaaggaagagagagaggagacgccagttcaaggagaagatgagtctagaagaagctcaccaccatag

SEQ ID NO: 23705 - DNA, 429 bp, Glycine max
  Peptide Sequence Number=SeqID_115390
ggacttagcaacatggagaggagtatgattgatgctgccagtggtggagctcttggtgatatgacccctactgaagctaggaatttgattgagaagatggctttcaactcccaacaattcagtgcaagaaatgatgctattgtccttagaggagtccatgagaatgttgctggtccaagcaagccatatgttcctcctccaatgcagcaacaacagcagcagtcacaacaaagacaacaaggaactgaggctcctcctcaaccttccttagaagagttagtgaggcaaatgaccatccagaatatgcaatttcagcaagagacaagagcctccattcagagtctgacaaatcagatggggcagatggctactcagttgaaccaagctcagtcccaaaattctgacaaattgccttcacaaactgtgtag

SEQ ID NO: 23706 - DNA, 741 bp, Glycine max
  Peptide Sequence Number=SeqID_115391
atgacaccggtaaaccgaaaggcaggacaggagagcgcacgagggagccgccagggggaaacgcctggtatctttatagtcctgtcgggtttcgccaccactgatttgagcgtcagatttcgtgatgcttgtcaggggggcggagcctatggaaaaacggctttgccgcggccctctcacttccctgttaagtatcttcctggcatcttccaggaaatctccgccccgttcccttttttctcctgccacatgaagcacttcactgacaccctcatcagtgccaacatagaaacagctatgaccatgattacgccaagctcgaaattaaccctcactaaagggaacaaaagctggtaccgggccccccctcgaggtcgacgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 23707 - DNA, 603 bp, Glycine max
  Peptide Sequence Number=SeqID_115392
atgggttctccacctgcccccactactactcctcctcctcctcctcctcctcctcctcctccttctcctccttctcctcctcctcctcctcctacttcggacgcatcggcttcgacgtctgccgtgaagcggacacgcaaagcctcacgcctacaatcgttgtccactagaccacctggtgtacatcacctacgagaactggaaggaggtccgtactactcacgaaacgatcctgagaccggtgactctgacaggtgcggcttgtacatagaagcagatcctgcccgcctggttgccatcgagagagtttatgagggatccactattgttcataacactcctttgttgcttggccaagtaaaggtgagtgtggaggaggttagagatgcagatgctccagttcctgtacccactgatgaggtttccttagtgggccaggcacttcacaccttccttgcttggccgacacatctggtcaagtctttatcacagcaggtagctgtgtctccgccaaaaccacctccgaagcccgatccggaggttgatgatccgctttatctgatgacattgaccatcccagagcttttcttgaggccttattag

SEQ ID NO: 23708 - DNA, 357 bp, Glycine max
  Peptide Sequence Number=SeqID_115393
atgatcaagtggaaggttggtgttgaggaggttaaagatgcagatgctcccgttcatgcacttaacaccttccttgcttggccgacacatctcgtaaagcgtttatcagaacaggttatgtgggatgctaccgtgttcggggtgtttaatgaagacttccccttgtacataaagcatgaagatttgtctgaaatagcacatggtggtcaatgtctcaacatctctattatacagttgtggattctcatctggctgagacaagtatacgagcggggaattcggatgtgtatggattcctcaagccacagtccatctagagatctaggcaatcgcaatttgaatcaaaaagttacatga

SEQ ID NO: 23709 - DNA, 447 bp, Glycine max
  Peptide Sequence Number=SeqID_115394
atgcagctggcacgacaggtttcccgactggaaaagcgggcagtgagccgcaacgcaattaatagatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtaggcggcgcattaagcgcggcggggtgtggtggttacgcgcagctgtgaccgctacacttgccagcgctgatgtccggcggtgctttttggcggttacgcaccacccccgtcagtag

SEQ ID NO: 23710 - DNA, 462 bp, Glycine max
  Peptide Sequence Number=SeqID_115395
atgaagattgttatctctattccactaagaaattgtgattttgctggaggagaacattatcaggacaattgttattcctattccataaataatttcgattggagacaggagtcaaccatgtacaatcatcatgaaaaaggaagagctcctgatcttgaaagcgtgttagcagacttcatgacatatcaagctagctctaaagctaattgttattcaacgcaacagcagggaactcagtttggcaaggactattcttttgaagattatcaatgggaatcagaatggcaaccttgttatcataatgaagcagaaggattgtttaatctggatgacttgttaatgcaattcaagggtacaattgattcaatgcaacaagcatttaaaagagctgagactcagattgctaagttggtggataaaatgattcaagttgtggtcagaagagaagaagagtatacatag

SEQ ID NO: 23711 - DNA, 378 bp, Glycine max
  Peptide Sequence Number=SeqID_115396
atgcccccgactgtccctgttaatcattactccgatcccgaaggccaacacaataggatcagaatcctgtggtgttatcccatgctaatgtatacagagcgtaggcttgctttgacacttaagtgtggttctcaaacgtcgcgggcagcgaaccgctcacgtcgccgcaatccgaacacttcaccggaccattcaatcggtacaggagcgacgggcggtgtgtacaaagggcagggacgtagtcaacgcgagctgatgactcgcgccttacccaggaattccatcgtttttgaagaccaacaacttgcaaatgatcctatccccatcacgatgaaatttcaaagattacccggacctgtcggcccagcttgcctatag

SEQ ID NO: 23712 - DNA, 156 bp, Glycine max
  Peptide Sequence Number=SeqID_115397
atggtctggccggcacaaagttcccgtgttgacgagttatcagaatcatcaagccaggcagagctactcctggtggtgcccttccgtgccagcggagtcctaaaagcaacatccgctgatccctggtcggcatcgtttatggttgagactaggacg

SEQ ID NO: 23713 - DNA, 231 bp, Glycine max
  Peptide Sequence Number=SeqID_115398
atgcacatgccaaagttgagtgcaaattgcaaagaagagcaagccaacaagaaaaggaaggaagtggtacttgaacccgatgatgatcctggacatttgagggcaaatgttttccaagaaggagggaatgatgagaatcctaaaactggccaaatacaggctaaaggtccaagtggagaaggacgaaggcccaagtggagaaggataaagcccccaagtggagaaggatga

SEQ ID NO: 23714 - DNA, 690 bp, Glycine max
  Peptide Sequence Number=SeqID_115399
atgacggaagggtgtggtgaagggttttgccttgcaaaccttcccggtgatgcttttagtctatgggggaacttctttgaggcaaagaaacaaatgatggctgatgccaagtttgcggggctgcttgggtcggcggtgctgggtaagccccgtgctaatttcggatgttggcccctcctcccccccgtgatcagttttgtgccaggatttgccaacctttggcttgcgccccgtgagctaagtctgtgcctcggtggtggatcatcatgtcataacatggccaagacacaaggtcacacgcacacacacacacacacactcacgcaggcacaagggggaggaggggcttggtcgtccgtccgcccgggcacacacctagttagcaccaggcaggcaaaacgagagagagccgacgaacggattctacccgccgctcgatgggaattgcgcttcaaggcgtctcgtagggctaatccgcctcacgagggtcaccaacggcacgtgcctttggggggccgaggccccctactgctggtcggcaaacggacggcgggcgcacgcgtcgcttctagcccggattctgacttagaggcgttcagtcataatccaacgcacggtagcttcgcgccactggcttttcaaccaagcgcgatgaccaattgtgcgaatcaacggttcctctcgtactag

SEQ ID NO: 23715 - DNA, 569 bp, Glycine max
  Peptide Sequence Number=SeqID_115400
atgggaacaaatcaaaccggcaagaggttctaccaagtcaaggttaaaaacttagataccaccagcatcaaggaattagggcggttgatggaacctctccaaatgcaagctttccgcaagacttacgggaaagatcttagagttgaccttagcagagagatgtcctctcgggggaagaaaaccatatctttcctccgggtgtctcccctctttgagcagaattgcaattgtggtcaaggattcaacaagaggtacctagaagacaaggcgaggggtatggccaatcaaggagattgggtcccgtttatggatgtgctagctttgctaatttttggggtcgtcctctttccaaacgtggatggtttggtggacctagcagcaattgacgttttccttgcataccaccatagcaaggaaagtcttgtggtagctgtcctggcagatttatttgacacatttgaccaaagaatagattgggaccagcttttggccgggataggaggtagaacaatcaattggttcccccgatggaaggaaggaaaggaaggagtccttttctcatgtggagg

SEQ ID NO: 23716 - DNA, 207 bp, Glycine max
  Peptide Sequence Number=SeqID_115401
atggaatgttgcggaactttacggattgcgcaacaatgcttccttttgacttctggcatgtcgcagaacttcacgaattggctaacgatgggtgttaagtacctcgaagcggtcaagcgaaggttgcatgccaccaaacattggtccccggaagaaattaggaaccttgcgtttgaactaacgagcatgaacgagagagacctctga

SEQ ID NO: 23717 - DNA, 183 bp, Glycine max
  Peptide Sequence Number=SeqID_115402
atgacgaggcaaaaagcttatgggtttgcgatttccacaacccaggaggcagcgacaaacaagaaacgaaccgagaagggtgcttcaggggttgtgattgcctacgaaatcatgcgacaacttggaggtcacctcgaagaatccataagcttcgtgagcttcgtggttgccactggccactga

SEQ ID NO: 23718 - DNA, 429 bp, Glycine max
  Peptide Sequence Number=SeqID_115403
atgacacaaagatttgggaagtacggacgaccccatgatgtgcaaattcaaaatgagcacgccttcctgccatatggcttgcctcccaactatacaccacccaatgtggcatacactcccagtgagattgtcaataactccactcccatactcattgaaagccaacaacctcaaactgatcatgcacatgtctctcaaaccatgggggagacacatgaaatttcccaccacaatctagccgacttcgagccttgtctcggatatgccactgaagggcaagtagttggtggtatgcccttgcaaaacactttggaggaccctcagtatcacccacaaccacaccccttggattccacagcgggtaaaacctcatgctatggcagaaattggaaagttgaatcatctagaggaaaggctcagggccattga

SEQ ID NO: 23719 - DNA, 355 bp, Glycine max
  Peptide Sequence Number=SeqID_115404
aatgaccaaacttggtctctgcttgtcatcgggcccgccgcctctggatgacaaaagggtgcgaataaccataagaatgaccaaacttggtctctgcttgtcatcgggcccgccgcctctggatgacaaaagggtgcgaataaccataagaatgaccaaacttggtctctgcttgtcatcgggcccgccgcctctggatgacaaaagggtgcgaataaccataaggtatctccgcgtatcatgggtgcagaatgaccaaacttggtctctgcttgtcatcgggcccgccgcctctgatgacaaaggggtgcgaataaccataaaggtatctccgcgtatcatggttgcagaatga

SEQ ID NO: 23720 - DNA, 462 bp, Glycine max
  Peptide Sequence Number=SeqID_115405
atgcgaagtaaatcttctgtaggtgatttagttccattagatttggaaattgaagccacttgtagaagaagcaacgcagaaagaaaaaggaaaatactgcaggataggacaacaccaccaattctagaggaacctcaatcatctgagtcatcttctttctttccacagacaagggaatctataagaggggcacctaaggctaacataatggctaaagatcaacctagaagagtgacccttgaagactaccctagttctgctgtgccgcaatttttcattattatagcgtggctagaggttcaagcacataatattacttatcctcattctttgattcagctaatacagggaaatttattttatggcctaccaaatgaagacacgtatgcacacttagcgacttacattgaagtttgcaatacagtcagcttgcaagtgtgccggaagatgttgtgtggctaa

SEQ ID NO: 23721 - DNA, 237 bp, Glycine max
  Peptide Sequence Number=SeqID_115406
atggcgccacttcttaacggccgttgtgatggccgcaagttcccaaatgacatgaccaagagcaagggcaaggatccacttgaaggacttggagggcctatgacaagggctagagcaaggaaagccaaggaagctcttcaacaagtgttgtccatactatttgaatacaagcccaagtttcaaggagaaaagtccaaggttgtgagttgtatcatggcccaaatggtggaggactaa

SEQ ID NO: 23722 - DNA, 294 bp, Glycine max
  Peptide Sequence Number=SeqID_115407
atgtaccctctcttgttctcagttacaacaacccatgtagatgtaccctctacttgtactacaaaggatgtaccctccaatgtgttaagacaaagttctcaggcgggagaagggagacacaaaagaattcaggcggttagtcctttgttcttttggaaaagggagaagagagacacaaaaagaattcagacgaacaaggtttggaaaccagaaaactcagaaagcttttggcaaaggaagaagaagaagaagaagaagttcaaaaagatgttcaaagagattgaaaggttgtaa

SEQ ID NO: 23723 - DNA, 387 bp, Glycine max
  Peptide Sequence Number=SeqID_115408
atggaactccaacatcttaatcaaaatgaagaaaccgacaaaaagaagaggagtatagcacttaaagcctcatcctcaatacaagaagaaaatgaagaagaagattcagatgatgaagaagacttctcactctttgtgaagaaatcacaagaagactctcaagttcttagatgttacaaatgcaaccaacttggtcacatcaaagctaattgtccttcaaatgaagaatggcctgagaaaagtgataagaaaaggtatgatgaaagaagaaccaagaaggcctacattgcatgggacgacaatgattcatccgatggttcagaaaaggagatcaatcttctaaccaaggattatgagagtgatgagaacttctctcaagaagtttaa

SEQ ID NO: 23724 - DNA, 423 bp, Glycine max
  Peptide Sequence Number=SeqID_115409
atgaccatgattacgccaagctcgaaattaaccctcactaaagggaacaaaagctgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgattgtccggcggtgcttttgccgttacgcaaccaccccgtcagtagctga

SEQ ID NO: 23725 - DNA, 495 bp, Glycine max
  Peptide Sequence Number=SeqID_115410
atgaggtttgaatcaactcaaactccacttgctcaaaactcaggaacaaatgacaagacaacaatcagcggtaaaaagaattcatcagaaactcgctgcaagattctatggacctttccaggtggcggagaagatgggcgaagtagcttacaggtacagggagagttacctaaagatttggaagtgactgaggagactgatgtgtacccagacaaggtgttgggttcaagagtcataatacaggggggtaatgaggttcagcagaccttgatacaatggaaaaataaagctttagaggatgtgacatgggagcataatgaagtcttgtgttgccagtttccagaattttgccttgaggacaaggcattgtctaaggaggtgggagttgatagaaatgtgattagtgaagtggggcctaggccaagggtgtggagagtttatactaggaaaaagacaaaaggaatgaaagataatgacgtggctgtgaacgcatga

SEQ ID NO: 23726 - DNA, 147 bp, Glycine max
  Peptide Sequence Number=SeqID_115411
atggaagctcaaaggtctgtatggtggtcagcagaggagcacagaccatcagactcttgcacagtcacagatttatggaattcaaggctcagactgggttaccaaaaggctaccactggcaaatgcatctatccaaatgacttctga

SEQ ID NO: 23727 - DNA, 714 bp, Glycine max
  Peptide Sequence Number=SeqID_115412
atgtactccacaaataactctgggtggagacagttaactccctataatcagtatgaagagcaaagagtccccgatcttgacattgtgtttgcagaattcatggcatatcatgctagttctaaagctaatcataatgcaatacaaaagcaggagattcaatgtgctaaagttttttttgaagattatcaaggggaaccagagtcacaattctactatcaaaatgaattagaaaggagtttcaatctggacattttgttaatgcaattcaaggatacaattggatcaattcaacgggcatttaaaagtgcagaaattcaggttggtaagctggtagaagaagtgactcaagctatgagcagaagagaagaagagattgtaaaggttgacactcaagaggagagccctgtgaatgagcatgatttagaagaagaagataaggagaaagcgcaacaatggaaacaatgcttacaaacacacactcaacaagaagataatttccaagttaacacatgttctcatcaactgactatcaaagaagaaaggcatgaagaccatgaggcttcaatcattctaggacaaccctgtctgacatttgctagttgtgttttcgacatgggtaaagcaataaaacacccagatgacagtaaagattggtttgaagcagaaatatcggagcaggagatgaaattaacagcctcagccatgatattatag

SEQ ID NO: 23728 - DNA, 195 bp, Glycine max
  Peptide Sequence Number=SeqID_115413
atgggggtgcaaatagcacccaggcccacttgggccctccagaatattcctccagaaggctgttgcttctggaggaagcaacctggctcgcctgggcgagctgagctcgcctgggcgagctgggaatttcgcaaaggtttcaaccgttcttcaacgttcttcattcgttcttcatcgttcttcgatcttcaacgg

SEQ ID NO: 23729 - DNA, 387 bp, Glycine max
  Peptide Sequence Number=SeqID_115414
atggtgaaagttggaacctcttacgtgccgatcaacgtctcattttcgccaaaagttggccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcctcatgggctatacacacccttacccattccatctacctaaggaactgattgaatgg

SEQ ID NO: 23730 - DNA, 141 bp, Glycine max
  Peptide Sequence Number=SeqID_115415
atgctcaatggaatgccccagggctcctccacgataagcacacgttgcgttcgagtcgtatcctcagaaaaatggaggttgaggaaccttggatggggtggtcttcgtcattggaagtgcggtagacaggctttgtggtag

SEQ ID NO: 23731 - DNA, 394 bp, Glycine max
  Peptide Sequence Number=SeqID_115416
tctagaggtgtatttcggcaattacacaatgatagagatggaagaaagttcagggtttcctgtgttattcggtggtgaaaattcaaaccctcctaatgatggttgcaaagacaagattctagggctggaacttattgcaagacttcaaaataatggtctcaaggataagatatttctagggttgaaacttattgcacgacttcaacaccgcaccagaggtttaagaaatttaactaggatacatggtgtggatttgacgaacgaaactcaggatacatgccccaggagatatataaagaaagaaatatatgaggaggtgctgggaatttcttattccatggtgaatcaatctgagaaggttgtggcacatgatctgaaaaagagccactttctg

SEQ ID NO: 23732 - DNA, 650 bp, Glycine max
  Peptide Sequence Number=SeqID_115417
tgtatgatggtgtttttgaggtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccaaacttccctctgggttcctcgctgaaccaatctcgggcttatcaagataatccttatggtgtctaccctgacttatcttccctctctggaagtggcgttatccaaaactttgtaacttgtatcaagcgatccgctcctagtaaggatcacatcaagaggattgtcgcttctttgaacactcacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcagagaaaaaggctgcaccg

SEQ ID NO: 23733 - DNA, 539 bp, Glycine max
  Peptide Sequence Number=SeqID_115418
gtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatggctcggtctatgtaaggcttgactcggctcgacttgtttactataaagttgctataaagctagcaaacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 23734 - DNA, 522 bp, Glycine max
  Peptide Sequence Number=SeqID_115419
atgaagcacttcactgacacccctcatcagtgccaacatagtaagccagtatacactccgctagcgcccaatacgcaaaccgcctctccccgcgcgttggccgattcattaatgcagctggcacgacagctgaaatggtttcatatcgaccaatataaaagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 23735 - DNA, 189 bp, Glycine max
  Peptide Sequence Number=SeqID_115420
atggatgtgtgtcgtaaagtgcctttcaccaaatttttatgtgtgcaaatgcgaaatgccaccaaggaagctctccgcaagagatctaggagggacgccgcggccgaaggaaccagcaccgctcctgagtttgacaaccatcgtttcaagagcgcaggacaccagcagcgtttcaaggccatcaaatga

SEQ ID NO: 23736 - DNA, 722 bp, Glycine max
  Peptide Sequence Number=SeqID_115421
atgttgctaagtagcaatgtcatctatatctgtgtaagagtgatcatgttggtgcgcatgatccgcactcgtctctttgcagcggcacgggtgaaatcttgccccggtatgcatagtagctgtgtgatagcctccctctctggttgtgctcgcacagttggccgtcctccaatatcagggggtggcccaggaaccgtgcgggtgtggagcacactgaaaatgaggacacgtagccctctaaaggtgagggcgtgcaaccctctcaaggcgaggatgtatagtcctctagaggtgagggcgtgtagtcctctcaaggtgagggcgtgcagccctctgttggcgaggacgtgtagtcttctaaaggtgaaggcgtgtagccctctgttggcgaggacgtgtagtcctctaaaggtgagggcgtgtagccctacgaaggtgaggacatgcagtcctctgatggcgagggcgtgtagccctctgaaggtgaggacgtgtggtcctctaaaggtgagggcgtgtagccctacgaaggtgagggcgtgcagccctctgatggtgaggacatgtagtcctctcaaggcgaggacgtgtagtcctctggaggttagggcgtgcagccctctgatggtgaggacatggagtcctctgaaggcgaggacgtgtagtcctctaaaggtgagggcgtgtagccctacgttggcgaggacgtgtagtcctctcag

SEQ ID NO: 23737 - DNA, 601 bp, Glycine max
  Peptide Sequence Number=SeqID_115422
aaaagaacatgctttacggtgtccttaccgaacccgtgctagagttagagtaatgggtaaagtagaggaggcgcaagagcaggtgaaggccgacatggaggccatgaaagagcaaatggccacaataatggaggccatgatgagcatgaagaagataatggaagccaatgcggttacagttgccgctaccaacgctattgctaaggtgaacccgatgcccccatctggccttaaccaaatgaatcatccaacctcagatatggtaggcaaagatttgggaagtacggcgcaaattcaaaacaagcatgccttcccaccatatggcttgcctcccaactatacaccacccaatgtggcatacattcccaatgaggatacacatcaaattccccaccacaatctagccgacttcgagccttgcctcggatatgccactgaagggcaagcagttggtggtatacccctacaaaacaccttggagggccctcagtatcacccacaactacacctcttgcattacacaacaagtaaaaaccctcatgctatggcagaaatgggaaagttggatcacctagaggaaaggctcaggccattgaaggag

SEQ ID NO: 23738 - DNA, 708 bp, Glycine max
  Peptide Sequence Number=SeqID_115423
atggctgaaatcctcagcaaagacagtttcgaagcaccggaagaagacaaagaagtccaagctctcaaaaacgagttaggaaaagcgaaacttgccaaggagaagttcaagttagccgctacacacatccggaaggagtatgccgaattacgggaagagaatgcaactactacaagagcccttgaacaagagaccaagagggctcgcaaggaagagtatggccgtaacaaatttcgcggagctctgtggggtagcaacagtgaactcaagctgcgaagggaagagagggacgactcgcgagcatatagcatggtcttgaaagaggagttagttgcctgttcaaggtccaaaaggagtttgtctcagcgtttatgcgagacagagaccaacatgctagctatcatcgccaagtacccagaagagttaagtctagccacggcccacgagcatagggtcgcggacgagtatgcccaagtatacgcagaaaaaaaggctagaggaagggtgatcgactctttacaccaagaggcaaccatgtggatggatcggtttgctcttaccttgaacgggagtcaagaacttccccgattgttagccaaagccaaggcaatggcggacacctactccgcccccgaagaaattcatgggcttctcggctattgtcagcatatgatagacttaatggcccatataattagaaaccgctag

SEQ ID NO: 23739 - DNA, 354 bp, Glycine max
  Peptide Sequence Number=SeqID_115424
atgataaccgtggggaggttgccaaccaagtgcttcattagccacaatagactttatactcacgtgaagatcaaatatgagacaaaataccattttttatctgtgacgtgttcatgcaagtgtgccaaaaaccatgaccacgctgttaacgtctcaccttcgactacggcgaatgctagaggaaggacaccaccatttccatcttgtgatgtgcccattaaagagggtcccatcgtatttgtcgtacaaatatgtgtcatcaacttgtatgattggcttacaatacttgaaagcctctttacattgactaaaagtccaaaaacactctatgaaactgacggtgtttacgactaa

SEQ ID NO: 23740 - DNA, 262 bp, Glycine max
  Peptide Sequence Number=SeqID_115425
cgtccagatgagttatgtttatgaggacataaccaagggcaaggaccatgaagcagttgaaggtcccatgactagaggcagacttaaacaagcccaacacatcatagagacaaggctgtttctctccgggttccttgttgaaccaattatcagacttatcaaggtaatccttgtggcgtctaccctgacttatcttccttcactggaagtggcgtcatccaaaacctccgtagcctgtatcaaacgatccgctcctactcag

SEQ ID NO: 23741 - DNA, 492 bp, Glycine max
  Peptide Sequence Number=SeqID_115426
atgagtcttcattcctcatctagtgttaatggtgagggttctactcctaaggaccccttgtataagatattagatgagttgagatcccttaagttgtggaaagaaaaacaagagagaaaagaaaaaggtaaaagaagagtggaagaaataagtcaagatgaaagagagaaaataagagaggaagaaagaagaaaaataatgaaagaaatgaaaagagaaaaacatgcctcctatagtagtcataactcttgcaagagcctaagtgaagaacttcgtgactattatgatggaaggcataggtcacatcttagacctcactcccataggtcacatcatgatgtaagctcctttggagcttgtaggcctaggatcttcttcatcaatggattcctttgctcttggaagatgaatggcagcggaatagagaaggaagagagagaggagacgccacttcaaggagaagatgagtctagaagaagctcaccaccatag

SEQ ID NO: 23742 - DNA, 339 bp, Glycine max
  Peptide Sequence Number=SeqID_115427
atggtcaacaaaatcaagattgagaaatttacaaggaataatagcttcaacctttggcacatcaagatacaagccttgttgaaagaagaaggcattggggctcctctctccgatcaaccgttgaagattgataagttagtgcttgagttacaagaggaaaagcctctctccctcgctcctatgagaattttgagttctcttagtgtagggaaggactccattacacttgaagaagtcaagtccaatctttattctagagagcttcgactaaaggcgtctagcaatggtgataaagcctctacatctgaattattagtgactgattctgctaaagggtag

SEQ ID NO: 23743 - DNA, 123 bp, Glycine max
  Peptide Sequence Number=SeqID_115428
atgcttgaaggtaccaaacaagggagaccaagtaaagatcaaatggtgaactttcaaggtatggctttcaaggccaacgtggaagttgaatgtcgggaagttatatgtgttgcaattgactag

SEQ ID NO: 23744 - DNA, 945 bp, Glycine max
  Peptide Sequence Number=SeqID_115429
atgtccttttctttgattggttccatgctttacaccatcaaaaaagatatagattacccatggaagcaagacatcataggtgatccatctactaaccttataaccaactcaaccgtaagagtagaaaccattaaaactaaggtagtttctaagcaaaaatcggttgaagaagcctctccaagtattcccattgaaaaaccactgttcaaacctttcaaagttagtgagaaagctaagcgaaagattagagatcttaggaaaactaaatccttagttgaaggagtaggtgacaatcatagtgaattactaaacaagattggtagtttacttaaggtcattccggaaactccccaaacctcggaaaatacttccaaaatggtaacaagaagtacctccaaattaattaatgtcattaatgaagatagtgaccaaaacttaaataacacaaatgagacaggatcagtgtcagaaaagaatataaatccaattaattccaaacattggaaaacaccttccaaattatattatcaacgtccaactgcccctgaccttctattagaagaaagaggagaaaacaatttcaagagttttagtgcaaacaacatctatgaatggaacatagatgcacaaacggagtataatatcatgaatacactccaacatatgaccatggtagccaaggcttaccaaacctcccacgaatattcagaagagactattatagacatcttagtggcaggattttctggacaactgaaaggatggtgggataatgacgatgataaagagattcctgacgccatcaataccttaattttaacaatagctcaacattttattggagacccatccttatggaaagataggtctgcagaattattatcaaaccttaagtgtagaaccttagcagattttaggtggtacagagatactttcctaactagg

SEQ ID NO: 23745 - DNA, 360 bp, Glycine max
  Peptide Sequence Number=SeqID_115430
atggggatcgcacccacagagacacccagtggacctgaagaagtccaacagggccctggggtttccagctctggttacaggcctctgtcggccctacagggcgcccgttccccccaggattgtgcccgtaagacacctagtggacccgaagaaggccaacagggtcttggagttgccaactctaaatacgggtctctgtcatcaggcccccctaccaatcgagctttcatcaagaagtactgcgcccccaggcaggcgcagggcgaaacaccacatcagcattgggatggccggcaacgggcaatagacgcaccgccatcacctctagagttcacctctgctcatccacaaaaaggttag

SEQ ID NO: 23746 - DNA, 306 bp, Glycine max
  Peptide Sequence Number=SeqID_115431
atgagggatgagatggattctatggcatctaaccaagtttgggatctcgttgagttgcctgttggtggatacaaagtaccatcggtatgtagacctgggtcttcaaacacaaagaaagattctcagaaggcaacattgagagacataagctttaaaacaacaaaagtgaaagtcgaagtaacactgtatgatcaagatgacattctgcttgcgactaatgataagggtatgctatatgaggtgaaacaatttctctcaaagaactttgatatgaagggatatgggagaggcatcttattgtcatag

SEQ ID NO: 23747 - DNA, 721 bp, Glycine max
  Peptide Sequence Number=SeqID_115432
tgtcctcgcctttagagggctgcacgccctcaccttcggaggactacacgtcctcccctttagaggactacacgtcctcgccatcatagggctgcatacccttcccttcaaagggctacacgcccttgccatcagagggctgcacgccctcaccttcaaaggacaacatgtcctcgccttcagagcactacatgtcctcatcttcagaggactacacgtcctcgccttcagaggactacacatcctcggcttcagaagaatacacgttctcgccttcagaggactacacattcacgccgtcagaggactacacgtcctcgccttcagaggactatacgtcctagcctttagaggactacacgtcctcgcctacagaggactacacgtcctcgccttcagaggactacacatcctccttcagaggactccacgtcctcgccttcagagggctacacgccctccctctgaggcacgccctcgccatcgagaggactacatacggctacacgccctcgccttcagaggactacgtgtcctcaccttcagagggatacacgccctcgcctttagaggactacacgtcctaaccctcataggactacacgtcctcacctttagaggactacacgtccttgcttttagaggactacacgtcctcaccttcggaggactacatgtcctctataacgacccgcctcgtcgcacggtgtccacactctaa

SEQ ID NO: 23748 - DNA, 348 bp, Glycine max
  Peptide Sequence Number=SeqID_115433
atgctcaaatgtcagtatgacagatctgtgagcgcggaagatgacgtaaatcttcgcgtgtcaatgggcttgccagccgcgattgacgaagggcgcagaagagacgttagtctctgcgtgctatcaggcttttcgtcttacagacagcaaaaaagaatgtttatacggataaccactcggacagcaaaaaagaatgtttatacggataaccactcgggtatttccgcccgtcagcgtgactcaaatgtcagtatgacagatcttgtgagcgcggaagatgatgtaaatctccgcgtgtcaacgggctttgcgactgtgattgacgaagggcacagaagacaacgttag

SEQ ID NO: 23749 - DNA, 279 bp, Glycine max
  Peptide Sequence Number=SeqID_115434
atgggtgatcacgtgcagcacgttcatcagctgacgcttgtattcgtggatgcgtttgatctgcacgtcgaacagctctttcgggttggccaccacgttgaggtggagcgccagccagaccgccagctgtttttttgttcagcagcttggcttcgcgcacgggccttattcaccggtcggaaaatcaatatgctgttcaagctcgctcaggttggctcaaatcggtacgccgggtgcggccgatattctcgtccagcacctcagagagcggctggttag

SEQ ID NO: 23750 - DNA, 169 bp, Glycine max
  Peptide Sequence Number=SeqID_115435
atggcggttgcttctggaggaagcaacctggctcgcctgggcgagctgggtggcaagctcctcccctattttcctataaatagagggaggagtgaaggagaaaggggttcagcccttctgattttcaactgttcttcgtcattcttcgtcgctcttcggtcttcaaccg

SEQ ID NO: 23751 - DNA, 274 bp, Glycine max
  Peptide Sequence Number=SeqID_115436
atgtcagcaacatttcaaaacaaagtcgtcgttgttaccggtggtactagcggtattggtcttgctacagctaaatattttgcaaaccagggtgcgcatgtttatatcactggccgcagacaagccgagttagaggccgccatcaaaaccataggcggtaaggtaaaaggcgttcaggccgatatgtccaaattggcggatattgaccgtctctatgatgccgtacagcaaaatcactcgcagattgatgtgatttatgccaacgcgggtggcg

SEQ ID NO: 23752 - DNA, 336 bp, Glycine max
  Peptide Sequence Number=SeqID_115437
atgcttgataaaggttgtaatggcttagctggagaagaagtattagctcaagaagatgagaggggtagatgttttgagcctgaaacctctgaggatgagtggcagaagtctcgaactagatctcttaggagaaaagcaatgactgcttcaaccagactcgcttatagtctcaggaagcgtaatacacgtgtagcaaatagtgactttgcttcaattttcatagaagatgtccgcgatgctaacgaggaaaaagctgtgaattcatttcgtcaggtgctacttacaagagatctgcttccagattcccatgatgattatcatgaaatgctgaggtaa

SEQ ID NO: 23753 - DNA, 321 bp, Glycine max
  Peptide Sequence Number=SeqID_115438
atggagtatccatggcccggtaacattcgtgaattggaaaacgtgatccaccgcgcagtgctggtgagcacttcgaacacgctctaccccaaagacttaaacctgcctaaaatcagctttaaccggccagagtttgcggccgatgaagagagcagtattgttgcgccgattacgactcgcatcagctatgagcgtcagagtgcactctacaaattagaaagtgtactagaagagctttttgagcaggcgccagaaaacttatatgagctgattaatggcactaccgtaagcaaggcctatgaacatagcaagaacaaccag

SEQ ID NO: 23754 - DNA, 192 bp, Glycine max
  Peptide Sequence Number=SeqID_115439
atgaaccttttcgtaaaagcacgagcttggttcaaccccataacccagggaatggcaattttgattgccaatacttcatcaaaatttcatagggatgaaaaactcgggaatacgcatgctatgcatggaaaatgggaaaacacaagggtcccacatgagcaaacctcaaaaccattggtatgcaatttgtag

SEQ ID NO: 23755 - DNA, 144 bp, Glycine max
  Peptide Sequence Number=SeqID_115440
atgtcttggaactgccttactatgaaccctattcaacaaatacatggcagtttcaaggcatacatccacaaagatacggcctttttacttcattgtagtaaatttctaaggcatccattgcctaagaaatctcgggcaagttaa

SEQ ID NO: 23756 - DNA, 681 bp, Glycine max
  Peptide Sequence Number=SeqID_115441
atgtatgaccagttagatgaggcttgtaggaccaccacccgacagcttgcggggtacttgacgctacttcagatctatgagcacttccctagtgtgcaccagtgcgtgactgacgatacataccaggagacgtccccacgtgcttcccgatggttgacgtcgaagacgcacatgaagggaatcacaggagcaccctacagggcacgttgtgatggtttgatcgtcacagatgtgtcctggttgctgtacacggagcatcggggggttagggcgtttcaggagatttcatgtttccagggtcaacttagatggggtcctatggtcgtcacggttcgaccggagagggtggtatttgcggattacatggagtggtttttccgcatatctcacccattcatgacaccgacccaggcaggtgaccagcagagggatgcatcagctgcagaccctgaggactacatacagccgcccagcccccaggttccagtgccatttgacccccttccacatgtgggatatgaggcgattgcacagaggttggagcgtgtgctcaaccttaggatagtcactgcaggcatagagttatatgacattatgcaagactgcctgacgatcgcgagagggggactcagtgctgatgggactgtcagggctcgtcagagacgccgcacggaccattga

SEQ ID NO: 23757 - DNA, 438 bp, Glycine max
  Peptide Sequence Number=SeqID_115442
atgaatgtttgtttcacctcggggagttgcatgacatggaaaacctgtcccgtggtggaagaattgcttcagcggctcattgattacgggcagcttgaagtgtccataggagggagggaagaaccacaaatttgcatgcagtcggaagagaagaaagttcctctaacccccaaggccctagtgatatgttttactaggaaagggaccggctccacacccatatacccccggacggcacccaagccaacaccatttgcatatcaaagtaataaggtcgttccttggaagtatacccctcccgcgtccagcgaaagagttgcaaccgaagttgactccctatcagctaaggtaaccaacatcactggcctcaatggcgtaacccgcagtggtcgggtgttcgcttcccctcacccgacggaattgacctccaaagggaaa

SEQ ID NO: 23758 - DNA, 627 bp, Glycine max
  Peptide Sequence Number=SeqID_115443
atgacgttgctcctcagcaacatcctgcccaccgatcataattccgacctccccatgcctaagtgccagctggtgtacgccatcctgacacggatgagcatccatgtggctcagttgatcgctgatgccatatatatttttgcaggtatggcgcccactaggcaccctttggacccagataagtccaacagggccctgggattccccgcactgatcacaggactctgccagtcgttcggagtccccgttgcacctaccaaggtgattcggccgcccatcacccgggcttttattgagaagtactgtacccagagacaggctcagggtgatgctccacaggccgcaggcgcgcccccaccacctcatcaggctggccaggctggggcatttgacatggagcagtatttacggcatttgatgagccttagcatgcagagccagggcttcgctcctttttcatgccctactccagaccagttcagggcagaggttgcatggcccggagattggcccgaggcccaagcaggagaggcacccccagaagctcccggcgatggagaagaagcccacgaggatgaggagatggctgatttgcttgacttcttgggagggagtggagacacgtga

SEQ ID NO: 23759 - DNA, 561 bp, Glycine max
  Peptide Sequence Number=SeqID_115444
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtgggggatcctgaggtggatcataattgctgggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 23760 - DNA, 148 bp, Glycine max
  Peptide Sequence Number=SeqID_115445
atggaggagttgattaacaaaacacaactctctccccaaaataatcccaacatcatcacatcggcttggcggctcctcaacagaatctcatccttgcacactactgctgtcattctgctcccacgaacaaggttcacgatcatcacag

SEQ ID NO: 23761 - DNA, 201 bp, Glycine max
  Peptide Sequence Number=SeqID_115446
atgactaccaatttgtcagagtctgttaattccatgttaaaaaacacaacacatttgtcgatgtcatcattggttgaggagacgtatttcaaaaccgcacaactctttgctaagagaggtcgacaaactcgggcaatgatgaactctggcacacagtattctggagttgtcttcgatgtaatgaatagcagtcaacaataa

SEQ ID NO: 23762 - DNA, 408 bp, Glycine max
  Peptide Sequence Number=SeqID_115447
atgacacatcaaatttccccacacttagcctttttcactcctaggcaaaataaaaaagcagagcaaggaacaaatccagagacattaaagagagacaatcaaacacaaaaacatttatatatttctcaattaatcccaaggaatgaaaggaatgggcaacatccaacacgtaaagagttaaagaatcaagacagtcatgaaaatcatccaagcacctcaaacatggcaaggcttgtaatgagcttcaaaacaaagaaaggggacataggctcaaaggggctatcaaaggaattaattcaaggtaggctcatttggctagagacttataagaacaaaatgcctaaatcatctcccaacatgcatgtgaagcaagaagtatcaacaagagtcaagccaaggctattgtga

SEQ ID NO: 23763 - DNA, 204 bp, Glycine max
  Peptide Sequence Number=SeqID_115448
atgcccgttgacacgcagagactaacgtcgtcttctgcaccttctatcatcctgacccatgaagtcagggttttactgtcgtcgtccggagacattcaagcccgacgactcgtaagattcttctctgctgggcagggggtgatcaagttcgatggcatggggaaatgtcgtggttgtcccactttatcactttcaagacagtga

SEQ ID NO: 23764 - DNA, 71 bp, Glycine max
  Peptide Sequence Number=SeqID_115449
atggagggaggcataggtcccatactagacctcactcccaaagaagagaaaattatagagggtctcaagag

SEQ ID NO: 23765 - DNA, 288 bp, Glycine max
  Peptide Sequence Number=SeqID_115450
atggacaagtggacgaatattacggatatgggatgtgtcattgcttcacgatacaacgtgaacgttgtttctctaccacgacaacaaaacatgacattttttcctcttagaagtcagccgccaccagattcttctgtgcatcgcgtaatatgcattggtcatgtgtatggaaatcattttgtacaggtttttttacgagaccagtgtcctttaccaccattggcgtttattgtggaatacacattgtcattatcaggcaaagaagtggctcaccccatacataggtag

SEQ ID NO: 23766 - DNA, 753 bp, Glycine max
  Peptide Sequence Number=SeqID_115451
atggcaagttcccgttttaccgcccgtctgcgccagacgctggcactggctgtgctggcaggctgcgcgttcggcgctcaggcaaaaatcgatcaggtgcgtttcgccgttgatccaacctatcccccttttgaatccaaaacgccgcagggcaagctggtcgggtttgacatcgacctcggcaatgcgctgtgcgcgcagatgcaggccaaatgcgtgtgggtcgagagccagttcgacggcatgatcccggcgctgaaggcgccgctgaagcaaatcgacttcaccgtgccgctgtatgacacccacacccagctgattgcgcgtaaaggctccggcctgctgcccactgcggaatcgctgaaaggcaaaaccgtgggcgtggaacagggcaccgtgcaggagcgctacgcgctggcgaaatggcagccgcacggcgtgaacgtggtgccgtatggcgatcaggcacaggttgagagcgacctgatttccgggcgtctggacgtggtatttaccgatgcggctcaggcggctaatggcttcctgaagcaaccacagggcaaagatttcgaactggctggcccaattgttgaggatcctattatcggtccaggcactgccattggtctgcgtaaaggcgatacagaactgaaaaccgcgctggataacgcttttgcagaaatccaaaagaacggcacctttgataatattcagaagaagtactttgcaacggatgtctctatcccgcattaa

SEQ ID NO: 23767 - DNA, 882 bp, Glycine max
  Peptide Sequence Number=SeqID_115452
atgtcggcggtgggaatgctgtcggtcttcatccgcgagccggaatttgtcggccagaccaaggacaagcttgccaccgtcgaagcgcagcgcatcgtggaaaatgcaatccgtgatccgttcgatcactggatgacggcttctccgcgagaggcgtcccgcctcctggaatgggtgatcgaccgtgcggatgagcgtttgcgccgccgtcaggaaaaggaaactgtccgcaaaagcgcgacgagcaagttgcgcttgccggtcaagctcgccgattgctcccagaacgcggccgccggggcggaactgttcatcgttgaaggtgactcggcaggcggttcggccaagcaggcacgcaatcgcgccaaccaggccattttgccgttgcgaggcaagattctgaacgtcgccagcgcaggacgcgagaagctgacggcgaaccagcagattgcagatctcattcaggctattggttgcggcacacgcaagaactatcgggaagacgatctgcgctatgatcgcgtcatcgtcatgaccgatgctgacgttgacggtgcgcatattgcatccctgctcatcacattcttctatcaggaaatgccggacctgatccgcaacggccacctctatctggcagtgcctccgcttttccgcttgagccagggcggaaaggcgttcaaaggccttggcgaaatgcgcgccgaacagctcaaggaaacgaccatggaccctaagaagcgaacgcttttgcgtgtccaggtggacgaagaatatgtcgatgaaacccgcaacacggtcgatgaactgatgggcaccaagccggaagcccgtttccgtttcattcaggaccgggcggcctttgtcgaagagctggatatttag

SEQ ID NO: 23768 - DNA, 855 bp, Glycine max
  Peptide Sequence Number=SeqID_115453
atgtctcctttccttgtgagggatttcggcgcgcaaaatttcaaggctatacaaagaatccataaggcatgggaaaccccgttaaggaaagatcaagaacttagggggattcgtaatggcatcattggtggttaccatgaatggctgaaagttcatacacgaggtttagtttggctcgccaagttaaaagtcgtcagcgaagagagtttcgaagcaccggaagaggacgaagaagtccaagctctcaaaaatgagttaggaaaggcgaaacttgccaaggagaagttcaagttagccgctacacacatccggaaggaatgtgccggattacgggaagagaatgcaactaccgcaaaagcccttgaacaagaggccaagagggcttgcaaggaagagtatggtcgtaaaaaatttcgcggagctctgtggggtagcaacagtgagctcaagctgcgaagggaagagagggaccagtcgcgagcacatagcatggtccaaagaagcttgtctcagcgtatatgcgagacggagaccaacatgctagctatcatcgccaagtaccaagaagagttaggtctagccacggcccacgagcataggatcgcggacgagtatgcccaagtatacgcggaaaaagaggctagaggaagggtgatcgactctttacaccaagaggcaaccatgtggatagatcggtttgctcttaccttgaacgggagtcaggaacttccccgattgttagccaaggccaaggcgatggcagacacctactccgcccccgaagaaattcatgggcttctcggctattgtcagcatatgatagacttaatggcccacataattagaaatcgctag

SEQ ID NO: 23769 - DNA, 261 bp, Glycine max
  Peptide Sequence Number=SeqID_115454
atgtatccacttatcctcctaaaatttaaccctttctccgcccccaaccctccatttgagctcgttgaaagatgcagaagctcagtggagatatgcgttgatgacatcataagtaccattgtcaacagagacaaactttgtcagagctcagagctaaatgcattgcaaatgcctagcaactttgaacttatgtcgaagtacacaaaccctcatgatacacacacacatacaccctcagaggaagctcaagggcagtcataa

SEQ ID NO: 23770 - DNA, 1716 bp, Glycine max
  Peptide Sequence Number=SeqID_115455
atggcatttggtggacttgcagctcgcccaggcgagctgttgcttcatcctgaaggtatgacagtggtgctttccagtgattccattactaaggccactgggtgcctttgtgagggaagcactaatcaagaaaggtgggagatgatctatgactcccatgtagcaagggctctatacaagcagaatgctgaaaaagctggtgatcataagacaattatggaaaatatttcattcgacctgcctcacaccatctacatcaacatcctcagaaatctgaagggcttaggtgatctggacaacatctactatgttgccctgatcaacaaggcgttgtggtatcaaggagtttatcatgtttttgacaagatggatgacaactccaagcacaccaccatagccaaaggacacagaacaaagaaaaggcacgagcagtctggtgtgtccatcccaaagcaaaaggttgtggccgaagctgctcttgctccaaaaagagaaaaggtttccaaaccagcacctgcacccaaagaagttgtcattttatccaccgttcccaaatgtgtcaagacaagaaccgttaaacccaatcccaagattagtgacaaagagtggtttatctcttttattcgcaacaaggagacttctgcctcattatcatcagacaatgactccactgaagatactcatgtctccacccctttgcaagcatccatattcagcacccaaacaacatttacctctatccctcattcacttagaaaagttcaagagactaagaactcatcatttgagacttcatctctattcaagctcctgagtggacaacgcatgactatgtacacacactatcacaacctaccctatgacgggacagtgaaggcaaaaataaataaggcaaagcgttcgtctccaagggagaaaacgagcggagttgccaccaatgtttattcaaggaaaacgttagaaaaaccagaacaaggtctgcgaatttcgaagataagggttcggaagttgtttacgcatggggaagctcgcccaggcgagctaagacttaaacctgaagtaactggctcgccctggcgagctggttccttcaccctgaagtcatttggtggcccaggcaagccagaggctagcctaggcgagctagggtcacaccagttgctgcatggaggaacttttaaggataagaagagcactcaaaacaatatccctaaggatttgtttgagaaacacaagagggatcctttacaggaggtggaaccaccaaatagaatacatgccaatatgtacattctcaatcaagcagcttcgtatcaactagggttgcacatctcaaaggccgtcgagatcaaaattgttgcagataaggtgtgccctcgtctacccatttgggatgttgttaagaagggcaacaaactgtactataatgaaaaaattccctcaagacggatgaaagttgaagtgttgaactattcaaggaactggacctcatcatctggttatgatggaagtggcaacactgatcaccatgacttcattcaagtgttgcatttagtcaggatgtatcactttgatgatgtctattcgtgcctcaccaaggatgctgacagctactctatcatcaaacgcttgctaagtcctttaatggtggatttcaaccatggagatgcagcggaagataaaggagaagaggtagggggaggtgccatccactag

SEQ ID NO: 23771 - DNA, 198 bp, Glycine max
  Peptide Sequence Number=SeqID_115456
atggcgatagtggtggcaatggtggtagtaattggtggtggtgacaaaggcgatattggtggtagcaatgatagaggtgatattggtgctaacaatagtggtagtagtaacaatgacagtggtgatggtggtggtagtagtgttaatggtgtcaatgacgatggtgatagcggtgttggagtcgatagtcagtggtag

SEQ ID NO: 23772 - DNA, 420 bp, Glycine max
  Peptide Sequence Number=SeqID_115457
atgactcacagagctggtagcccgcggagacaccttacggttatccgcacctcgtcattcaggaggcggcgcccgaagtgtgatcaacagagaccaatatggtcatctgcacccatgatacgcggagatgaccttacggtttccgatggagacctttttgtctccagaggcggcgggcccgatgacaagcagagaccaagtttggtcattctgacccatgatatgcggagatacctttggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaagtttggtcattctgcacccatga

SEQ ID NO: 23773 - DNA, 335 bp, Glycine max
  Peptide Sequence Number=SeqID_115458
gtcatgtgacgtgcacccttatatcatccagaggcggcgggcccgatgatacgcggagataccttatggttatccgcacccttttgtcatccagaggcggcgggcccgatgacaagcagagaccaaaggcggcgggcccgatgacaagcagagaccaagtttggtcattctgcacccttgtatcatccagaggcggcgggcccgatgatacgcggagataccttacggttatccgcacccttttgtcatccagaggcggcgggcccgatgacaagcagagactaagtttggtcattctgcacccttgtatcatccagaggcgggggatcctctag

SEQ ID NO: 23774 - DNA, 363 bp, Glycine max
  Peptide Sequence Number=SeqID_115459
atggttatgggggatttcatcagcagactctccttccccgcatgcttgcattttagtggagaaaacaccgagactttttcaagtctcacaagttacccagaactacgtaggtctgagttcctcattggaggatacgtaggagcaagagcctcgcttttgtcgaccgcaccgctttttgttaccatgatccaagagctggtagcccgcggagataccttacggttatccgcacctcgtcattcagtgaccccaagtgtgattgatgagcacaggccaatgtggtcatctgcgccctttccggagatgtcagcatcttccagtggagactttctcaagtctccacagttatttagaactacgtag

SEQ ID NO: 23775 - DNA, 276 bp, Glycine max
  Peptide Sequence Number=SeqID_115460
atgattgcgcaacaatgcttcttttttacttctggaatgttgcggaactttacggattacctaaagatgggtgttaagtacctcgagatggtcaaacgaaggttgcatgccaccaaacaatggtcccaagaagaaattaggatttcaaagctctttcagagcataaaattttgtgctcttctcttcctctccctttattcatctccttcttcctccaagctcttatccatggcctcctatggtggtgagcttcttctagactcatcttctccttga

SEQ ID NO: 23776 - DNA, 273 bp, Glycine max
  Peptide Sequence Number=SeqID_115461
atggccacaatgatggaggccatgatgagcatgaagaagataatggaagccaatgcggttacaattgccactaccagcactgttgctaagtacgaatggccccatgctgtgcaaattcaaaatgagcacgccttcccaccatatggcttgcctcccaacttacaccagccaatgtggcgtacactcccaatgagaatgtcaataactccactcctatactcattgagagccaacaacctcaatctgatcatgcacatgtctcttgacccatga

SEQ ID NO: 23777 - DNA, 189 bp, Glycine max
  Peptide Sequence Number=SeqID_115462
atggagtcaggtgacatgcggagataccttatgagataccttatggtcatccgcacctttcgtcaaccaggggcaaacgagctcgttggcgcgcagagactaacgtcgtcttttgcaccttttgtcatcttgacccatggagtcaggtggcaggcggagataccttatggtcatccgcacctttcgtaa

SEQ ID NO: 23778 - DNA, 249 bp, Glycine max
  Peptide Sequence Number=SeqID_115463
atggcccgcaccaagaaaacagggaagataacgattgaggccgcaaaggaaatcgctgagaagatcgattcctttgaggagcaggcgacactgggatccttcatcccccatggacgtcaggatgttctcaccgctgctattggacgtccagagcaccctggacgtgtccgtgctgctagagccaatgtcaccatcaagcaatacttggatcggctgatcgaggctgtacccgaatcaaataaacattaa

SEQ ID NO: 23779 - DNA, 417 bp, Glycine max
  Peptide Sequence Number=SeqID_115464
atgcttggccaaacagaggagggcgtgtgcgacatgaggtcttgggtaaggggtcagtggatcccgtttgatgccgatgctattggccagctcctgggatatccgttagtgctggaagagggccaggagtgcgagtatggccagaggaggaaccggtacgatgggttcgatgaggaggccatcgccagttgctatgtataccggggcaagattttgcctggactgctgccgggagacgggtgcggatcatgtatggcgcctaccaggcaccctctggacccggataagtccaacagggccctgggatttcccgccttgatcacaggactctgccagtcgttcggcgtccccgtcacacctagcaaggtgattcggccgcccatcacccgagcttttattgagaagtactgcacgtag

SEQ ID NO: 23780 - DNA, 243 bp, Glycine max
  Peptide Sequence Number=SeqID_115465
atgctggcgcgcatgtccaaagccgccatcgtgccctttgttccccgccgcaagccggatggttcaggctacgagctgattatgctggagccggaacttgcgccgccgctggatgatgccgagacaaccgcccgctggatgaacggcattgtcgagaagtgcatcctgctcgcgccagagcagtatatgtggctgcaccgccgctttaaaacgcggccaaacgggacaccgtcccgctattga

SEQ ID NO: 23781 - DNA, 1018 bp, Glycine max
  Peptide Sequence Number=SeqID_115466
atggctacctcaccaaaagaaacttcagctcctggttcacccgctgtaccatcatctccgcaccaggaacaacctgaattcaacatccaacccatacaaataattcctggtcaagcctctgctcctgagaaactggctcccagaagacaacagggagtgaagattgctgaaaaccctagccttgcaacaagtcctagggaagtagacacggagatggacaagaaaatccgcagtattgtgagtagcattctgaaagatgcgtctgtgcctgatgctgatgaagatgttccaacatcctccaccccgaatggttctgtgcctgatgttgataaagatgttccaacatcttccgctccaaatgctgaagccctcccttcacccagtgaagaggagtcaacagaagaagaggatcaagcctcagaggagacccctgcaccaagggcaccagaacctgctccaggtgacctcattgacctagaagaagtcgaatctgatgaggaacccattgccaacaggttggcacctggcattgcagaaaggttacaaagccgaaagggaaaaacccccattaagaggtctgaacgaatcaaaactatggcacagaagaagagcactccaatcactcataccacatccagacggagcaaagttgcaatcccctccaaaaagaggaaagaaatttcctcatctgatcctgatgatgatgtcgaactagatgtctcgacatcaaagagggccaagaaatctgggagaaaggtacctggaaatgttcctgatgcaccattggacaacatctctttccactccattggcaatgttgaaaagtggaaatatgtgtatcaacgcagacttgcggttgaaagagaactgggaagagatgccttggattgcaaggagaccatggacctcattaaggctgctggactactgaagacagtcaccaaattgggagactgttatgaaggcctagtcagggaattcattgtcaacattccctctgacataacaaacagaaaga

SEQ ID NO: 23782 - DNA, 336 bp, Glycine max
  Peptide Sequence Number=SeqID_115467
atgaaaatcaaatccaaaacatttccaaaaatcgagttgaagtgcttccgtaacgcttccgtaagcgattatgtggaaattcttcatcattcttcaccgttcttcgttgttcttcagtcttcaaccgaactacgtaggtctgatttccttatcgctgtcgcaacctacccttcggcgggagggcgacgcgtgactcgcgggatgcgtgttccacgaaaggaatacgcgcggagtcgccaccaacgtttatttgaggaaaacgtcggaaaaaccgaagaagacgcgatctacgaacttttagtgaaaggtcaggagttgtatttacgcacagggaag

SEQ ID NO: 23783 - DNA, 281 bp, Glycine max
  Peptide Sequence Number=SeqID_115468
agggattccctggtggtccacgtgacccgtcagtgctcacatcatttgccgagcatgttgcacatgccgtgtggagtggacaggaacgtcctgatttgaagttagtgtcacatgggaggaagctgacactgattgggaggccagtgcctgagattgaaggcctggtggctgccacaggattaagtccactgatagattgttcagttattactggcgatcctggacttatatccacattcttcttgattatcataatcataatccatatgaacttcttgtga

SEQ ID NO: 23784 - DNA, 303 bp, Glycine max
  Peptide Sequence Number=SeqID_115469
atgtatcagtatccttttgaaggtcatcacactgatacttctgcgagcgaacattcgttcggtggtgttgtggaaacacaacctcatttttcatggcccactatgactccttcacagcaacatgatgccccaatggcaacacctaacgccccatttgctccgcaatggaatgagttttctgctgaggctaagcaagtagaagcagggagacatcacggcagaagaaatcctgattgtcaagcgcgaagatgggatcgacaatgtggcacatccttacgacatcacgaacaccataatgaatga

SEQ ID NO: 23785 - DNA, 941 bp, Glycine max
  Peptide Sequence Number=SeqID_115470
cgcggtcaattggtttcctcgttggaaggaaggcaaggaaggagttcttttctcgtgtggggactaccctaatgttgcactgatagggactaggggttgtattaattataatcccacactctccataagacagctagggtaccccatgaggggagcgccaaccgaagaaagtctctcgccttgccttgtgagtgatctaggcgcgcaaggtctcaaggttatacaaagaatccacaaggcgtggaggaatccgttgaagaaagacaaggagcttaggggcatccgaaatggcgtcattgaaggttatcatggatggctaagaattcatgcgcgagggttagattggctctccaaattgaaagtcatcgatgaggagaatttcgaagctccggaggaagatgaagaagcgagactcgccaaggagaagttcaagtcagctgctacacacatccggaaggagtgcaccgatttacaagaggaaaacgcggccgctacaaaagcccttgaacaagaaaccaaaagggcccgtaaggaggaatatgaccgagagaaattccgaggagcattgtggggtagtaacaatgagctcaagctccgaagagaagagagagatcggtcacgggtccaaaaggagtttggctcaacacttggaagccacggagcaaagcgtgctagcggggcgggggggcaatacaaggaagaattgaaccagtccatggcccatgaacaaaagctagtggaggattttgcacgagtgtatgctgaaaaagaagcaagagggagggtgattgatgcgttgcatcatgaggcgactatatggatggataggttcgccttgaccttgaatggaagtcaagacctcccgcgtctgttagccaaagcaaaggccatggccgaagtgtgtactgcccccgaggagatccatgggctaatcaattact

SEQ ID NO: 23786 - DNA, 300 bp, Glycine max
  Peptide Sequence Number=SeqID_115471
atgggtctaggcaaggatggcctcgggaatgccgacgtggtcgatatcaagggaaatccatacaaatatggattagggtatgaacccgggatgccggggaggaggaatgtgccgtcaagacttcgggcggatagagtatggttcggccgtattagccagtgtttcaccagtgccggaatggtgtccgaggaggaggtggctgcaatggaagaggagttccctcaagacccgccaagttttgtgcaaccatgccatcccgattctcaagtgggaaactggcgcgtgataagccagtcggaa

SEQ ID NO: 23787 - DNA, 69 bp, Glycine max
  Peptide Sequence Number=SeqID_115472
atggccatcatcgataagtgcaaagagaagctcaaatctttagcggcgactcacgagcaaaaaggatga

SEQ ID NO: 23788 - DNA, 276 bp, Glycine max
  Peptide Sequence Number=SeqID_115473
atgaatagccaatatatttgcttttatctcatgcctttcttcgttcatggttcgatattctggtgtcctaggcgtagaggaaccacaccaatccatcccgaacttggtggatactccggggaacagatatccagtggagatgacggggtggggcctgtagctcagaggattagagcacgtggctacgaaccacggtgtcgggggttcgaatccctcctcgcccacaaccggccaaaaaagggaaggatttttccctctggggtaggaaaatcatga

SEQ ID NO: 23789 - DNA, 201 bp, Glycine max
  Peptide Sequence Number=SeqID_115474
atgagtcatgattgtgtggaacaatcaaaaactctaattgaaacacttatactacaagccctgagagcttggcacaacgatgctaacttggtagtggctagcaaactggactgctctctcagtcacatcagagtttgtaggaacttcaatgaaaataggtttgatggcatgcacgttgccttggttaatcatgaagggtag

SEQ ID NO: 23790 - DNA, 1962 bp, Glycine max
  Peptide Sequence Number=SeqID_115475
atgacgatgactcagtctgtgttcagaacatcatcaactgcacggaccaaaaccgcgaacctcacgagcatgttcggcaaatacgtggacaaaaccagcgtccatagttggaacaccgtaatcgcggacctctctcgaagcggagattcagttgaagcgctaagcgccttcgcctcaatgcggaagctgtctctgcacccgaaccgctccacgttcccctgcgccatcaaggcctgcgccgcgctctccgacctccgtgccggcgcccaggcccaccagcaggccttcgccttcggtttcggccacgacatcttcgtctcctccgcgctcatcgacatgtactccaaatgcgcccgcctcgaccacgcctgccacctgttcgacgaaattcccgaacgaaacgtggtctcctggacgtccatcattgccggttacgtccaaaacgaccgcgctagggacgcggttcgcatctttaaggagcttctggttgaggagagtgggagtctggagtccgaggatggtgttttcgtggactcggtgcttctggggtgtgttgtttcggcgtgttcgaaggtggggcggaggagtgtgaccgaaggtgttcatgggtgggtgatcaagagggggtttgaggggagtgttggggttgggaatactttgatggatgcttatgcaaagtgtggggagatgggtgtggcgaggaaggtgtttgatgggatggatgagagtgatgactattcttggaactctatgattgctgagtatgcgcagaatggtttgtctgctgaggctttctgtgtttttggtgagatggtgaagagtggcaaggtcagatataatgcagtgacgttgtccgcggtgttgttagcctgcgcaagttcaggagctttgcaactggggaagtgcatacatgatcaggttataaagatggatttggaagatagtgtgtttgtaggtacttctattgttgatatgtactgcaaatgtgggagagttgagatggctaggaaggcatttgatcgcatgaaagtgaagaatgttaagtcatggactgctatgattgctggttatggaatgcatggctgtgcaaaagaggctatggaaatcttctacaagatgataaggtctggagtcaagccgaattacattacttttgtgtcggttttagctgcttgcagccatgctggtatgttaaaagaaggctggcattggtttaatagaatgaaatgtgaatttaatgtagaacctgggattgagcattattcgtgcatggttgatctccttgggcgtgctggctgtcttaatgaggcttatggtttgatacaggaaatgaatgtgaagcctgattttataatctggggttcccttcttggggcttgtaggattcacaagaatgtggaactaggggagatctctgcaagaaaactattcgagttagatccaagtaattgtgggtactatgtgctactctccaatatttatgctgatgctggaaggtgggccgatgttgagaggatgaggatattgatgaagagtcgtggattacttaaaacccctggatttagtatagtggaactcaaaggtcggatacatgtatttttagttggagacaaagagcatcctcaacatgagaagatttatgagtatttggacaaattaaatgtcaagctgcaagaacttgggtatatgccaaatgtgacatcagtgcttcatgacgttgatgaggaagagaaaggaatggttctaagagttcatagtgagaaactagctgttgcctttggaatcatgaattcagttcctggatcaataatccaaatcataaaaaatcttagaatttgtggtgactgccactctgcaattaaattgatttccaaagcagtaaatcgagaaattgttgtaagagattctaagcggtttcatcatttcaaggatgggttgtgttcgtgtggggactattggtga

SEQ ID NO: 23791 - DNA, 936 bp, Glycine max
  Peptide Sequence Number=SeqID_115476
atggagtatcattgtctttgtcgatcactaatcttcgtcggagaaactggttggccacctctggtggggtttgtttgggatgaggcaaagtacccgaccatgtcgcctttgaaggagattgtggatggtattcacagtcaagtggcaaagattgaggatgatctcaaggttcgtgtttctgagtataacaatatccgcagtcagcttaatgctatcaaccgaaagcaaactggaaggtgtgtggatgttgttatgactggtatagttttcaaatatagtatgttctatttctttgctgatctacttgactatttcagcttagcagtccgtgatctttccaacttggtaaaacctgaggacattgtccccaggtcttctaagaagttgtatgaggataacgaatatgctctttatactgtaacactcttcagtcgtgttgcggataattttagaactagtgcacgtgaaaaagggttccaaattcgtgactttgaatacagtccagaaacacatgagaaccgaaagcaggagttagataaattggtacaagatcaggaaagattgagggcttctctgttgcaatggtgctataccagctatggagaggttttcagttcctggatgcacttttgtgctgtgcgtttatttgctgagagcattctgagatatggtctgccaccatctttcttggtaatatactcttctaaaatcaaagtgcagtctaatgacccctgggattttcaaacactgatcactgagtattgggtattccaggcatgtgttttagctccttctgtaaaatccgagaagaaagtacgttctatccttgaaggtgcatactggaagaccgaggatgaagtaggtgccgggatggctggcctagcaggtgatgccgatgctcacccctatgtgtctttcaccatcaatgttgcttga

SEQ ID NO: 23792 - DNA, 216 bp, Glycine max
  Peptide Sequence Number=SeqID_115477
atggaggaatctttggcgtcaggcatatggaaaagggaaaccgtttcgaagagcttgattggggaagaatacgacagggaatggaaggcagagactgacagggaagtgatgatgatgaaaatactagtatgtgtgaatttaacaagagaaattgcggaaaaaggaaaaagaatgagacattgtcccgaggacaagctgcaaaaatgggatctttaa

SEQ ID NO: 23793 - DNA, 1146 bp, Glycine max
  Peptide Sequence Number=SeqID_115478
atgttgccatgcgattactgccattccaaacccgccatactcttctgcagaccagattccgctaaactatgcttgctatgcgaccagcacgtgcacgccgccaacgccctctccctcaagcacgtgcgcttccagatttgcgactcctgcaagaccgacaccgctgtcctccgctgctccaccgacaacctcgtcctctgccaccactgcgatgtggaaacccacggtgctgccgcttcctcccaccaccaacgtcaccgcctccacggcctctccggctgcccctccgtcacggagatcgtctccgcgctgtgcctcgatttccgggcccaggatcccgtggtccccaccgccgcctccggcggtcgcgatgaggtgtacgagcaggtgctggaaatcgcgcggcagaggaacgacgacctcggcgccgaacaactcaagttcgacgaatcccccataaacgacgtcgttgttgttgacgagatgctgatgcagcaaacgccgttcacgtctttgcttatgttgccaaattccgaatctgaattcgactcccgaaaaagtaacgataacaacggttacggaaccgaggcaggggatcttctctggaattataaccccgcgtatcagcctcctcaggtgtgggattttcagttacaaaaatcaagagattgccatgaaccaagagttgtaacatttgatggtctagaagttccaaaattatttcaggatgagcacaatatgaagtactcaacaattggtgatgacattgatattctatcaagaaataatcaatcggatcagtcatcatcaagccatgcaaagaagaaagaagagaacaacaaaaaagctaaaggtgggttatcatcagagtccaaactgtttgaatccataccgtacaatggcaccaacaatgtcgtagtcatggagcatcttgttggtgggaatgaaaatgttggcaccttaacagccagggttagtttggaagagttggctaagaatagaggggatgccatgttgcgttacaaggagaagaagaaaactcgaaggtacgataagcacattcgctatgaatcaaggaaggccagggctgatactagaaaaagggtgagagggagatttgtgaaggcaagtgatgttcaagcgtga

SEQ ID NO: 23794 - DNA, 522 bp, Glycine max
  Peptide Sequence Number=SeqID_115479
atggcagcaagatttggagccaaaattgtaccttttggtgcagttggagaagatgaccttggtgaagttagatatggctctacaaatgagcaattaagtggtctggtagaagtaacttcagtcttgacttttgtagtttttgattatgatgacttggtgaagattccttactttaggtcggaaatagaaagcctcacaaatgaggctacgcagttaaggagtgatgctggtggtgaggtggcaaatcagccagtgcatatgcctttgattttgcctaaagttcctggtcggttctactattattttggaaaaccattggaaacggaagggaggaaacaagaactgagagacgacaaacagaaatctcatgagttatatttacaagtgaaatctgaggttgagagatgtattgcgtatttaaaggtgaaaagagaaagcgacccctacagaggtatagggcctcgactattataccaggctacacatggtttcgagtctgaagttccaacatttgaaatttga

SEQ ID NO: 23795 - DNA, 507 bp, Glycine max
  Peptide Sequence Number=SeqID_115480
atggcagacccaacagctatttacgagtttttcaagcagcagccctcaaacggtggtggaaagagagcaccaccaccgtcctccgccggcggcaccacacgcaccttccaatgccacttctgccaccgcaagttctacacctcccaagccctcggcggccaccagaacgcccacaagctcgagcgcgccgccgcgagaagatcctccgccaacgccaacctcaacctcaacgtcgtcccccctgctgctactaacgggcccatgcccatgctggagcccaccgagctcttttttcaccaccaccctccttactggctcgatgtggagcccttgcagcactttcatcatcaccacactactgcacctctttcttccttccacgctgctgcgtcttccgtttccgcacctcaacaacaacaacttcttctctccgccggacacaacaacgtcgtcgacgtcgctgcttcttccgaccacgtcaacctcgacctcaccctccgcttgtga

SEQ ID NO: 23796 - DNA, 147 bp, Glycine max
  Peptide Sequence Number=SeqID_115481
atggcttctcgtttcgatcaagctcttcttttgggaattatatttgttgcatttgttctcacttcaggagagaagggtttgggtctggcatctgtaagaatgatgggaaatatactcgctgttcttgtacgtagtgtaaatttataa

SEQ ID NO: 23797 - DNA, 855 bp, Glycine max
  Peptide Sequence Number=SeqID_115482
atgggtggggtgtatattttctttcaccattgtcaactggggacgggggaagctgcacatgttcagtcagaacgggcaactaacacctgccaacagttattgaatggcaacaacattcagtcattagctgagcagagctcaaaggaaattcaaacctccatgactcccgcaagtttaagtatttctagtgaaagggagcaatcagctccattaatgtacacaccacaagtgtcattttctcaaaaaactggacacattgaggaagatccacgcaagtctgcagctgctgcagtggcagcaaaactgactgcttcaacatcctccgcgcagatgctatcttttgtgctgtcctctctagcatccgaaggtgtgataggcaatccaatgaaagaatcttctgcagattatcactctgagaagaggaccaagctcgagaatgaccagcagccatcttttataccatctcagaatcctcagcaaccacttcctccctttccactttctgagtctattcaacacaatgcacccacaaccaaccagcaatctactcccagcgaaccaccacctccaccctcttcatcacctccccctttgccgccaccaccaccaccaatgtcacagtaccctgtgccgcagttcatgcagactgccggatccattagtagtatggcatatggctatggtgtggcacaacagccatcaatggcagcctatccgggtgttgggccttccctgaatggtgtttcttcttttacccctcctccaatgggtacatatcagggttttcagggcacagatggaaattactataatcagccctcatcaatgcctatggccccaatatctcgacaataa

SEQ ID NO: 23798 - DNA, 237 bp, Glycine max
  Peptide Sequence Number=SeqID_115483
atggttcatgatgatgatgttgaaggtgaagaaaacacgatatggaagcacatgaagtcgtcttcacttgcgtgggtaacacactcgtgtgaatatgggatgcgatttggaaggcaaaatgaaagcaaagacaacgacttttgtttgtggcagcaatcgtgcacagatttggaaaaggaggtggcagcgcaatggtggctgggtactagggtgatggtggctggtgaaggttcatag

SEQ ID NO: 23799 - DNA, 288 bp, Glycine max
  Peptide Sequence Number=SeqID_115484
atgaaaaagaaaaatgagaaattctctctaagtgtgggtcttgatcttgagcattcttggaagccaagcattcttgttttccatcttttaccgaaccaagaaaacatggagcagaagcagaaaccagaaggcataaggtgttggaacagtaaagaatcattaattcaagccagaatggtacttcactataccaacacattatctgttctgagttctgaattgtcgttgaagctaccaaattccataattgttcatgtagagaaggcaactgaaggatcttttcattga

SEQ ID NO: 23800 - DNA, 923 bp, Glycine max
  Peptide Sequence Number=SeqID_115485
ttgagcctgcaagaaccaagcttcctgggaaaaccaggttccccatctcacaaatcagtgttatgggttttgtgtattgtgatttctgctccaacagcagcttttccagacacagctacttcttgccaggtgctgaggtcaaagtagattgcatgttcaaagcactttcagagaaaacttctgagcagatttcactttcagtgaacagaactaccaataagtatgggatgtacaagctggaaatcccttcagtggatggagtgaaatgtgcagaagattctgcagttgtgtcttcttgccaagcaagcttaataggtagttcatcctctgcttgcaatgttcctggctacaaaaccacttctaatgtgatagcaatcaaagcaagaagagccaacctctgcatatacagcttcaatgctttgactttcagaccatccaagagggacatcaccttgtgtgactctggaactgatttatataatggcagtaatcaaaatctggaagttctttactcttggtggctggaggcaataaaatcaagaagtgttgaaaagctgaaccatctaatggtcagtgaattgtacatgccagcatggctcagcacatgcttctctgctaaaggaaaatatcatcatgacatgacgtgtgccaacaacattgtaggaaaatatcatcatgacatgacgtggaagcatgacctgtgtaaagcttcccgcgacaaacccaccatccaagattcttcgggagctctcattggagttagatctaagaagaatgatgatgatgtggttgaagggggtgacagatctcagatgctagagatggacatttctcatggcataaaagatgaacaaggaaaacaaggggtatcactctattttggaatagctaatttggaaggtaaattttatcttatgaaataa

SEQ ID NO: 23801 - DNA, 189 bp, Glycine max
  Peptide Sequence Number=SeqID_115486
atggtcagtgaattgtacatgccagcatggctcagcacatgcttctctgctaaaggtggaagcatgacctgtgtaaagcttccctcgacaaacccaccatccaagattcttcgggaactctcattggagttagatctaagaagaatgatgatgatgtggttgaagggggtgacagatctcagatgctag

SEQ ID NO: 23802 - DNA, 207 bp, Glycine max
  Peptide Sequence Number=SeqID_115487
atggattggggtggactgaatgtcgatcaaatcagtgcactgaacaaggaaaatggagaattgtgtacatatatggatatggatccagccattcatcacattatgtggaagcacaagggctggctaaagagacaaaagaaagggaagaagaaaagtgcaaaaggagataaagaggtgcaaagtgaaaagtcagaatgtgcaaagtga

SEQ ID NO: 23803 - DNA, 291 bp, Glycine max
  Peptide Sequence Number=SeqID_115488
atggaggtgatggaccacgtgcgtatgaagaggcaagagaaattggagaaaatgatcgctgcagagaacatgccaatggagttcattagaagagagaaggaaagctctatactgaattgcattgagaattgggtggcaaaaatatggatgggggtacgggaggaaggaaagggcaggcaaatattgagcaaggaaagcattggatggttgcagcattctgttgttttgcagaatctcgttgtcatatccagtcatcttcagcatttaatagagagctatctcagctcgtaa

SEQ ID NO: 23804 - DNA, 57 bp, Glycine max
  Peptide Sequence Number=SeqID_115489
atggctaaatttgaaatgcctgtaattgaacaattcactgaattgttcaaggattga

SEQ ID NO: 23805 - DNA, 693 bp, Glycine max
  Peptide Sequence Number=SeqID_115490
atgagcgatggcgatgtcaaggacatgaagatgaaaaagaaggtgaaggcggtggaaaatgacaacaacatggaggggcaagcgcattttgacaacaactttatgttcgaggtgttgaagcacgtggatgcgtggacactgacattggctgcagggagcaacaaccatgattcgtggtcctcatgctcggtggcttctgtcgcctctatgcgctttatctcttcccattctccaagccacaacaaacatcatcttcttcctccatattggctgagtctcatacttccaactccagaacgcgcacgtttcgttcgtggaaaagcatgtgacaagccccacttgaattttgcatcgagtgggggtgtaggagctggtgtcgtcgatggaaaccttctagtaggcgaggacccagaggtcaaagtgacaaaggaagtcacattggggttagggtcgcgcacaacacagactgcaccaagggtggtcgcaagcatttattggggtggcggcgcagttgcacgatcagtgatgcagggtggtggcgtaacgacggtggtggtcaaggacgtggggacatgggtgggtgcgtacacgaatttggtgggtcctccagggcgggtggtggtgggagtatgttatggaggagtttgtcgtggtggtgatgatgcacaaaaagaaagagagagattaggttag

SEQ ID NO: 23806 - DNA, 825 bp, Glycine max
  Peptide Sequence Number=SeqID_115491
atggacagtgtaagtcgagaggagcgtgcgtacttcgaaagaggagtaattacagttgattctgggaagcttgaacctgcaatcgcgagtatggttcagcgtggggagaaagaaacacacgatgtggtagaaggggaaagcggtggtggttggaggaagcgcaacccaatcggtggctttaaagcggtgtatgtcgtcatacacggtggctccgggtgggttccgggttcagctacggctaaccggcagggtggggtgatgggaatatctgcttcaaactacagaaattttaacgaccggaaggctatgattcctcccaaactagcaagaccgaaatatgaggtggtgtggaaaggcgatgtaaatggagaccagaaagaatccaaattcatatgtggaaaatggccaagggggctttgtttactaatgtgcaaaggttcaagaggaagctctgtgatgataataattgcacccagtgcaataatagcagtgaaagtattagccatgtttgtagagagtgcaaggtggcatgagcaatttggaatgtcatttcgagcaattctttgtctgttgaaggttgcagggagtattcacaacaatgcagctgaaggttggacgattatcattggcatgcaagtagcatgggagaggggcttcaaggatttgttcattgaatccgactcaaccacaataatttctcttatcaatgatgggtgttcatctgatcatgcttttaatcatgtggtagaagctataaaggattttgctaggaaagacgacattacgaatggagtcatatccttagagaagccagcatgtggttga

SEQ ID NO: 23807 - DNA, 108 bp, Glycine max
  Peptide Sequence Number=SeqID_115492
atgaaggagggtggtggtggtcttgggcttggtagagaaagcaaaatagaggtgcaggaagtaatgtcctatggttcggcatctcaagaatgtatgtgggctagttaa

SEQ ID NO: 23808 - DNA, 132 bp, Glycine max
  Peptide Sequence Number=SeqID_115493
atgactgatgctggccgggcagagctatccctgactaaactgaccagattgacaatggaaaagtccactcccaaagaatttgaatcaaaggttcctccgaaagacattcctaaggaggacaaaaaacattaa

SEQ ID NO: 23809 - DNA, 123 bp, Glycine max
  Peptide Sequence Number=SeqID_115494
atgaaagtgatgaagaaggggaaaagacactcacacagtggggaaaagaagaagaataagaggtacagagaacaaaaccttgatgttgagataattgttgccacgcagaacagtgaaggttaa

SEQ ID NO: 23810 - DNA, 1929 bp, Glycine max
  Peptide Sequence Number=SeqID_115495
atggatagacaagaaaatttgttagcattctccatgcctagccagctgttatcaattgacgaggaactatggcgaatggctgaagagagggcacaagagatactatggacaattgaaccaattgtattatctgaggtgaacagaaaagatgttattgattatgttcagaggctgatcagaggttactatggagcagaggtcttgccattcggttctgttcctctaaaaacctatcttcctgatggagatattgacttgactgctctcagtcatgaagatgcagaggaggatttggcacaagcagtatgcaatatacttcaaagtggagatgaccctgaatatcaagtccggcttgtgaaatgtacagtgaaaaacatagcagttgacatctctttcaatcagatggctggaatatgtactctacgctttttggagcagtcgacttcttggtggacaccatggcttgttatcaacatatgcggtagaaatattagtcttgtatattatcaatcgttttcattcatcagtgcgtggtcctctagagactactatggctcatttgattgggaccataactatgttagtatatggggtccaaaacccttatcatctcttccagaaattgctgagacaccagaatgtgatcagggtgaattcttgctccaaaaagagtttctcagaaattacaggaatatgtgctcttttccatcaagggcatctgagactatgacccatgaatttcccgttaagttcatgaacatcttggatcctctaagaaatgacaacaacctaggccgtagtgtaaacatagcaaacttacatcgagtaagatttgctctttcctacggtgctagaaggcttaagcagatcctcacacttccaggagaaaacatgggtgcagcactagagaagtttttcttcagcactttggacaggaatgggaaaggagaaagggcggatgttgccgttccggtttctccatttggtattggaagatctgaagagtctgtcctccgtggagattgtgaaagttactgtggtggcttacaatatgttcagttgtatcgtaattatgccatgccaatagctgtacattccagttctccatcgtcaccttctcaggatgatatccttgcaccatcaacgcagcaaaactggagtatgttttaccaaggcggtactgatgtatatatcccgggacagacactctatcatccaacttacaaccttgaaggaagagggaaatcacgaggaacgggcacatacatacctgacttgaattataattcctactgggatatgcacacaaagccatccaggccaaggagatttgcttcttcaaagtacaatgcattgcccaaatcaccttcgaaaaagcaacaagcagaagaggttcattctgtgacagacataaatgctaattcagattcaaggctgtttgagttctcaagtgaagattccccccttcttctatgcaattgcaaggctataccgccaacacaagcccaagagtctactccattagcaaagtttcattctgagacagacatggatgttacttcgcagctgcttgagttctcaaatgaagatttcccccttcttccaaaggtttattctgagacacacatggagggtaattcgaggtcgtttgagctctcaaagaaagatttcccccttcttcaaagcactcacaagactgccctgtcagagtctgctgctaagttaactaagcaagccaagagtttcccatcctctaaagagtctaaactgaaaaatattgagtttggaactttcaagaaatcacaatcattgatagaaccaagtttatcaacaaagggtgagagagaagattctggtgttccattatctcaagaaactgtgttggtggttccaaaggtggcagccgagaggaaagatgaatctccctag

SEQ ID NO: 23811 - DNA, 891 bp, Glycine max
  Peptide Sequence Number=SeqID_115496
atgcaaccctccaacaagaagaaacaccctcccacctcctcccccgccccgcgcctcctccccctcctcgccgccaccctcttcctcctcttcctcttccgccagacactccttcaccccaccgccgacctctgcttctcctcctcctccgccgttcccctctctccttccgaggccaccatcgccgccgagttcgactcctcgccgctcaccctcgtcaccatcctccactacgccacggcgcgtgcgctccctcagcagaccaagggcgagatccgaagatccttcgacgtactacaatccctcgcgccatgcaacttcctcgttttcggactcggccacgactcgctcatgtgggactcgttcaatccacgtggcaccacgctgtttctcgaggaggatcctaagtggaccctctctgcactccagcgttttcccatcctacgcgcccacattgtgcgttactccacgcgcctcgccgaggccaaggaactcctctcctcttataaagattattgtcccggtgtcagcaagaacaccactgaccacccactgaaaggtgatcggtggtgtaagctggcacttggcacgctgcccaatgaggtgtacaaccgtgattgggatgtgatcatgattgatggaccgcggggatattttgcggccgcgcctgggaggatggcggtgatatactccgccgcaatgatggcgcgtgggagaaagggatcgggtgtgacgcacgtgtttcttcatgacgtggacaggggtgttgagaaacagtatgcgaaggagttcttgtgcatgaaatatagggttgggggtattgggaagctttggcactttgttattccacctgttgttaatcctagtgatattgctcatggattttgctga

SEQ ID NO: 23812 - DNA, 657 bp, Glycine max
  Peptide Sequence Number=SeqID_115497
atggcgatggaagtggagcagaatcagaatcatcaattagggtttcccttctggaaaccgctccgtcgcaggttcggacccgaatctcctttcttcgctcatggcaacctcgaacgggaacttctcgccaaacagcttgctttggaattaacagaagagaaacaacagcttgagaaatggatgcaagaggaagaaggaagagtttacccgacatcttggttgctcagcatacatgtatctgaagtgcatgattctttctttcaggcaaaagttgcacgtggctatgatatgtacgaatgcttggtggaaaggtgtggattgaaattcaaaagctacaatagtaggcagcagcatctggttgacaagcataaattccccacctcatttgagtttttcaagaaggctaagccttcaaagaaacataggttgaagtcccaacgcaaacaagctgtttgtaaggaggattcttcaggaatgatggaagtggaaaatgcatccatggatgaccttgtttcagcagtctctaaattgaacacttctgactccaccccttcatcaatcagttttggtcgccgccacaaaggcttgtcatttgtccctcgagctgttcagcgtggaggtggatcaaactcaacagcatctgtgacaaagaaataa

SEQ ID NO: 23813 - DNA, 543 bp, Glycine max
  Peptide Sequence Number=SeqID_115498
atggttgaaggggaaattctagttgaaggtggtgcttgcatcaatattttacctgtaacaaacggaaattcgtcaaatactcatggcgtagttgcattggatgttacaattgaaagtcatcgacgactgattattttcatggccatttcatctcaagccaatttcaatatgcttttagggcacgagtggatgcagtttcgtctacaattatttttctggaacaaggaaagacatttaacattatcaagctattttgctcaaatgttgacgtatattgccgagaagatggttgtgactaatgtggctgagaaaatggaaaattctcgatcaacactcaccaacctagctctaaataaagtgagttatgttgctcaatttgcttcttctagtaggtcaatccaccctaccctgcttaaggtacaccatcgtggggttgtgggaggggaaagttggttggatgctaaaaaggatctagcaattgagatggtggcacctgcatatactttgatgttcaagtgtaagtcaaggaattacttggcctga

SEQ ID NO: 23814 - DNA, 2688 bp, Glycine max
  Peptide Sequence Number=SeqID_115499
atggtggacttttggacatctgttccttcttatgaattgaaaattaatggcatcccaagaacagttgtttcaacaagcaaaccagaggacctgatcatcttcttggactttagcattcctacaagaaactcaactgagcaagttctaaatgcactacatgttaactctggcatcttaactcctctccatggcagaagtaatggaacccgtggatttagttttaaactcaagaacatatcaagaactgagattatcacaattgaattacaagctacatccatacttggaaggacaggcactcctgtctctcctgttgctcctatcacattcctttatgatcccatgaaacccaatgtggtactaaggaccagctccctcactgaaacaagggatttcaacatcaacataattgctgagttcacaaagccagtatttggctttgtgacatcaatagtagacgtctcgggaggaagattgataaggcagggtaaaggaattatcaagagctttctacttgttgactgtcaaagcagtgacaaaggaggtgtcagttaccattcctgcagggaagattccaccccagcaatatccattgcactgcactcatttatcagtgccggaacaattgcaacatcactagtagctgctatggtttcactttcctcagcaaatttagaagcattaagcatacttgctttggaaggtgcaagcagtcctgcttccaatccatcaattaatctacatggaatgattggacacctacaagtctttgccctcacaagttggttttcaactaatcaatttatcaaatactctgagacaacaagaggtcttaggtggctaatacctcatcacaagcttccctggaaaaaaattgacacttggtcttcaatcttggaaagagagaaacttgcagggagaagtaatggcctgtctgcaggagaacattcttataacagagatcaacaacaaaatgacttaatgaacttgtcttatattgatcacaaactatcatttcaaaccaaaaataccactaaatttggtcggtttcacaatcagcatgatttaagtaagacaagtacattatatggtctacctctcaattccatcgaatatttcacttatttcttgagaggagaaccattgtctgctagcaatgtcatcaaaggaatggagagttataaagggtggcaggacatggagatgaacttattctggcttggtgtgggaggaagctgtttacttttacttcatgttttcgcgatattcttcctaagacataggatagggagaccacctcaaggcagtttatcagttcctaggtttgagctctttcttctgatcctcatgctaccttgtctttctcagtcatcaacatttataataaaaggtggtacaactgggggaattattactggggtgttgctactagcaatccctgtggcattcatcttatcatcattgctatttcttgttattgcaatctacactggaagctttgcgcaatacaaagaattcaacaaaataaccaatgaagaaaaatggtacaccaaattatggttctttttcattgggaggcctatgaatgggaagtggtttaacaaggaaggactaccttcctctttcctctcgcgctttggaattctctttgataattggaagggtcctccagtgctgattttaggtgatcaaaatgaacagaataataccataaccaagtggagcgaaagcgacaaaagtgggatccgaagaaccaaaacagcaagttcagaggacagcaatgaggaaaccaaaatctccacattcaagagggtatttggctgcataagagcatcctatatcatccttgacttactaagaaaagttggtttgggaataatatctgcagcttacccatcagaaaactcaaacaaaagcctttttgcattgataatcacattaatgcagttcatttttctgttcaccaccaaaccatacatcagtagaggtgtccatgttgtggaaagtgtttctctcttgtgtgaggcaggtgtgtttgttatcttaatcctccacaatggttcacactcagttgaatccaaaacttgggaattggtcatgctgcttcttctgatgtttacattcattgctcagattaccaatcaatggtatgctatggtaaattccctattgaatctctcacaatctcagaataaatctttaagggatggacttaagttagctgccaagggactcatcctgcctttccttccaagcaagcactggtccagcgtgatatcaacattctcccagaccgagacagacattctttcactgaatcctatatgctcaggaacagaatttgaaagacgaaacagaaatggatatatggatccaattagcgccatgacggctacagtggttccggtgcaaagtccaagtacacccagccacaatgttattgaaagaagagatcctagaacctggggggcaggtgcaagttcacatattgaagtggaaggtaaatggctaaaggggcacaacaaggctgggcttaaaaaagagctaaagatgttaagggagcttgcaaaagctagcttctctggggacacaagggttgatgaagccagtaccagctacactttaggggaacaacaacattcatcaggtgaaatctatttgggtaatccaaagcgaaggtattactga

SEQ ID NO: 23815 - DNA, 822 bp, Glycine max
  Peptide Sequence Number=SeqID_115500
atgcctgagaaaagttcgagtctttggaccactatggtttgtgggtacgctcagaatttctgctccaacgaggctttggatctgtttgaggatatggttggggagggctttgagcccagtggctccaccttggcgtcggtgttgtccgcatgtgcccggtcgggttgtctcgagctcggggaaaggattcatgagtttatgatggtgaaaggggttggacttggagatggagtgattctcgggaccgcgttggtttacttgtatgcgaagaatggggcgattgcgatggcgcgaaggttgttcgatgaaatgtcggagagaaatgttgttacttggaatgctatgatttgtgggttgggtgcttatgggtacgtggatgatgtgcttgatttgagggagtgggttgttgttcccaatggtgtcacctttgttggagttttgtcggcttgttgtcatgctggcttgattgatgttggttgtgagatttttcggtcgatgaagtcggtgtatggaattgagctgaagattcagcattatgggtgcttggttgatcttcatgggcgaggggctagcacgaatagtgggaatactgaggttgctgaaagagtggtgaaggaaattcttgctctggaacctcagaataatgttgttctttctgctttctctaatatgcagaggctggacactggcaggaaggagaaaaaggaatcgcatgaagatagtcctaatggaggctttaatcctttctccgtttctctgacgtttgggaactctatcggagcagtcggaggaaaaactggaggaatcttagggaaccgttag

SEQ ID NO: 23816 - DNA, 1023 bp, Glycine max
  Peptide Sequence Number=SeqID_115501
atggcttccacgcccttctccactttctgccacttccacaaacccaccctccttttcttagcttccgacgggttcaggctcggtggcgctccggcgatcgccttcggaaaggttcggaagaaccgcaaaatgggaatattccccgtttgcagagctggttctgccgtcgtcttccgcgacctcgacgccgacgactttcgccaccctcttgatcaacaggttggttgggcgattaagaatgaagagaaaggtcgcggggtggatcccctgaatacgctgctactgagagcaattccgggattgaacgaactgggaaaagctcttctagtgtttattgagaagtttagtcaaacagggccttacataagtgctttcaatcttcctgatctttaccacctaatggtcgaagctgccgaaatattaaatgtagatgcccctgatctatatgttcgtcaaagtcctgtgccaaatgcatatacattagctataagtggtaaacgacctttcgttgtcattcatactagccttgtggagctcctgacaaaagcagagttgcaggctgttttggctcatgagctgggtcacctaaaatgtgatcatggtgtgtggcttacatatgcaaatattctaacccttggagcctattctgtacctggtattggcggtatgatagctcagactttggaagagcagctgttccgctggcttcgagcagctgagttgacttgtgatcgtgcagctcttcttgttgctcaagaccctaaggttgtcatctctgtcctcatgaaattagctgggggatgtccatctatggctgatcaactaaatgtggatgcattcctggagcaagctcgctcttatgaaaaagctgcttccagcccaattgggtggtatataaggaatgcacaaacaaggcaactgtcacatcctctgcctgttctacgtgctagcgaaattgatgaatggtcaagaactccagcttataaatctcttttgaaacgaggaattcagatcaaatcttag

SEQ ID NO: 23817 - DNA, 1686 bp, Glycine max
  Peptide Sequence Number=SeqID_115502
atgaggcagcacaagcaagtgtcctccattaaccggcgacccaccgttctttatctggtgtgcgtcgcagcattgttttccctcctcctcttctacacccaatcctctttcttctcaggcgccgtgtcttcagattcttcaaggatagatgccgtctcttcagatcgcgattccgaaacaatccacgttttgtctaactttcagtccagtgtgaagcaatgtgtgattttcagcttagtaattagtgttacaaaggataacagggggcttggactcactgcacatgttattgaccattgcaaattaatccttaaataccctgaaggtaccaacagcacttggtacaatgcacagtttaagaaatttgagcctttggagtacaattatgatttgtgtgagacaatcctattgtgggaacagtatcgcaacatgactacggtgttgaccagagagtatcttgatgctcgccctggtggttgggtggattatgctccacaaaggatagcgcagttgggggcaaagaagtgcactaacaagacactttgtgaagagaacctcgatgtgttattacctgcaaagcccccatttcatccacggcagtttcgaacttgtgctgttgttgggaattctggggaccttctgaagactagatttgggaaagaaattgatagtcatgatgctgtttttcgagacaatgaggcccctgttaatgagaaatatgccaaatatgttggtcttaagagggatttccgtctagtagtaagaggtgctgctcgtaacatggtccccattctaaacgggtctgacaatgaggtactcataatcaaaagtctgacacatagagaaatcaatgcagttataaagactatacccaatccagtctatctcttccaaggaattgtactacgtcgaggtgccaaaggaactggaatgaaatctattgagttagcactctccatgtgtgatattattgatatatatggcttcactgttgatccaggatacactgaatggacaagatacttctctcagcctaggaagggacacaacccacttcaaggaagagcatactaccaactcctagaatgtcttggggtaattagaattcactctcccatgaggtctaagaggatggaagactggtcagatatacctagtagacaaatgataagccaagcacatgcagcagctttgcgcttaaaaaggagtcaagctggtcagggtggtgacttagggcagtttggcaattgtaaggtgtggggcaatgtcaatccagacaaaagtggacctgtctcgggatcaccagacatgagtgatgtcaggagatattcaaattatagtaaatgggaagtcatgccttttgagagtttgaggaaagaagcacgggatcattataaccagatgcaaggggtctctgtatataaaatggatggcaataagttggatgatctagtctgtgtgagacattccttaaaatccgaggtatactttccgagggcttcatggctcctcatccatcgttctgtctcatcacttattgcagagcacaacacgaatctcaactccaaggaaaatgaggtagtcaatatgcgtaatttcatcgatccatatgattcatattttaaagtgattcatgataacttgaatcaaagtaatttggatggacttggttttggggaagaataa

SEQ ID NO: 23818 - DNA, 615 bp, Glycine max
  Peptide Sequence Number=SeqID_115503
atggcgtgcacaatcgacttccgctgtctcgacgagggttttggcggcaaaacctacaagcgcaagagagagcagcagtcgcagcctcagcacgacgccgccgccgatgacgtcatcgacggcgcctctctgatggacaccgacgacgcactcccgccgccggcgaagcgatcggcgctgccatcgtcggagaacccggacaagccggcgttcggtcatccgagctacgacggcgtgatcgccgggagggtgtcggggcggaagtggaagcaagtgcggcagcggagggcgtcggcggcgcaggttagccggaaggggacgacgttcgagcagagggagagggagaaggtgataaagaaggcgtacaaggagaggatgatggagctgaaggaggagattcggttgaacaaggtcgagaagaggaagaagaaagaggagagggagaagaaaaagcaggagaatatcatcagatctggaaccaagttccaaaagattacaaaccctaatactttgaagaagatcgccaaatccaagcagaggaagcagcttagggttgttcctgatgaattgggccctaaggccaattggatgaatcttgttaggtacacattctaa

SEQ ID NO: 23819 - DNA, 99 bp, Glycine max
  Peptide Sequence Number=SeqID_115504
atgcatgaaaacggaacagtggttttgttcggagtggtggaagtgattttgagagtgagcgagaggtctctctgcctctggtgtgtagtgagtgagtaa

SEQ ID NO: 23820 - DNA, 234 bp, Glycine max
  Peptide Sequence Number=SeqID_115505
atgattgttgtcagtagtggtggcggtagcaacgacaaagatcatgttggtggtcatgatgatggtcatatggtggtgatcacatacggtggtggtagtggtgatgacgatcttaatagaactttaaatgtgactaagtctcaatcgagaattagtctcataaccatctgtctagactatcaaagtttgtggaaggaatactttaaggtatcactgagtagcctaaggatctaa

SEQ ID NO: 23821 - DNA, 96 bp, Glycine max
  Peptide Sequence Number=SeqID_115506
atgccaagaaagagacaaggaccacagattgatttagaagggaaaatattaagaatagaaatgtcccatgaggcaacaacgcctacatatatataa

SEQ ID NO: 23822 - DNA, 813 bp, Glycine max
  Peptide Sequence Number=SeqID_115507
atggctcagataatttttgggaataaatggagacatcttcttggagaaagagatttttgggaacacgttggtggaattgatgtatccttggcaccttctagttttggccaggcaaacacacgggcttttgatgccttgcttcggaggttacagaaatatgttccatatgaatcagatgttgctgatttgtatgctggagctggggtcattgggttgtcattagctgccacaagaaaatctattaaatgcatcgagattaacaaagagtcaaaggcatcttttgagaagaccattgaacggttacctgccaccgttgacagcagtattacttggcatcatgcagatgcttcaaaagagccctttttgtggcttttgggttcagatgttgtcgtcattgatcctcccaggaaaggactagatgcatctcttattgatgcattgaagaatatatcatcagtcgagcgtaaagccttttcatcttctggaagctcaaactcatcccaggaagagaagagaccttgggttttacgtgctaaagaagattcagtccaaattggaagcaaacctccaactaacatagctcaatcagtgccacaaacccttatttatataagttgcggatgggaaagttttaaagaggactgcaagtcattgttgtctagtaaggcatggtatttggaaaaagctcatggttttaatttctttcctggcacccagagcattgaagttctagcagtgttcaagaggggccctcagaaaaagaaacaaggaaagaaaaagaaaaaacacttgcaaggagctgtgagacattaa

SEQ ID NO: 23823 - DNA, 846 bp, Glycine max
  Peptide Sequence Number=SeqID_115508
atggcagaacaacatgtagttggtggaagccaaggttgggatgaatccacagacttcaattcttgggtttcaggccgaacatttatggttggcgatcaacgtgttttcaagtactcttctttgcatagtgtggttgaactaggcagtgagagtgagtacaagaattgtaatattggcaatgctgtgaactcaatgagcagtggcaatgatgtgaagatcacaacagtgtctagctctgggacctcttccccatcatcaccatcgttatcatcagcagcatcagcatcagcatcatcatcatctcttgtgttcattgctgcattgttgattgcctctatgcttaaccagttttggtctatgactatcttcttgaccccggcaacggatactacacttccacccccactctcagcgtcggtgcccgctgcaaaatcggcatcgccgtcaacctctccgacacatgcatgcaaagacatagcactcaatgatgatgacaaatgttttgtttcttttcatccccgtcgtcgctcccctccatctcattttcaccatagatctattcttccaacgccgtcaacaatggttgcaaccactcttcaaccacgtataaacctcgagtccttatttgattccaacgacaacaacaacctcgggttcatattcatagttgacggcaacaactacgggtttagattcatcatcgttgagtgttatgtctcaaatggaaaactccgccgtacactgtactgtcaaaaccttcctctccatttctctcctttgcatgtgtcggagaggtcaacggcgatgccgattttgcagtcggcgccaacagtgagggtggggtga

SEQ ID NO: 23824 - DNA, 129 bp, Glycine max
  Peptide Sequence Number=SeqID_115509
atgcgaatgagaagcgtttatgtcaacaaaagcattacccagaggaagcatagtagaagcagcaattccaaggagagaaacttgcctctgcttttaacgtgcgagggaagggctggaaagagtgagtaa

SEQ ID NO: 23825 - DNA, 936 bp, Glycine max
  Peptide Sequence Number=SeqID_115510
atgggtttgtgttcttctgtccaccgaaacgagcaaaccaacatgaagcatcatctaacactctcttttgagtccaaaactgaaagccttctgattccttcatcacccttcgaagacaaagagaaacccaaaaacggaaactttgtggttgttgctgatgatgatgcgtttaagcctcagcagtggtcaccctccaggtccaccaccaccttctcagtcaaagactgtggggataacgaacctatttctgcaaatatgctgtgtttgcctcttcagttccatgatgcttttttgttgcatatgcttgtgatgactacgatggattttagtcctgggtatgcagtctatggaatctttttacctttatttggtctctgtggggtcaatttcaagttatggaccacaacatgctggtcatttgaagatggcaaagaggaatcattttttgattcaaaggcctggttagactcagactgtgacgatgatttctatagtgtaaagggtgagtttaccccatctcgtggcagcactccagtgcaccacatttttctcaacaaaaccactccttctgagccttgttctgttccggaaccatctccaacaacacaaaagaaaaagctgttggatctttttcgcgaaagtgtcagagaaaaccaaagtgatgatgctgagaacactttcggcaacgaaaagaaagaagtgaaaccaacaatggtacatgatcttattcctaaatctgcacacagtactccttatgtctcgggaggaaattctgcatgtagcagtgaaagaacaatgaatgatgatcatgcaccgattagagagaaaccagttaaatctgttcagtgctgccttccaagcttggcttcttgtcgtagcttcagcgagaggaagaggaagacaagtcctgcaatagcagctaatggaacagcatga

SEQ ID NO: 23826 - DNA, 774 bp, Glycine max
  Peptide Sequence Number=SeqID_115511
atgaagatgttcggggtgtggaagaaagtgaagggattgaaggagaagttcctaactcaagctaggagagagactatattggaagcagtgttggctatttcatcctatgttatgggttgcttccatttactagtctttgtttgcaaccaaattgaggcattgaatgccatctttcaacaaggatcttctagggaagcaatggtggcggttgatcttgcaaccacatactcttatgtctcagcttttaaaggttgttacttccctggttcaaaagctctgaatgcgaagaaaaggtatgttccaagctacacctgggctaatatcttttgtgtgaaggagatggcgaacaaaggtagctttgaaatggttagtgatggcttaaaagatgttggtgttggtatgggcatgatccgtagagactcaaatggctacatccttggcttagctatcaacttcctccctcacaagatctcacctaagatggcagaggctctagcctcgaaacggactattcaaactgctagggagaggcgattttctcatttcattttggagacaaactatcttcagctagcacaggcatggaaaagtaaaagagctcttaacccaacctattttgatgatgtcttggaggactgtagatatgttagcagaggtgtagtcaatttcaaaattctttttgtgaaaagactaggcaataaagttgttgaatctcttgcaaagctagctcttgatactagggaaaagtattggttggatgacctactcacttag

SEQ ID NO: 23827 - DNA, 168 bp, Glycine max
  Peptide Sequence Number=SeqID_115512
atggatgaagagcagtggatgtatgatagtatgatgtctggagaaattgatatgaatgttgaaaatgaggaagatgttgacgtcaaagtagaacatgttgattgctcttatgcatttaatacttctcagttgtttgctagtcgtgatgaagttttagaatgggcttga

SEQ ID NO: 23828 - DNA, 264 bp, Glycine max
  Peptide Sequence Number=SeqID_115513
atggacacaaagaaaccaccggaaacaatatctgtcaatatgaccggagtgatgtgtgtttattcggcactgtgcatgaggtttgcttggatggtacgtccaagaaacccacatcttcttgtatgccatgtctccaatgagacagtgcaattgtatcaactctcaagatggttcagagctcaaaggcgatataatgtttgtaactatgggatatacaggggccttgagcagaacaaaaaggatgcagatgcagatgcagagtaa

SEQ ID NO: 23829 - DNA, 3360 bp, Glycine max
  Peptide Sequence Number=SeqID_115514
atggcgacatcagggttaggtgtagcggcgtgcaatggtgcaagtgttcggaggcagaagggtcacgtgggatcaaatttggcggtggaggcggtgcgcaatgtcgaaggagggtggcgggaatggtgcgcagcggaccttatcttcgccgcagcagccatgaaaggaaagaacaggagaagtggtggtgctatccatatggagtacctcattcacattcaggagattaagccttggcccccatcacagtctctcagatcacttcgttctgtgttgatacaatgggagaatggtgaacgctcttcggggtctaccggtgtagtttcaccttcgcttggtcctaattctgctgccggtgagggaaaactcgagtttaacgagtcgtttaggcttcctgtaactctgtcaagggatatgtctattcgaaatagtactgctgctgtgttccagaagaattgcttggagtttcacttgcatgaaactcgaagagataagaccactaaagggcagttactggggactgccatcatagacttggcagattgtggcgtgcttagagagaccttgagcattcgtacgccattgaactgccagaggaactacagaaacacagatcagccacttttgttcattcaaattgagcctgttgaaaagagctgccctaagtcctccttgaaggacagcttgtcaaaggaggtgacaaagggaaataatggcagtgaatctatatcagaattgatgaatggagagtatgctgaggaagctgagattgcctcatctactgatgatgatgtttcatctcattcatctgcggccgcagtcactacttcctctgagtctagcgcgtgtatgccccccgaacatgaagaggaaggaaactgttgggggcatgaattgagtgatttaggtggtagggaggttgcagcccctggggcagtgaatgcaccaaatggaccagctcaaaacagtggtaggaatgacaaggagcatgagcatcccttggcctcagagacaagagttgagaagttgaatgagatggaacaagatgcatatgagagactggagaggagttcatcctatgtgtcctccaaaattgggagtccagtaaatggtcatacctctattacaagtactccaaatcatagatcagcaacaaccccaaagcaggctgcttctttgaatgctgattcttcgtccccaatcttggaggaaaattctaagagcaggtccataagcagtgatgatgaaaatttggatcaggagggttgtgaaaaagtttccaatggtagaaatatgagtacaggtgttcaaataaacaatgacgaaagtgattttgacatctattctagcaacactacatctctagacagtaattacctcgtggacaagaatccaagctttggtttgggaaccaaagacaacttaagtgaaatgtttcattctgataagcaatatcatgtagaagatgaatcggtggcacaaggtgtgaaagatcaagttaatttgagtagcaattcatattctttaggtgggttagataatggtatgaaaggcaatgttctgaaaaatgaaagattaaagcatgtgaggtctgtaagatcatcagccgactcagttaggtctattgggtcacttggtaacaatcatctcgctgaggtaaaggaaaatggtgttaatggagatacccaaaataatggagggaacattagaagcagtgacagaaaagatgccaaggtttatccaagggaagccagaaatgccattttagatcgcaagattgagcacttggaaaacaagataaagatgcttgaaggagagttaagagaagctgctggtattgaggctgctttatattcagtagttgctgagcatggaagctccacgagtaaggttcatgccccagctcgacgcctttcgaggctgtaccttcatgcttgtaaagaaaatcttcaagcaagaagggctggggcagctaaaagtgctgtttcaggattagcccttgttgcaaaggcatgtggaaatgatgtcccaaggttaacattttggttgtctaattctattgtgctgagaacaattataagcaaaactaccaaaggcatgacaccatctaatccttctggatctagtacaagtaggaggaatggagaagggaatgacaaggtaacacaaccattactatggagggggttctctcatagaaaaactgaaaatacagcttttgaatatggaggtataggtaactgggatgacccaaatgtgttcacatcagcattggaaaaggttgaagcttggatcttctctcgcattgtggaatctatttggtggcagtctttgactccacatatgcagcttgctgatgcaaagatcactcataaggattcagcaaaaaactatacaaatatgtctagttcatgcgatcaagagtggggaaatttatcactagatatttggaagaatgcttttagagaagcctgtgaaaggctttgccctatccgagctggagggcacgagtgtggctgtttgtctgtgctacctaaattgataatggagcagtgtgtggctagattagatgttgctatgttcaatgccattcttcgggaatctgatgatgatattcctactgatcctgtatctgatcccattagtgatcccaaggttctccccattccacctggtcaatcaagctttggggctggtgcacagctaaaaactgcgattggtaactggtctagatggctgactggtctatttggtatggatgatgacgacccacttgaggatatagatgataatgaccttgatagcaatgatgaaagtcaaaataccttcaagtccttccatcttcttaatgctttaagcgacctcctgatgcttcctaaggatatgctcttaaatgcatccatcaggaaagaggtgtgtccaatgtttagtgcatcgctaatcaagaagattctagacaattttgtcccggatgagttttgccctgatccaattcccactgatgtttttgaagctctggactcacaggatgatcttgaggatgaaaatgagtctatcagcaacttcccctgcaatgcagctcccactgcatattcccctccaccagcagctaccattacaaacattactggggagtttggaagtgaatctcagctaagaagaagcaaatcttctgttgttaggaagtcatacaccagtgatgatgagctcgatgaactaaactatccattatcttccatattgaatattggctcatcctcatcagcatcaacaaactccaaccggaaggggaaagacagtcgcgatgaatctgccatcagatatgaactcctcagggatgtttggatgaacagtgaatga

SEQ ID NO: 23830 - DNA, 1824 bp, Glycine max
  Peptide Sequence Number=SeqID_115515
atgaaattgttcccttctttcctctgtattgagctgctgatgctaccacaaccacctttcaaaccagtatattacacattggttattattgacctttgtaaggctcttcctggagcctttcctgcagttgtagctggagctgttcgtactctctttgagaggattgctgatttggatatggagtgtcggacgcgtctgatcctttggttctcacaccatttatcaaacttccagttcatctggccatgggaagagtgggcttatgtcctagacctcccaaggtgggcccctcaacgtgtctttgttcaagaggttttggagagggaagttcgcttgtcatactgggacaaagttaagcagttgccttgcaaggcaacttacaaccagaatcatgcatcagtgaaaccttctctcgaccctatctgtttctgcaagcccccaaccataatcagagcagagaaggtagaaccctctgtgctgttctcttaccctcatgctttggtctgcctggcacagtggagcttacaacagagtagagagacagactggagcttgcagcagaggagagaagcttctcttctatcacatctaagtattgaaaatgcacctggtttagaagaattgcttcctccaaagggtgggccgaactttagttttggtgcagaagatgataaagaaagcaatgaacatgtactgtctggacagctcaacaacatggttaaaggaaaggcacctgtccgtgaaataatctcatggattgatgaaagtgtgcttccaaataatggtctagaagttaccctcagagtggttgtacaaactcttctcaatattggatccaagagtttcactcatttgatgactgtcttggagagatatgggcaagtctttgcaaaattatgtcctgaccaggataagcaagtcatgctgatagctgaagtgagttctttctggaagagtaatacccaaatgacagcaatagctattgacaggatgatgggttatcggcttgtttcaaatctggctattgtgagatgggtcttctcagcagagaatattgagcaatttcatatgtcagatcgtccttgggagattcttagaaatgcagtaagcaagacacacaatcgtatttctgatctaaggaaagaaatattatctcttaaaaagaatatttcatcatctgaagaagctgccaaggaagcaaaagcagagttagatgctgcagagtcaaaacttacactagtggatggtgaaccagttattggcgacaatcctgctaggttgaatagattgaaatcacatgctgaaaagacaaaggaggaggtggtgtctcttcaagaatctttagaagccaaggaagctcttctttcccgagcaattgaggaaaatgagacaattttgcttatcaaacatatgtttgaagtgctggcattgtttctcttgttgtacaaaagcttctcaaacgtgttgacagagcgccttcctgaaggatctagaacactgcatgagttgaagtctgcacaagttgatgtggtgatggcagtggaccctgaagagccatcgtcaatggaattagacaaccagaatcagagacctcaaaacagtcatacaaatggcgagaagaaaggtggtgcttataatgtaggtgaaaaggagcagtggtgtatcaccactttgggctatgtgaaggccttctctaggcagtatgctgctgagatatggccccatgttgagaagttggatgcagaggtattgacagaagatgcacctcttctttttcggtcagctgtttattctggtcttcgaagaccaattcacgaggcttga

SEQ ID NO: 23831 - DNA, 222 bp, Glycine max
  Peptide Sequence Number=SeqID_115516
atgaagacattaaccactactttggaaggaaagccagatcaagcagtacctcggtggattgaaccaaagatgtggtgcatattgagcgatggtttgaagaatgaatggaataagtggttttatgatggaacatcgttagacaaagaggccatgacaacacttttcaacaaatgggcaacatattttctccagattaaaaacatggaatttagaaaaatttag

SEQ ID NO: 23832 - DNA, 693 bp, Glycine max
  Peptide Sequence Number=SeqID_115517
ttggaactcttacgtgccgatcaacgtctcattttcgccaaaagttggcccagggcttcccgctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggaaaacattaatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 23833 - DNA, 519 bp, Glycine max
  Peptide Sequence Number=SeqID_115518
atggccccaaggaagcttgcctcaaagagatccaggaaggacaaagcggctgaaggaaccagttccgctcccgagtatgacaaccatcgttttaggagcgctgagcaccaacagcgttttgaggccattaaaggatggtcattccaccgggagagacgcttccagctcagggacgacgagtataccgacttccaggaagagatagttcgccagcggtgggcatcgctggttacccccatggccaagttcgacccagacatagtcttggaattttatgccaatgcttggcctatacaggagggcgtgcgagatatgcgatcttgggtgaggggtcagtggatcccattcgatgcggatgccctcagccagttcctgggataccctttagtgctggaggagggccaggagtgcgagtatggccagaggaggaaccaggccgatgggttcgatgaggaggccatcacccagttgctgtgtataccgggacaggattttgcccggaccgctgccgggagacgg

SEQ ID NO: 23834 - DNA, 60 bp, Glycine max
  Peptide Sequence Number=SeqID_115519
atgcctataggtggagctgatattgaggaggaggaactgacagatttgagggcaccctag

SEQ ID NO: 23835 - DNA, 636 bp, Glycine max
  Peptide Sequence Number=SeqID_115520
atggccccaaggaagcttgcctcaaagagatccagaaaagacaaggcggttgaaggaaccagttccgctcccgaatatgacagccatcgttttaggagcgctgagcaccaacagcgcttcgaggccatcaaaggatggtcattccttcgggaaagacgtgtccagctcagggacgacgagtatattgacttccaggaagagatagttcgccggcggtgggcatcgctggttacccccatggccaagttcgacccaaacgtagtcctcgagttttatgccaatgcttggcctacagaggagggtgtgcgagatatgcgatcttgggtgaggggtcagtggatccctttcgatgcggatgccctcagccagttcttgggataccctttagtgttggaggagggccaggagtgcgagtatggccagaggaggaaccaggccgatgggtttgatgaggaggccatcgcccagttactgtgtataccggggcaggattttgcccggactgctgctgggagacgggtgcggttcatgcgcaccaacatgaccaccctgacccagatctggatgaccttgctgctcagcaacatccagcccagcgatcataattccgacctccctctgccgaagtgtcagctg

SEQ ID NO: 23836 - DNA, 465 bp, Glycine max
  Peptide Sequence Number=SeqID_115521
atgtttgacaacccgattaacgctacttgcaggaggcacaacacaaagagaattagaaaatttttgcaggacttagaagcagcagcaactctaggagaagaacctcaatcttccgaggcgtcttctagctttcctattcccgagaaatctcatatagatttaattgaagaagttattatggctaaagagctaagaagagtgacccatgaagattactcaagttccattgtgccgcaatttttttccagtatagcgcgaccagaggttcaagcacaaacaatcacatatcctccttctctgatacaactgattcaaaataatttgtttcatggcctaccaaatgaagacccatacgcatacctagccacttacattgaaatatgcaatactattcgattggttggtgtgactaaagatgcaattcgattgagattgttttcattctcattgtctggagaatcctaa

SEQ ID NO: 23837 - DNA, 255 bp, Glycine max
  Peptide Sequence Number=SeqID_115522
atgtcaatccttaccctcggaagcaaaaaagaagagaaaggaaagtttccaatcaaaggaaaaaaggaagcaaggaaattcccaatcaaagagagggagaaagaaaaaagaaaagaaagaaaagtcccaaccaaagaatgggagaaagtaaagaaagaaaagaagaaagctcctggtcaaagaaaccagaagaaatgtgcagagaggtctttagaccggacaatatctgaacaatacaaaattgtcaccaaatga

SEQ ID NO: 23838 - DNA, 577 bp, Glycine max
  Peptide Sequence Number=SeqID_115523
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccctactcaatcaaggttatggtactactttgttccgatgctcagtccagggcaacacccgacctatactactagaactactatcggaagaccagcaccaagcttgtttatgaggtggttgctaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 23839 - DNA, 357 bp, Glycine max
  Peptide Sequence Number=SeqID_115524
atggacccttgggtactagtaccctcacctttagaggactatacatccttgtcatcagagggctgcacgccctcatcttcagaggactacacgtcctcgccttcagagggctgcacgccctcaccttctaaggactacatgtcctcgccatcagaaggactacagtcctcgccttcagaggactacacgtcctcgccatcagagggttgcacgccctcaccttcagagggttgcactgccctcaccttcagaggactacacgtcctcgccttcagaggactacacgtcctcgccatcagaggactacacgtcctcgccttcagaggactacatgtcctcgtcttcagaggactacac

SEQ ID NO: 23840 - DNA, 381 bp, Glycine max
  Peptide Sequence Number=SeqID_115525
atgacattgctacttagcacatttgcccagcgaccgcaatgccaatctccccctgcggaagtatcagttggtctgtgtcgtcccgacatggggatcgcacccacaaagacacccagtgaacctgaagaagtccaacagggccctggggtttccagctctggttacgggcctctatcagtcctacagggtgctcgtacccccccgacaaggtcacatcatcatagggatcacgcctcgcctgcaagacacgtcctcaccaccagagggctgcacgccctcacctccgaagaagtccctcgccttgagaggtcagctacacgccctcgccttggtcattctagttaccttcaccttccagaggactacacgtcctccctataa

SEQ ID NO: 23841 - DNA, 1002 bp, Glycine max
  misc_feature (25)..(25): n is a, c, g, or t
  Peptide Sequence Number=SeqID_115526
ctaaagagtccaagtgaggaagaanttgaagtccctgaggagggcgaagaagtgcaagccttgaaagtagagcttgaaagaatgagagtggtcaaggaaaagctaaagacgacagtcagcagagtcgggaaagacaatgaactcaagcttcgaaaggccgaaagggatgaatcaagggtggagagtatgatattagaggataagttgaaggcttgtcaaaggtggaagagaagtttgaccgaaaagttaagtaggatggaagaaagcatgttcacaatcattgaccagtataaagagaagctaaatctagctactagccatgggcagagactaaaggatgagtatgcgaaggtatcaaccctgcaagtcgaaagagaagcaagggagagggtcatagaatcattgcatgggaaagccatgaaatggatggatagattcgctctcactctgaatgggagtcaagagcttccaaggctgttagccagggccaaggaaaaggcggatgtatactcaactcccgaggaagctcatgggctttttgattatcgtcaacatatggaagtgcaagagcagatgaaggccgacatggaggccatgaaggaccaaatgaccttcatgatggaggccatgttgagtatgagaaggatgatggaggacaacacgaccgcagttgccaccaccagtgtcgctattgaggcggatctgactcacccatctagcataaaccaaacaagtcgtccagccccagacatggtaggtcaaggaggagaagtgttaggcagtatgggcggtccccatgcgaatgccaaccactccattcccgttctccttaagggccagcaaccccagttggaaaatgcaccatttgcccaacctatgggtgaagcccgtgaaaagcctcgggatcacgctctgggcgagtttgaacctcaccctacatatgtcgttgagggaccaacattttgtggcatgcctcaacccaatgccgcgagagccccttaa

SEQ ID NO: 23842 - DNA, 492 bp, Glycine max
  Peptide Sequence Number=SeqID_115527
atgactacaggatcatcggtctactctacctcaattcaccatttcgaactttatacagaaggtttttccgtaccagctccttctacctataccgctgttgaagcacctaaaggagaatttggtgtctttctggtcagtaatggaagcaatcgtccctaccgtcgtaaaataagagcacctggctctgcccattcacaaggactcgattctatgtccaaacatcacatgccagcagatgtggtcaccatcatagtggatgagatcggtcgagtggtctccgttggagatgggattgcacgtgtttatggattgaacgagattcaagctggggaaatggttgaatttgccagcggtgtgaaaggaatagcgttgaatcttgagaatgagaatgtcggaattgttgtctttggtagtgataccgctataaaagaaggagatcttgtcaaacgaactggatctattgtggatgttcccacaggggggatcctctag

SEQ ID NO: 23843 - DNA, 627 bp, Glycine max
  Peptide Sequence Number=SeqID_115528
atgagtcttcattcttcatctagtgttaatggtgagggttctactcctaaggaccccttgtataagatattagatgagttgagatcccttaagttgtggaaagaaaaacaagagagaaaagaaaaaggtaaaaaaagagtggaagaaataagtcaagataaaagagagaaaataagagaggaagaaagaagaaaaataatgaaagaaatgaaaagagaaaaacatgcctcctatagtagtcatgactcttgcaagagtttaagtgaagaacttagcgactattatagagggcgtcatagttcacatactaaacatcactcccaaagaagagaaaaggatagaaggcctcaagaggttaacattagcctcccatatttccacggaaaagataatgttgaggcctacttagattgggaaatgaaggttgaacaactctttgcttgccatcatattagcgaagagagaaaagttccattggctacccttagctttcaaggaatgatggattcatggggatcctccagtagagtaatgaccttaagagtgcccttaggaagaggcacattcccttctactatgaaagggagcttatggacaagctccaaaggcttagacaagggagtatga

SEQ ID NO: 23844 - DNA, 297 bp, Glycine max
  Peptide Sequence Number=SeqID_115529
atggaccctaagagaataaaggtcattcctgagtggcctactccaccatgtgttgaggaaagaatccccgagtttcaagaacctatggatttgaggtcaaatctttttcaagggggaaggaacatgatgaagagagagaggagatgccacttcaaggagaagatgagtctagaagaagctcaccactataggaggccatggataagagcttggaggaataaggagatgaatgaagggagaggaagagaagagcacgaaattttgtgctctaaaagagctctgaaatctgaagtttaa

SEQ ID NO: 23845 - DNA, 228 bp, Glycine max
  Peptide Sequence Number=SeqID_115530
atgaccataatttgtctctgcgtgcccttggacacgatcgagcctgggtggcaaggcatctctgcgtgccaccggacacgatcgcctctggatggcgaaaaggtgtgggaaatgaccataatttgtctccgctcacctctcgacttactgtccctgaatgacaaagggcgcataatgaccataatttgtctctgcatgtttatcactcgacttgcgaaatctgaatga

SEQ ID NO: 23846 - DNA, 546 bp, Glycine max
  Peptide Sequence Number=SeqID_115531
gctgcacgccctcacctccagaggactacatgtcctcgccttgagagggctacacgccctcaccttgggtactagttaccctcaccatcagaggactacacgtcctcgccttgagaggactacacgtcctcgccttgagaggactacacgtcctcgccttgagaggactacacgtcctcaccatcagagggctggacgccctcacctccagaggactacatgtcctcgccttgagagggctacacgtcctcaccttggagaactgcacgtcctcgtcaacggagggctgcacgccctcaccttgagaggactacacgtcctcgccatcagagggctgcacgccctcacctccagaggactacacatcctcgccttgagagggctgcacgcccttacctttagagggctacgtggtagcacccacaagacacccagtggactcggaggagcccaaaagggccctggggtttccaactctggttacgggcctctgtcagtcctacagggcgcccgtccccccagcaagttcatgccatcgtggcatag

SEQ ID NO: 23847 - DNA, 177 bp, Glycine max
  Peptide Sequence Number=SeqID_115532
atggaagcagatctcaagaagactctcaaattcttagatgctacaaatgcaaccaacttggaccagaaggcatacattgcatgggatgacaatgactcatccgatggttcagagaaggaaatcaaccttctaaccaaggactatgagagtgatgagaacatctctcaacaagattaa

SEQ ID NO: 23848 - DNA, 309 bp, Glycine max
  Peptide Sequence Number=SeqID_115533
atgcaaaagaaggacaaggaacttagaggcagtagtaacagatccatcggtggctgccacgggtggttgaaagcctacacacaagatctggattggctcccgaatttgagaaccactaagggggtggaggatgaagctccggaagaggacgaaaaggtccaagaggagcatgtctcagcggttaggcgagaccgagaccaacatgttagccatcgtcagcaagtaccaagaagaattaaatctagccacggcccacgagcacaaagtgccggacgaatatgcccgagtgtacgcggaaaaggaggctag

SEQ ID NO: 23849 - DNA, 612 bp, Glycine max
  Peptide Sequence Number=SeqID_115534
atggcccagaagaagagtactccaatcactcctgccacatccagaagaagcaaggttgctatcccctccaagaagaggaaagaaatttccttttcctcatccgattctgatgatgatgtcgaaccagatgtctcgacatcctatagaggccaagaaatcttgttggagaaagaggaaagtgtgtttttaccagcattctcctccttgctgaaatttacgaaatatcgcagaacgctactgcttttccatggagcctcaccaaaagaaacttccgcttctggttcacccgctgtaccatcatctccgcaccaggaacaaccagaattcaacatccaacccatacaagtaattcctggtcaagcttctgtccctgagaaactggttcccagaagacaacagggagtgaagattgctgaaaaccctagccttgcaacaagtcctagggaagtagacacggagatggacaagaaaatccgcagtatggtgagtagcattttgaaagaagcctctgtgcctgaagctgatgaagatgttccaacatcttccaccccgaatgtttctatgcctgatgttgagaaagatgttccaacatcttccgggcccaatgctgaa

SEQ ID NO: 23850 - DNA, 1224 bp, Glycine max
  Peptide Sequence Number=SeqID_115535
atggggacaaatcaaaacggcaaaaggttttatcaagtcaaggttaaaggtctagatgtcactagcctcaaggaattgggacgattgatgggacccctccaaaggcaagccttccgcaaagtttacgggaagattctagatttgaccgtagcggaggtatttacggaagccgtcgtatccctcgcccaatactacgaccagccgttgaggtgtttcacgtttggggacttccaaatggtgccaactattgaggagtttgaagagatattaggatgccctctcggggggagaaaaccgtatcttttctccggctttcttccttccttgagcaaggttgcggctgtgattgaagattcagcaaaagagttggatcgcataaagcaaattcggaacggcgtagtgggtctgcctcggaaatacttggaagacaggcagggatatggcgagccagagagtgggcccgtttgcggatgttttagctttgctgatttttgggttgtcctctttccgaacgttgatggcttggtagacttagccgccattgatgctttcctcgcatatcaccatagcaaggaaagtccagtggtggctatcttggcagatttgttcgacacctttgaccggaggtgcgagaaaaacagcgcacgaattgtctgttgtttacccgctctctgtgtatggctgatttcacacctgttccgacaagacacgagacacctgtgtccgcttcaaagctatcgctcgtgcaccgaaaaaggaagagtcgtttgggaccaacatttggctgggatagggggcagcacgattgattggtttcctcgttggaaggaaggcaaggaaggagttcttttctcgtgtggggactatcctaatgttccactgatagggactaggggttgtattaattataatcccgcactcgccataagacagctagggtatcccatgaggggagcgccaaccgaagaaagtctctcgcctttccttgtgagggatctaggcgcgcaaggtctcaaggttatacaaagaatccacaaggcgtggaggagtccattgaggaaagacaaggagcttaggggcatccgaaacggcgtcattggaggttatcatgggtggctaagaattcacacgcggggcttaggttggctctccaaattgaaagttgtcgatgaggagaaattcgaagctccggaggaagatgaagaagtccgagctctaaagtag

SEQ ID NO: 23851 - DNA, 663 bp, Glycine max
  Peptide Sequence Number=SeqID_115536
tggcttctgtttctatcagctgtccctcctgttcagctactgacggggtggtgcgtaacggcaaaagcaccgccggacatcagcgctggcaagtgtagcggtcacgctgcgcgtaaccaccacaccgccgcgcttaatgcgccgctacagggcgcgtcccattcgccattcaggctgcgcaactgttgggaagggcgatcggtgcgggcctcttcgctattacgccagctggcgaaagggggatgtgctgcaaggcgattaagttggtataatgggtgtctgtggaagggtggaaggctgaggctggagaaggccaaagaagactatcttgtgcgtttgaagagagaatgggaacaaggcgctctagatgatgctactcaaaaaccacctgctgctgctattgaggaggaaattcccagcaccgcacactcttccgagtcaaataccaaacacctcaatattttctttcccagattgagaaaggcaaggcatcaagcttatcgataccgtcgacctcgagggggggcccggtaccagcttttgttccctttagtgagggttaatttcgagcttggcgtaatcatggtcatagctgtttcctgtgtgaaattgttatccgctcacaattccacacaacatacgagccggaagcataaagtgtaa

SEQ ID NO: 23852 - DNA, 512 bp, Glycine max
  Peptide Sequence Number=SeqID_115537
atggtggaaaaccttcgcgaaatcgcccacggaaacgtctctgaagcgttacggaagcgcctcagcttggatgggaaaagaaggaggtggttgccgcccagctcgcccaggcgagctgggttgcttccaccagaaggcaccgccttctgttggaacatcctggaaggcccaagtgggcatgattgctatttgcaaaccctttgtttactaaatacacccccctctaccctttttttatggttcttttttcgtaacgttacggaactttatgaattacgtaacgatacttgttttctttccgtcatgtcacgaaaccttacggattacacaatcgttccctctttggcttcaggaatgctacggaactttacggattgcgcattaacgctttcttttgactctcgacatgccgcggaatttcacggattgcctaaggatggatgtcaagtacctcgaaatggccaagcgaaagttgcatcccaccaaacagatggttcgcagacgaaattatg

SEQ ID NO: 23853 - DNA, 170 bp, Glycine max
  Peptide Sequence Number=SeqID_115538
gatactgggctgccttgcagcgacgttctccgctggcccagcgtcgggaaggggtgacgattggtcggtcgtggccctatcctccatttgcctccacccctaagtacctgcaagtaggagacaaacaatacatggacaatcgtgaccggtcatcgtcttaccttggttga

SEQ ID NO: 23854 - DNA, 423 bp, Glycine max
  Peptide Sequence Number=SeqID_115539
atgtcggctctgaaagaacaaatggcctccatgatggaggccatgttaagtatgaagcagctcatagagaagaacgcggccaccgccgccgctgccagttcggctgtcgaagtagacccgactctcttagcaactacgcaccatcctccctcaaacataataggacggggaagggacacactggggcacgatggcagccctcacctgggatacaaccgagcggcttacccttatgggaatagtgccgccaacttccagttgcgaagggaagaaagagaccagtcgcggcacatgatggttctgaaagaggagttcaattgccttgttcgagaagtccataaagaagcttgtctcagcgtttatgcgaacggagaccaacatgctagttctatccatcgcaagtaccagaagagttgggtctag

SEQ ID NO: 23855 - DNA, 570 bp, Glycine max
  Peptide Sequence Number=SeqID_115540
atgaaaggactacatgtcctcgccttgagaggactacacgtcctcaccatcagagggctgcacgccctcacctccagaggactacatgtccttgccttgagagggctacacgccctcaccttgggtactagttaccctcctcagaggactacatcctcaccatcagaggactgcatgtcctcaccttcagaaggctacacgccctcgccttcagaggattgcatgtcctcactttcagggctactagttaccctcaccgtcagaggactatacgtcctcgccttgaaggactacacgtcctcaccatcagagggttgcatccctcacctccagaggactacatgtcctcgccttgagagggctacacgccctcaccttggggcctacacgccctcaccttgggtactagttaccctcactgtcagaggactacgcgtcctcaccttgagaggactacacgtcctcgccatcagaaggctgcacgccctcacctttagaggagctacacgccctcgccatcagagggctgcacgccctcaccgtccagaggactacacctcctcgccttga

SEQ ID NO: 23856 - DNA, 207 bp, Glycine max
  Peptide Sequence Number=SeqID_115541
atgaccacagattcacctccactccttatgttcccatggacccggtccccagtggagtcgccaactgtcgcaacctacccttcgacgggagggcgacgtggggctcacgggtgcatcttccaagggaggaaggcgcacggaatcgccaccaacgtttatttgaggaaaacttcggaaaaaccagaacatgtggtctatgaacgttaa

SEQ ID NO: 23857 - DNA, 589 bp, Glycine max
  Peptide Sequence Number=SeqID_115542
gtccaagtagggaagaagctgaagtccccgaggaaagcgaagaggtgcaagcactaaaagtagagcttgaaagaacaaaagtggtcaaggaaaagcataagacaacagtcactagggtcaggaaaaaaaacaagttccgaggggctctatggggcagcaacaacgagctcaagcttcgaagggccgaaagggatgagtcaagggtggaaggcatgatattagaggacaagttgaaagcttgtcaaaggtcaaagagaagtttgacccaacatctgagtaggatggaagaaaatacattggcaattattgaccagtataaagagaagctaaacctagttgctagtcatgagcagagactagaggatgagcatgcaagggtatcggctccgcaaatggaaagggaagcgagagagagggtgatagaaccattgcatggggaagctgtgaaatggaaggatagattttccctcactttgaatgggagtcaagagcttccaaggctgttagccagagccaaggccatggcggatgtatacccatctcccaaggaagttcatgggcttctcgattattgccaacatatggtcga

SEQ ID NO: 23858 - DNA, 370 bp, Glycine max
  Peptide Sequence Number=SeqID_115543
atggagatgacactagtgagggctaacattgaagaggacaccaaagcagtgcatgatggcttcaccaacaagatttctttccagcaccatgaccagaaaattattcataaacctctatcccttagagaagaaattaaagatgtctttcccaaggagattcctcatggactgccaccttcaagaagatcaagcttatcgataccgtcgacctcgagggggggcccggtaccagcttttgttccctttagtgaggtcgggaaacctgtcgtgccagctgcattaatgaatcggccaacgcgcggggagaggcggtttgcgtattgggcgctagcggagtgtatactggcttactatgttggcactgatgagg

SEQ ID NO: 23859 - DNA, 245 bp, Glycine max
  Peptide Sequence Number=SeqID_115544
atggctaagtttgaccctgagatagtcctggagttctatgctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 23860 - DNA, 326 bp, Glycine max
  Peptide Sequence Number=SeqID_115545
gatcagaagaaaatttcaagttgcttgttcgccttagtccgatggtgcaaaaatcttgctatgttgaacgacacaatggagttatcccccacaagaaacaaatttattacagcatggacgctaataagaggagttatgcacctaggcaacagcaacaacaaacagtaaatgtagggtatgcaatcagcttattgggcttttctcaaaagacgtactacaaaatagtgttggagacctatgtagtgatttgtggagccatgaacaacgatgatcacgctgcaacacggttatgtgagacggaagtcaccatcaaggaagagatagag

SEQ ID NO: 23861 - DNA, 624 bp, Glycine max
  Peptide Sequence Number=SeqID_115546
atgggtattgctgtttctgagcatcaaattgccaaggaaatcactgccaaacaagtccagcattggccaaagaaagggaagctgtctgcagggaagctaagtgtgaaatatgcaatcctgcacaggattggagctgcaaactgggtacccactaatcatacatccactgttgccacagaatcatttgctgtcaaattacccattgccttcccaactgtattgtgtggcattttgttgagtcaacaccccaatattttaaactacactgactctgtgatgaagagagaatctcctctatccctgcattacaaattgtttgaggggacacatgtcccagacattgtctcgacatcagggaaagatgcttcaggtgctgtgtccaaggatgccttgattgttgaactcaaggacacatgcaaggtgctggaagcaaccatcaaagccaccacagagaagaagatggagctagaacggctgatcaaaaggctctcagaaagtggcattgatgatggtgaagcagccgaggaagaagaagcagctgaggaagaagaagaagaagccgatgacgaagatgcagcagaggatacagaatccgatgatgatgattctgaagccaccccatga

SEQ ID NO: 23862 - DNA, 440 bp, Glycine max
  Peptide Sequence Number=SeqID_115547
agggccgcacgcctcgcttcagaggactagacgtcctcgccttcagaggactacccgtcctcgccatcagagggttgcacgtctcgccttcagagggctacacgccctcaccttcaaagggctgcatgccctctcccttaagagggctacacaccctcaccatcagaggactacacgacctcgccttcgtagggctacacgtcctcacctttagaggactacacgtcctcgccttcatagagctgcatgccctcaccttcgtagggctacacgccctcaccttcagagggctacatgccctcgccttcagagggctacacatcctcgccttcagaggactacacgtcctcacctttagagggccacacgcccttgccttcagagggccacacgccttcgccttcagaggactacacgtccttgtggcgtccctaaattaa

SEQ ID NO: 23863 - DNA, 357 bp, Glycine max
  Peptide Sequence Number=SeqID_115548
catttcatttctaaacgaccatttagaggaaacactgggtccaacaaagataggaaaaaatcactcaaagtgtatcaatctcacacagtgcgtggcgagaaagtcgctagcgcacaggattttggttggcaatcaaagggagagggccactttgggtcgtggtttcctttctttactgttcagatattgtctgggcaaggattgacattctcaccctgggtcaaggtttatggtaagttaggattctggctcaaggcttgtagaacggctggtcatgatatatgtcagggtttggccagcggttcggggatgaaggggatgtcccacatttattcccatgatacacatgcacaatga

SEQ ID NO: 23864 - DNA, 372 bp, Glycine max
  Peptide Sequence Number=SeqID_115549
agacaggtccagggtgatgcaccacaggccacggacgcgccgccacctcatcaggctggtccagcaggatcgtttgatacggagcagtatttgcggcatttggttcaccagcaggcggccaaccactgggcacatgtacagacccatgattgtcgttatcagatgagtctcagcctgcagagccagggctttacttcttttccgtgccctactccggaccagtacagggcagaggtcgcatggcctggagattggcctgaggcccaggcaggagaggcaccagcagaggctcccgacgaggcagatgaggcccgcgaggacgaggagatcaccgatttactggatttcttaggagggagcggggccacatga

SEQ ID NO: 23865 - DNA, 420 bp, Glycine max
  Peptide Sequence Number=SeqID_115550
atgtatcaagttggtctgtgccgtcatgacataggtaaggatcgcgcccacaagacgcccagtggacccgaagaagtccaacagggccctggggtttccagctctggttacgggcctctgtcagtcatacagggtgcccattccccctgcaaggaatcgctctcacaaagacacccagtggacccggagaagtccaacagggctctggggtttccagctctgggatcgtgcctgcaagacacccagtggacccgaagaagtccaacagggtcttggagttgtcaagctctaattacgggtctctgtcagttctacggagtacctgtcacctccagcaagggcatcaggccccctactaatcgagctttcatcaagaagtactgcgtctccaggcaggcgcagggcgaaacaccacagtag

SEQ ID NO: 23866 - DNA, 489 bp, Glycine max
  Peptide Sequence Number=SeqID_115551
atgggtgatcaagaggagacacaggaacatatgaaagccaacatgtcggctctgaaagaacagatggcctccatgatggaggccatattaggaatgaggcagctcatggagaagaacgcggccaccgctgtcgctgtcagttcggctgccgaagcagacccaactctcttggcaactgcgcaccatcctccctcaaaaatagtaggacggggaagggacacactggggcacgatggcagctctcacctgggatacaaccgagcggcttacccttatggattgccgcccaactactcaccacccgtcttgcaagacgatgcgggccatattgcttctcccgtccttgaaagagagcctcctcaacagtccgaagaagtccacaaagaccctcaagactatgctcgaagggatgtcaagttctatcccccgatccctgaagggccggcacccagcacgctgcctcagcccaacatcgcaacacaaccaata

SEQ ID NO: 23867 - DNA, 414 bp, Glycine max
  Peptide Sequence Number=SeqID_115552
atggcgaaaggtgcacggaagaacataatttgtctccgcatatcatcgggctcgccgcctctgcatgacaaaaggtgcagaaggtccataatttgtctctacgtgacatcagactcgatcatctcaggatggcgaaaaggtgtgcggatgaccataatttgtctccacatgtcatcggggatgccgcctctggatgacaaaaggttcgaaatgaccataaattgtctctgtgtgcggattaccataatttgtctccgcatgtcatcaggctcgccgcctccggatgacaaaatgtgcagaatgaccataatttgtctctgcgtgcctccggactcgatcgtctctagatgggataaaggtgtgcgaaaccatattttatctccgcatgtcatcgggcatgtcacctctacatga

SEQ ID NO: 23868 - DNA, 456 bp, Glycine max
  Peptide Sequence Number=SeqID_115553
atggctaagtttgaccctgagatagtcctagagttttatgctaatgcttggcccatagaggagagagtgcgagacatgcgttcatgggtgaggggtcagtggattccctttgaggcagatgccctcagccagttcctgggtgacccgctagttttggaggaaggccagcaatgtgagttcagccagaggaggaacagggccgacgggttcgacgaggaggccattgcccagctgttatgcacaccgaggcaggtgcggatcatgcgtaccaacatgaccactttgacccagacgtggatgacgctgctgctaagcaatgtcttgcctagagatcataactctgatctccctctacctaagtgccagttggtgtatgccatcctgacactgatgagcgtcccacgtggcccaggtatgccacaactaggcacccttctggaccaggataaggtctaa

SEQ ID NO: 23869 - DNA, 420 bp, Glycine max
  Peptide Sequence Number=SeqID_115554
gcacttgctagcattgccacacctcttgggcttgagtttattcctcaagtaaagaagttgttggatgagggtttggttcgcaagagcttaaatccttgtgctttgttggtgcccaaaataggtattattaggcaccaagtccctaaaataggtggtatgatgaatgttttgagtggtgcaaccctcttttgtaaaatcactcgtacacctaacatcttcatggttgatcaaggggttcccatgaatcctaagagaataaaggtcattcctgagtggcccactccaccaagtataagaaaaatttggggcatccatgacttaacaaacttttacaaaagcacactcattgagttggtgaggaactatgtgtccttcatggaaagatgcccggaaagggtttcagaccttaccttactctaa

SEQ ID NO: 23870 - DNA, 804 bp, Glycine max
  Peptide Sequence Number=SeqID_115555
atgggatcaagtcaaaagcatcctcttaaaaagaggttcaatcaagtcaaaatcaagagcttagaggtcactagtttacgagagttggggcaattaatgggtcaacttcaacggcaagccttccgcaaagcctatggtaaggtttgggacctagctagggtagaagtctccatggaaccgattgcatccctttcccagtattatgaccagcccctaaggtgcttcacatttgaggacttccagctagtgccgactatgaaagagtttgaagaaatcctgggatgcccactgggaggaaggaagccatatcttttctctgggttctatccctccacgacaagagttgccaagtaccaaggaagtgttggaggaaagggcaaaggccttggaaaatcaagcgaatggctttcttttattgacatcttggcgtttttatctttggagttgtcctctttccgaatatggaagggtagtggactagcagcgatggacgctttcctcgctttcatcatggcaaggaaagcccggtcgtcgccattttggccatgtatgacacgttcgaccggggatgtgaaaagagcaacgcaagaattgtttgttgtgcactggctctctatgtgtggctggtttcacaccttttttctccaagaaggtaggcccgtctattcgctacaaggagtcaagaacttccccattgctagccaaggccaaagcagtggcgaacacctactccgcccccgaggagatccacggacttctcagctattttcagcatatgatagacttaatggaccatatgattag

SEQ ID NO: 23871 - DNA, 588 bp, Glycine max
  Peptide Sequence Number=SeqID_115556
atggagtttggtgatatacctgttcattttaatattctggatgctatgaaatacccatctgaagatctttctgtatttcgtgctgaaataattgaccatgttgttgatgaatacatgactgatctttattctaatctgcatgcctctcactcttcatgcattgagtctgaaattgtacttgatcatatgtctgaatttgatgctgagagtgaatctgagagtgatattgattgcatgcctggtggtggtgttttacctcttgagattgattttatagagtcagataggactaaccatgtttcagaaaaaagcagcacatccctcctcttccattccctccagagcagtttccaacaaaaaaatgaggcagagaaagattgttgtcagaaaagcataagaggctataggctggaccctggcggacattcgctgcatgaagaaggcagaaatgtctccaagcttgattgcaagcggaaatttgtccccccaaggattcatgaaaaatgtaaagatccaggtcccttgcagtcaactgatgtggtaattcatttagctaatagaagtgtttcctatcctgtggtttcatag

SEQ ID NO: 23872 - DNA, 411 bp, Glycine max
  Peptide Sequence Number=SeqID_115557
atggcgaaatcaccatcccagatgagtttcttatcaaggacgctcaagatcctatccaggcaattgttcaagcaacatatccagatttatttaataactatagcaacgaagatttcttgcaaaaaaaaagatgttgtagcctctacgaaacatgttgttgacaaaataaatgactatgccctatctttgattcctagtgaggaaaaagaatattgtagtgctgatagtattgataaatctgatgaactactcaatcctgctttcggagtactaacacctgaatttctaaactcattgaaaacatcaggaatacctaatcacaagctcaaaatcaaggttggtactcccatcatactactatggaatttggacaatgttgatgggttatgcaacagaactaggcttatgtga

SEQ ID NO: 23873 - DNA, 381 bp, Glycine max
  Peptide Sequence Number=SeqID_115558
atggttgggttccattccgtatactttatttggatgggaattggcgcaaatatccgtgcttttaacccaaaccttttgcagggctcgagcgtgcaacttgtatggtctggagaacgcttacttggatcttatagtttaggatctgctcaaggacctacaggtttaggtaaatatctaatgctccccgaggagaagttctaccacgtggaaacgctctttaatggaactttagctttaactggtcgtgaccaggaaactaccggtttcgcttggtgggccgggaatgcccgacttatcaatttatccggcaaactactaggagcccatgtagcccatgctggattaatagtatttctgggccggagcaatgaacctttttga

SEQ ID NO: 23874 - DNA, 336 bp, Glycine max
  Peptide Sequence Number=SeqID_115559
atgatggaacagatatttatcaatcttgcagtagcagacgtgaataagtcaatggatttttacacacaattgggttttaagaataatcctcagttttcggatgaacaggaaaaacctcttgcagatacaaaaaagcagatcgcaggactattttcgctttcagtttccagtcttgaccgtgtaaatgaaattgttgagaagggacttaaagcaggaggcatagagccatcgcctatgaaggactatggttttatgcagcaaaggaatattgaagatcatgatggacatacctgggaaatattttatatggatatgagcaaattaccaaacgcgtaa

SEQ ID NO: 23875 - DNA, 309 bp, Glycine max
  Peptide Sequence Number=SeqID_115560
atgtgctcgcgactggtccctctcttcccttcgcagcttgagttcattgttgctactccacagagctccgcaaaatttgttacggccatactcttccttgcgagccctcttggtctcttgttcaagggctcgtggtccctctcttccttccggatgtgtgtagcggccaccttgaacttctccttggcaatcttcgcctttcctaactcgcttttgagagcttggacctcttcgtcctcttccggtgcttcaaaactctcttcgctgacgacttttaacttggcgagccaatctaaacctcgtatatga

SEQ ID NO: 23876 - DNA, 150 bp, Glycine max
  Peptide Sequence Number=SeqID_115561
atggagaaaatgaagaaacaacaatggaagagaagcttctatggaggctggatctttgagcttcaattaggtcctttaatggtggttttccaccatggagatgcagcagaagacaaaggagaagaggtgagaggaggcgccatccactag

SEQ ID NO: 23877 - DNA, 795 bp, Glycine max
  Peptide Sequence Number=SeqID_115562
atgcgcgctacagggcgcgtcccattcgccattcaggctgcgcaactgttgggaagggcgatcggtgcgggcctcttcgctattacgccagctggcgaaagggggatgtgctgcaaggcgattaagttgggtaacgccaggggcgaattggagctccaccgcggtggcggccgctctagaactagtggatcccccgggctgcaggaattcgatgtccgccttcacgacggacagcaccgcctgtatctctgctcgcccagtgcagagatcctcgcctttacgacgccagcagtagcaatattcaaaccagtgtcaaaaggtcgtgctatggtccaccgcaccccagtccagcacgatgagggcgatgagtctgatgatttgccacaaaggcggtgcaagaagtctacgacggacgacccaccgcccagcctttctggaacagacgttgcctctcggatcaggcctattatttacagtttcgaacgatacgagctagcaagggtgcccgcagcccttggtgtcgcagacgcaacccaactttcattcctcttcctttgccttggaatgtcctttggaacggggatgaaaggtgcaggctgggtcacagcccgggaagcgatcaggactgcagggactggcgattacactacatttcggaatgcggttgctggtgcgatcggaaatcgccaagcgtacgtagcagccaacgcagcatctcgattatcaagcttatcgataccgtcgacctcgagggggggcccggtaccagcttttgttccctttagtgagggttaa

SEQ ID NO: 23878 - DNA, 147 bp, Glycine max
  Peptide Sequence Number=SeqID_115563
atggtgatagaaatctctcaaagaacaacactcaaccttaccaaatgtgtatgggtttgcatttacagtcaagcaccacatgtaagggtggatatgagaaggatatttaggctaaaactaagggaaaagaggggcaatgaggagtaa

SEQ ID NO: 23879 - DNA, 316 bp, Glycine max
  Peptide Sequence Number=SeqID_115564
atgcaaagactattgagagagaacaacgaggagttgtatgaaagaattgagcgattagagaatcgtgaacgtcatgaggaagaaaggagaggaggaaatggtggtggtccaaggccaaaccgaattgaaggagtcaagctcaacattcctccctttaaaggcaaaagtgatccggaggcatatttggagtgggagctcaagatagagcatatcttctcatgtgtttccatcaagtgttccaagccagcttataggagcaaccctcaagagaccaaggaaatccaaagacaagtggaagactcattggtagggatgg

SEQ ID NO: 23880 - DNA, 258 bp, Glycine max
  Peptide Sequence Number=SeqID_115565
atgttgaagactgaagaaccgccgaagaacgaacgaagaaccgatgaaaaacggtggaaaatcttccacgaaattgctcaccggaaacatcctgggaaagcgttatggaatgaatccctaaaaaagagggaggtggttgccgcccagctcgcccaggcgagctgggttacttcccttgctcctacgtattcctcaagggtaaggaatacctatgtagccttctttgagaacccctggaaggtccaagtggctggttag

SEQ ID NO: 23881 - DNA, 162 bp, Glycine max
  Peptide Sequence Number=SeqID_115566
ttgagcttagctcatcagtgggctaagcgtgcatccaccgctaagcgcaactacagcgtgcttagcgcgacagaagaatctggccaggcatcaatatcaagatcgcgcgctaagcgcgagatcagtgtgctaagcgcagtagttgtcttcagccaggcttag

SEQ ID NO: 23882 - DNA, 312 bp, Glycine max
  Peptide Sequence Number=SeqID_115567
atgggcccttctagaggtttctgggcattttcttgcttaaggtggaagcaacctagctcgcccaggcgagctagcaattttgaaattttgaattgggccttccagaatatttttcgatgctggattgcttatggaggaagcaacccagctttcctgggcgagctgggcggcaacctcctccccctttttcctataaataggctgaaggaggctgttctaaggatccctgagccccctggctatgtatttcagctgttgtgggtgaaaaaaataatttccgtgaagaaaatccaagccgaggtgcttccgtaa

SEQ ID NO: 23883 - DNA, 378 bp, Glycine max
  Peptide Sequence Number=SeqID_115568
atgttggggaatggttacgagcccggaatgggtttaggcaaggacaacggtggcataaccagcctgataagcgctaaaggaaaccgtcggaagtttgggttaggctataaacccacacaagcggacataaagaaaggcattacaggaaggaagagcggaggtcaaggctcgcgattgggacaagaagtcaaaggaggcccgccctgccacatcagtaggagctttataagcacgggtctaggacacgaaggccaagtcgttggatatgtgaagatgattcgccaagtgggtcggagttggtatgaccatgccctcctggtttccgacaaggaaattggcgagtggaggaatgcccggacatttacgcaacaagcataa

SEQ ID NO: 23884 - DNA, 90 bp, Glycine max
  Peptide Sequence Number=SeqID_115569
atggcttctatggatacctctgctaaggtcaactctaagatctttccaacctcttgccggtttgatttgttcccatgcttgctaaagtga

SEQ ID NO: 23885 - DNA, 286 bp, Glycine max
  Peptide Sequence Number=SeqID_115570
atcatggatacgatcattgtctactagaccacctagtgctgagagaccagtggtccatgttgatccagctaccggcaaggccgacagtccccacagaaagaaattaagaacatatttggggattgtggcgcatgataaggtggacatcacctacgagaactggaaggaggcccctactgctaagaaggacctgatttgggaggatattcaggcagaatttgatatcctagaggcttctgacagtaggacgaaaagggaagttacctcagaccgtggcaagagatag

SEQ ID NO: 23886 - DNA, 2088 bp, Glycine max
  Peptide Sequence Number=SeqID_115571
ctggagcaccattcgcattcgctgatgtcgatgtcgttggagcgcacgtagtaggtggtcttcaggccttcgcgccaggcgctcaggtgcagctccagcagcgtgctggcgcggatcgtgctcggcacatacaggttgaagctgatcgactggtcgacatggcgctggcggcgcgcgttctggcgcacgctggcgaactggtcgaccttgtaggcacccttctcgtagtacggccaggtttccagcgacaggcccggagccgccaccggccgccggaagtccttcttttcctcgtagtagaacgcgctgtagatcgggtcgatcgacgcggtggaaccggcaatctgcgcggtgctcatgttcggcgcgacggccagcagccagccgttgcgcaggccgtgcgtggcgacctcgcgggccaggctgtcccacgcggcgccgctgtagtcgcggtcacggaagtaacgcccgttgtgccagtcgctgcccgcgaacatcgggtagctgcccttctccttcgccagctgcgcgctggcctggatggtcaggaagttgatgcgctcgtagagacggtggtgccaaccgaacgtgcccaggccgatggcgcggtacttgcggttggtgatggtggcctgcggcaccggcagcgcgttgaggtcaatcacgttgtcgagcatgcgcacctggatcgggatcaggcgctccagcacgtcggtggccagcaggtcatccggcgcactgattgcccggccgaggttgatcgaggacaggttgcagaccacgaagtcaccggcgcggcgcgtggtgacgatctggtcgccgctgacgatctcctggatcatccgcgtcgggctcatgttctgcaggatctcggtgcacaggttgctggaatagatcatgcccgcgtgcttgttcgggttccggcggttgacctcgtcgcggtagaacaggaacggattgccggtctccaactggctgagcatgatccgcttgaacagatcgatcgccttcaccgtgcggcggctgatgcgctcgtcggccaccagttcggcatagcggtcgcggaagctgcccgcaccgcgcgtctcatcgtagaagtcctgcaggtaccagcccttggcctgcttcacctcgtgcgggtcgaacaggtaccagtcggcgcggcgctcgaccgcttccatgaacaggcgctggtcgccgttgttgaggcgcaggtccatgaacgcttcgatgtcgcggtgccagatgtccaggtacaccgccaccgcgcccttgcgctggccaagctgatcaaccgacaccgcggtgttgttgagctgcttgatccacggcaccacgccaccggaggaattggccacgccccggatcggcgcgccgctgctgcgcacatagcccaggctgtcgtccaccgtgtcgatgaagcagctggacagctgcccacccaccttgccggcattggccagggtcggtgtgtcgacggtcatgtacaggttggacagcgcccagtacgcctcgccgaccagctgcatgcgccgctcgcgcggcttttcttcctgcatgaggtacaggccgttgtaggcgaacaggcggtcgcgctccgggtcgatcatctcgccggcctgctgcagctcttccttcgaatagcagcgcaggatgtcgttgctgtagatgccgcggtcagccaggctttcctgcaggccaacgtaggagccgtacttcaggccgacatcgtagaagcggttgcggctggcacgcttgtacaggcggcgcaggtagatgcgcgcggcaaactgttcccactcgggtgcaaccaggtccacccgcgattcggcctcacggatcagcagatcgaccaggtcgtcggcgctgatgctcggtttgcgctcgaccatcgcctgcaccacgcggcgatagtcgctcacgtccagctgcgggaactcggcatgcacggcgtcgatgctgcgctgcaggcgctcggcctcgaacggcaggcggcggttgccggcctccttggtgatccaggtcggcacgcgctcgccaccggcgcgcaaggtgtcgccggcgccggccagatcggccacgcggaag

SEQ ID NO: 23887 - DNA, 339 bp, Glycine max
  Peptide Sequence Number=SeqID_115572
atgacgggaaggcgtgctcgttttgaatttgcacatcatgggggccgcccgtacttcctaaatctttgcctaccatatttgaggttggatgattcattgcttgaggccggatggggacgtcgggttcaccttagcaacaacgctggtagcggcaattgcaaccgcattggcttccattatcttcttcacgctcatcatggcctccatcattgtggccattttctctttaatgtcctccatgtcggccttcatcttggggtgggggtgtcctctacttcacccattactctagctctagcacaagttcggaaagaatgcaacgagcaatgcaaccaatga

SEQ ID NO: 23888 - DNA, 309 bp, Glycine max
  Peptide Sequence Number=SeqID_115573
atggcattcttgggagagacaagcagtcagacagttgtgaactccacattaggttttatttttccaaatggatccattgttcacaacgatagtggtgtttcctttcaagcttccactctagttcccattcgagtacctaatgggtgtgattttcaaacgttaaaaaccagaatacacaatacccttaagctaaccaacaagcaatttttggatgaaatttactaccagcagcctttcacgtatgcagctcaccgaacctgtctcaggaaaatgacgatctcggactcatttaccgttggatcatcgtga

SEQ ID NO: 23889 - DNA, 829 bp, Glycine max
  Peptide Sequence Number=SeqID_115574
atggctccgaaaaagctttctgcaaaaagatctaggagggacaccgcggctgaaggaaccagtgccgctcccgagtttgatagccaccatttcaggagcgtcgagcatcagcagcgtttcgaggccatcaaagaatggttgttccaccgagagagacgcgtccaactcagggacgatgagtacacggattttcaggaagagatagctcaccgacgttggacgttgctggtcactcccatggctaagtttgacccagatatagtcctggagttttatgctaatgcttggcccacagaagagggagtgcgggacatgcggtcatgggtgaggggtcagtggattccctttgacgcagacgccctcaaccagttcagggccgacgggttcgacgaggaagccattacccagctattatgcgtaccgggtcaggatttcgcctggaccgctgcagggaggcgggtgcggatcatgcgcagcagcatgaccaccttgacccagatgtggatgacattgctgctcagcaatgtcctgcctagtgatcataactccaaccttcctctgccgaagtttcagctggtgtatgccatcctgacacggatgaacgtccatgtggctcagttgattgctaacgccatttatttatttgcaggtatgccacccaccaggcaccgtttagacccggataagtctaacagggccctggggtttccagcattgatcacgggcctctgccagtcattcggggttcccgtcacaccttgtaaggtgatccgaccatcggtcaccctagccttcattgagaagtattgcatgcctaggcaggcgcagg

SEQ ID NO: 23890 - DNA, 450 bp, Glycine max
  Peptide Sequence Number=SeqID_115575
atgatactcctcacaatgggaatagtagccctcaattatccaagtcatgacatggtaccttggtcacgcctgcgctatgacaatctgaaaagatgttggttgtatgggccatgggtgctggcagcttcacgctcaacatttcacgcgttaacggctctgtcgcaatcaacactggcatcgttcagggctcaattacgcagaccgtgttatccagtcgcaatttttggggtttctaaggttctcttgccgagggagattctcgggagaaatccgatagtttctgctaagcctcttgataatgctcctccaccggatgatgacgctttgtcaccagagaattcatcgggatttgatggacaaccctcacagctatcgtccccgccaggctttcgcgaagatgtgaggtctcatgctggtggttccattttctgctgtggggttttgttttaa

SEQ ID NO: 23891 - DNA, 474 bp, Glycine max
  Peptide Sequence Number=SeqID_115576
atggcttctccacctgcctcgcctccccttcctcctcctccttctcctcctcctcatcctccttcttctgatgcatcagtttcaccatctaccgtgaagcggacacgcaaagcctcattggtcaatgttgatcctgctactagcaaggtcgacggtccccacaggaagaaattaagaacatatttggggattgtggcgcgtgataaggttgacgtgatgtacgagaactggaaggaggtccctactgctcagaaggacttgatttgggaggatattcaggcggaatttgaaatcccaaaggcttctgaaagtaggacgaagaagaagttacttaagactgttgccgatcagaacagtgtagacgacactgtctatgagaaatacaacataagcaaggaaaaatgggcccagttttgccacactcgtagagacccttcttgggaggatgtgcagaaaaaggcacgggccatctag

SEQ ID NO: 23892 - DNA, 639 bp, Glycine max
  Peptide Sequence Number=SeqID_115577
atgagtcatcattcatctagtgttaatggcgagggtactagtcataaggaccctctatctagaatcttagatgagttgagttccctcaagttatggaaagaaaaactagaaagaaaagaaaaaggaaaagagagggtaaaaataaatcaagatgagagggaacaaataagcgaagaagaaagaaggaaaatactaaaagagttaagaaaagaaaaacatgcctcctatagtagtcataacccttgcaagagcctaagtgaagaacttcgtgactattatgaaggaaggcataggtcacatcttagacctcactcccataggagagaaaaggaaagaaagcctcaagaggctaacattaacctcccatacttccatgggaaggacaatgtaaaggctaacttagattgggaaataagggtagaacaacaacttaaaaggaagtctacttcaaaatcttatggctctcactcttatccaaagaaagaccaaggtcaaggcatcttaggggtgacaccttctaagcccaaagatgataaggggaacacaatagaaaagcaaccccttaaggatagtatgcaagagaagactagctccatgaagtgctttaaatgtcttggaagaggacatgttacttcttaa

SEQ ID NO: 23893 - DNA, 372 bp, Glycine max
  Peptide Sequence Number=SeqID_115578
gagtttgttgaaatggatgatttgcttcacaaagcaatccaagtggagcaacaattaaaaaggaagggagtggataagagaagttttaccaactttggttcttctagttggaaagacaaaggtaagaaagatagggctgctacttctagtagttccacacctatcccatcaaaaactcgctcaaagtcccaagaggaaccctctaaatggagtagagatggttcatatcaccaacccagtgatgaggacacaaccaagggcaaggaccatgaagcacttgaagggcccaagaccagaggcagacttaaacaggcccaacaagtcatagagacaaggctggtcatttgtatagctgccattgatgatgattga

SEQ ID NO: 23894 - DNA, 345 bp, Glycine max
  Peptide Sequence Number=SeqID_115579
atgacgtgcgaccattctttggtcctcgtgaggtgcttggcacccatcattaggcaattggtgaaattccaggacatgccgaaaaaccaaaaaaatattgatgcacaatcccacccaggcccacttgggccctctggaatattcctccagaaggcggttgcttctggaggaagcaaccctgctcgcctgggcgagctgagctcgcctgggcgagctgggcggcaaccacctccctattttgctataaataggggaggagtgcaagaaggaagaggttcagcccctgaggcacttttctctctttcgaatttgcttggaaaaattgtttccgtgaagaaaatctaa

SEQ ID NO: 23895 - DNA, 549 bp, Glycine max
  Peptide Sequence Number=SeqID_115580
tgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggggtgtaaatatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccg

SEQ ID NO: 23896 - DNA, 138 bp, Glycine max
  Peptide Sequence Number=SeqID_115581
atggccaggaaaagggttttcaatccttaccgtgttgaggaaagaattaatgagtttcaagaacctctagatttgaggtcaaatccttttcaagggggagggaatgatgcaatcctaccccccaagggcattggatag

SEQ ID NO: 23897 - DNA, 294 bp, Glycine max
  Peptide Sequence Number=SeqID_115582
atggactcgggaaggttccaagttagtgtaccaggtaatagctacccacacgagggtttttacttgttgtggaatgcaagaggtgtagctgggggtgatactgagggccttccgaagtgttttcaaggggtataccaccaactacttgccctccagtggcatatccgagccaagactcgaagtcggctagattgtggtggggaatttcacgtgtctcttccacggtttaagagacatgtgcatgatcagtttggggttgctggctctcaatgggtacaggagtggagttattga

SEQ ID NO: 23898 - DNA, 282 bp, Glycine max
  Peptide Sequence Number=SeqID_115583
atatatatatcagggtgttacagcattgaccttgttggatgtcccttgtgtgggaaaatagagtggttaaagagtttaaacatcttcgaggggatgtttaggatctttaattcatccatggtctttgtacttgatggtgctcacgttcatacgttgtatgttgtgtatgttcatgggggggaggtgcgtcacttggtagggaactcccttgtggcccaagctgatcaccgaagggggggagttacggtgcacgactgggtgaccttgacaattactacatag

SEQ ID NO: 23899 - DNA, 228 bp, Glycine max
  Peptide Sequence Number=SeqID_115584
atgacttccaagattattttgatgatgccaaagaatcaagagttaagcaagttccaaagaaccaggcttcaacaatcaagtctcaaagaatcaagattcaagattcaagaacaatcaggatcaagattcaagactcaagagaagttgatttcaagattcaagagaagaaatcaagaagcaatagacaagatttcacaagggaagtatttttcaaaaatccaaacataa

SEQ ID NO: 23900 - DNA, 390 bp, Glycine max
  Peptide Sequence Number=SeqID_115585
atgcaaacaacaacaccaaaccgagtagaaagacccgatagaaagactagctcgcgtctccttactaactatatagactgcaactcaagcactaactgcatcacttcttctccgagagaagactactgcgactctggtggttatgcaacaacactggctaccgaacagagattatgcgatattccttgttggaagtatacccactattctcttcttccctcctcccccctctattccgtcgtctctcctggtgtgccaagctaccgatacaccgccgcaagaagcatgggtaacagcagcagaaggaagacacaacaacgccgccatcatcatgttactactatactatataatatcactctcgcggaacgcacaaacaaaggcatctag

SEQ ID NO: 23901 - DNA, 434 bp, Glycine max
  Peptide Sequence Number=SeqID_115586
tgtatgaaaatgatgaagacaaccgacatgacgtcggactagaagatgaggaggaggtggattcgaaggtacagaatgacgatgatggaggagagtttcaacatcagatagaaggatacaacgagaaaaaaaagaaagcaggacataggaagatgtccgcatctgatattatgcaagttgaaaactatagaaaagttggcattagacctccgcacatgtatgcaacatttaccaatcaatgtggtggatatgacaaggtcgggtttatcaggaaaaatatgtacaatgaagtagggcgcatgaggaagcaacatacttcagatgcaaggggtgcattgaaatatttatatgatttacgcaagaaagatccaatgatgtatgtttcctacaccgtggatggagggtcaaagactacaacggttgttttggtgtga

SEQ ID NO: 23902 - DNA, 164 bp, Glycine max
  Peptide Sequence Number=SeqID_115587
atgaccagcaggatattggcaaacagttcatgggactccttaaagaggtcgcgcaaatctgcattatccaaaccgccaaatacttccagcccaaaccatttcaggccatatttgctgtacaaggtcatgagtacaccactcaaagggatcgctaccatcagcag

SEQ ID NO: 23903 - DNA, 207 bp, Glycine max
  Peptide Sequence Number=SeqID_115588
atggaccctaagagaataaaggtcattcctgagtggcctactccaccaagtataagggaaatttggggcttcaatatcttaccaaacttttacaaaaggtgtaggaaaaaagggatccatgagtttcaagaacctctggatttgaggtcaaatccttttcaagggggagggaatgatgcaatcctaccccctaagggcattggatag

SEQ ID NO: 23904 - DNA, 234 bp, Glycine max
  Peptide Sequence Number=SeqID_115589
atgccttccaagagggtacatctacttggggattgttatactgagaacaagagagggtacatctcttatggatcagttcaagtggagggtacatccacttggtttttcaaagagaacaaggaagggtacatcccttgtggatttttggcttgtaaaggattttacaaggttgaaaagaaatatcaagaaccgcaggttgcttggggactggatgtaggcacggtttatggttga

SEQ ID NO: 23905 - DNA, 369 bp, Glycine max
  Peptide Sequence Number=SeqID_115590
atgtcgtcacgcatgcattgtacgttggtctcgtcttttgtcataggaagccagaagcatacgtattcccgagtctttcatctctatgaaatattatcgagtattggcaatcaaaattgccattccttgggttatggggttgaaccaagctcatgcttttacgaaaaggttcatcaagtcaagttgaagcatggaagtagccatcaaccgaaattggggcaaaagatggatcgggttacatcgctgcttcgtctagtgccaaacacatttaggactgttgatgtccttgttacttccagtttcaccttgacaaaggtgtcacagaccatgttgaaaatcaaaattgattcaatctcatgtcctgcataa

SEQ ID NO: 23906 - DNA, 810 bp, Glycine max
  Peptide Sequence Number=SeqID_115591
atgggtcaacttcaacggcaagccttcccaaagcctatggacttccaactagtgccgactgtgaaagagtttgaagaaatcctgggatgcccactgggaggaaggaagccatatcttttctctgggttctatccctccacgacaagagttgccaagtaccaaggaagtgtttggaggaaagggcaaaggccttggcaaatcaaggcgaatgggctttcttttagtgacatcttggcgcttttgatctttggagttgtcctctttccgaatatggaagggttagtggacctagcagtgattgacgctttcctcgcctttcatcatggcaaggaaagcccggtcgtcgccattttgaccatgcccgtctatccgctacaaggtcaccgctcgtgcatcgaaaaaggaaaggcgaattgggaccgactcttggctagcatggaggggcgtctgttaattggttccctcgctagaaggaaggaagaatcaggattctatcttcatgcgaaggatgtcccatcagaggagtgccatcagatgaaagcatcacgcctttcatcgcacggggtttcagtgaccacaatgcgagggtactccaaggagttcgcaaggcatgagatgcggcgtgaagaaaggacagagagcttaggggaagcagtacaagccctaaaggcagagcttgaaagagcccgggtagtcgaagagaagttcaagtccatagccatcaaactgaagccttggaacgaagaggtgaaaggaatcatcacgggtcaaaggcatgatcttgaaggacgagctaacggcttgccttag

SEQ ID NO: 23907 - DNA, 1011 bp, Glycine max
  Peptide Sequence Number=SeqID_115592
atgaaactttctcgtctggtcgtgatgaccgccatcgcactcggctccgcgccggcctgggccgccgacgcggtggtgactgtctactccgccgatggtctgcacgctggcgatcacagctggtatcaaacccagttcgacgccttcactcaggcaaccggcatcaaggtgcaatacgtcgaaggcggttccggcgccatcgtagagcggctgtcgaaagagcgcagcaacccgcaggccgacgtgcttgtgacgccgccgccgttcatccagcgcgccgccgcggaaaaactgctgcaggatttcaccccgcaggatgcggcgcagatcgccgacgctcagccgcagttcgtgccgctggtaaacaactacctgagcttcatctataacgccaaactgttgccgcaggcgcccgccagctatcaacagctgctggacgcgcagttccgcaacaagctgcagtactccacgccgggccaggccggtgacggcaccgcagtattgctgcaggcgtttcacagcttcggtagcaaggacgccggtttcgactacctcggcaagctgcaaagcaacaacgtcggcccttccgcttccaccggcaagctgaccgcgctggtcaataaaggcgagctgttggtggccaacggcgatctgcagatgaacctggcgcagatgcgcagcaacccgaacgtgcaggtgttctggccggccgggccggacggcaagcgcagcacgctggcgctgccttactatgtcggcctggtgcaaggcgcgccgcaaagcgccaacggcaaaaagctgatcgacttcctgctgagcaaagaagcgcagagcagcgttagcgccatgtcctacggcatgccggtgcgtaaggacgtcatcccgaacgacgataacttcaagcggtcgcaggcggcgctggaaggcgtggacatctgggcgccggactggaatcaggtggtaagcagcctgtccgccgatatctcacgctggcacaaggtgaccgaatga

SEQ ID NO: 23908 - DNA, 576 bp, Glycine max
  Peptide Sequence Number=SeqID_115593
gctctggtgagtctcgaaggatgcaacattggctgtcaccctatcaatctctccaacttggatggaacatggcgcctccagtacacttcttcctctgatgttctcattcttctccaagctgttgctacttttcctttctttcaagttggacagatctttcaaaaatttgaatgttgtcatcaatctaatggaggtgttatccgctatgttgttcgatggagcattccaaatttgttagagcgagttggtgccaagtcctatcacgaatctgttctagacgttatcagtgtccctcaccaccatgatctcactctcaaattacatcaggttgtcgacattgatgcaattttcccaagcacaaccaacgaagttaaggtcatgatttatgcagatggaggccaatttgagaagcattgggcaattgagaagcttcgagatatgggatctaagtttagaactatgagaagatggccagaaatggtgggtctttcaatggcaatagtggatggagggcgattgactgttgatggcatagtcgagaaagataaaacaaaccacaagcagaaatatggatga

SEQ ID NO: 23909 - DNA, 796 bp, Glycine max
  Peptide Sequence Number=SeqID_115594
ttggcccagggcttcccggtatcaacagggacaccaggatttatttattctgcgaaagtgatcttccgtcacagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgatgtctactgggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 23910 - DNA, 60 bp, Glycine max
  Peptide Sequence Number=SeqID_115595
atgagtcaagtatacctaagtaaggaagatcgtgctcagggaagagggatagatttgagg

SEQ ID NO: 23911 - DNA, 69 bp, Glycine max
  Peptide Sequence Number=SeqID_115596
atggacgagaagcctagcacatgggaagcttccttgagaagcgaggaaggtagcttccttgggaagtaa

SEQ ID NO: 23912 - DNA, 197 bp, Glycine max
  Peptide Sequence Number=SeqID_115597
tggaactctcaagcgggttgcttggggactggacgtaggcacaagggtgtggccgaaccagccttgaatcttcttcatcaatggagtcctttgcttcttgaagataaatggaagcagaatggagaaggaggaaaggtaggagaagatgagtggagggagagggagagaaggggcacgaaatttatgcctcaaatgag

SEQ ID NO: 23913 - DNA, 856 bp, Glycine max
  Peptide Sequence Number=SeqID_115598
atgcctcctaaggtgtctagttcctccggcagaggaggaagatccagtacaaaaggtaaagaagttctactggctctaccagagccaataaccaaaaaggcaactacaacatcttctgggtcacctacccagactgggtcatcgacccataaaggaaaacttgaagggtcattgacccagacaactaccatcaaatctgagtcatcaactcaggaatctccaaaaccaacaacaagcaaacagactgtggctgactatgcctggtcaatacaaactctcttggccttagaagatataggcctcaccaaaataccaaaattagcaaaaaagacctgggcagaaatggcctcagaatcagacgatgattctgaaacagatctacaaaaacaaatccaaaaagccaaacagaccaaaatcgtctgtaaccaaaaaccaagccaatcattgactaaacaagaatcaacaccacaacccggtaacagttacatttcaaaaaacaaatttttcaatgttttacaaatggaaccagaatactgggacaagaatcctttcaaagcaaccgccaaagcattccccccgggattccattacaagccaatagccacaaacaaaacccgcaaattctacgaattcatcctaatagatacaaactcagtatctattaaacacttcaaagaccccaaagatccaaatctaaatacccattccacaatccaaatcttgaaggtgatgcagccacggcattatggctcaaacttaaaccaacccaaaaaattctctgcaccatttgaccctgcaggatataattattgggattacattgacgcctggaccaatgtgttctggcatcaaaata

SEQ ID NO: 23914 - DNA, 939 bp, Glycine max
  Peptide Sequence Number=SeqID_115599
atgggattaagtcaaaagccttcgtttaaaaagaggttctatcaagtcaaaatcaagagcttagaggtcaccagtttacgaaagttggggcaattaatgggtcaacttcaacggcaagccttctgcaaagcctatggtaagatttgggacctagctagggtagaagtctccacagagtccattgctccctgcccagtatatgatcatccgttgaggtgcttcacttttggggacttccaactatcactcatggtggaagaattcgaagaaatcctaggatgtcctctagggggaaggaaaccatacctcttctcagggttctatccctcattagctagaatttctaaaatattccaaatcttggcgaaggaattagaccaccaaaagcaagtcgaaaatggggtggtcgggataccgagaaaatgtttggaggcaaaagcaagaatcttggcaggtagaaacgaatgggccccgttcatagacgttctcgcactattgatctttggaggagtcctcttttcgaatgtggatgggttggtggacctggcagcgattgacgcttttctcgcctatcataaccacaaggaaagcccggttgtcgctatgctagccgacctatatgacacgttcgaccggggatgtgaaaagagcagcgcaagaaatgtttgttgtgcactggctctctatgtgtggttagtttcacacctttttctccaagaaggtaggcccgtctatccgctacaaggtcaccgctcgtgcgtcgaaaaaggaaaggcgaattgggaccaactcttggctagcatggaggggcgtctgttaattggttccctcgctagaaggaaggaagaattaggattgtatcttcatgcgaaggatgtccaaatgttccctggatgggaacatggggttgtattaattataatcctgtgctcgccataa

SEQ ID NO: 23915 - DNA, 238 bp, Glycine max
  Peptide Sequence Number=SeqID_115600
tgatcttccgtcacagtggcttctgtttctatcagctgtccctccctgttcagctactgacggggtggtgcgtaacggcaaaagcaccgccggacatcagcgctggcaagctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 23916 - DNA, 222 bp, Glycine max
  Peptide Sequence Number=SeqID_115601
atgtggctccgcatgccaccggtctcttgggacacggtaaacaaaaagtggggtggtcgacaaaagcagggctttttagctcccgttatgcctcaatttgtgatgaggaactcactactgttgggaattctgacaactacaggaaacactgcatacatcaagatggagaaaatcacttcaaagtgtacaatcctcacattccaggacgacgttcctaaatga

SEQ ID NO: 23917 - DNA, 205 bp, Glycine max
  Peptide Sequence Number=SeqID_115602
agtattttcgaagcaggattgcttctggaggaagaaaatcaggtcgcctgggcgagctgagcggcaacctcctccccattttcctataaataggcagaagggggttgttctaagggtccctgattcccctggctatgcatttcagctgttttgggtaaaaaaaattgtttccatgaagaaaatcccagccgaggagctgccgtaa

SEQ ID NO: 23918 - DNA, 803 bp, Glycine max
  Peptide Sequence Number=SeqID_115603
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatttctctttctcttttcttgattctctctccttcgaccccctcctattcatccaaacatcacctccctcacgaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 23919 - DNA, 621 bp, Glycine max
  Peptide Sequence Number=SeqID_115604
atgttgaaaagttttaaacaacaagaacaaatgtcagttcttgaattgtacatagaaaaggatgtggctggtggttcaatgtttcattctgcaaattcgcttacatcatgtggaaattatttatctaatgacgagacacaaccgacaacaaatatgagcaatttacatattgacgaagacgatgatgacgacgatgatgattatcttgtgtctaactcatacgttgaagaatctttagacgaagatgacagtgttgacggtgtatctgataccgacgatgaagtcaccaacattcctcaaccagtaaggattgttcacccagcagaaggtgcacaacgaattgaaaatccattttggaatgatgctatgcattataacaatatcaactggagttatcctgatgaggaggagatttgcggtttggagttgccgtcgacctttaatattggccaagaattatatgttggcatggaatttgatagtaaagatgcggtcaaaaatgcagtcaaacaatatgttatgaaggtgcatcaaagtttcaaagttgttgaaagcaaatcgaacaagcatgatcagagaagatccatcaataaaaatttctttgattcaagagaggattaa

SEQ ID NO: 23920 - DNA, 408 bp, Glycine max
  Peptide Sequence Number=SeqID_115605
atgaggcagctcatggcatcgttcagccagatgcagtcccagatgcaatctcaaggacttgcactacctccagagcctctggttggtccctcaggtgctcgagtaagcacaaaagggagttgtgttgatctctctggaaatgatccagaggcgggtgactcagataggtgcggcttgtacatcgaagcagatcatgcccgcttggttgccctagggagagtttatgagggatccactgttgttcataacactcctttgttgcttggccaagtaaaggtaggtgtggaggaggttacagatgcaaatgctccagttcatgtacccactgatgaggtttccttagtggggcaagcaattcacaccttctttgcttggtcgacacatctggtgaagtctttatcacagcag

SEQ ID NO: 23921 - DNA, 258 bp, Glycine max
  Peptide Sequence Number=SeqID_115606
atggaaagattgcacgaagactacaatgtggacctaactctcaaaaacaggtcccagaatggaatcgcaaaagctggttcgaggtacttacccgttgaagatcgaagaacgatgaagaacgtcgaagaacggtcgaaaaccttcgcgaaattcctcacagaaaacgttacggaaacgtttcggaagcgcctcggcttagattttcttcacggaaaatttttccaaaaattcgaaagagacgatctacgaaccttttaa

SEQ ID NO: 23922 - DNA, 552 bp, Glycine max
  Peptide Sequence Number=SeqID_115607
atgaaaagtgatatccactataatgatgttaccaatggaaaaattctaaagtggcttccttttatgttttttggtggtaaaggctccattaccagaagccacgttgatattgatatgtcccatgttttcatcacccagtttcaaggcattaaaaagatatggctatttccctgggaacaatccagtctgatgtacaaattaccttataattttcacagtttagctaatattaaggaacccgactatcaagaatttcctgctttaaagtatctaaacggttacgaagccgttatccatcccggagaaacactttatatcccttccgggtggtggcactatatccaatatgaaacagaaggatattccgtctctgtcagagctcttccttccaactggctcgagaaatggagaggatttaaaaatctggtcatgatcaggcattttgataatgctatgcgaaatttatttaaagaaaaatggtttgactttaaggtaagaaaagcccacagaaaagcaaaaagagcagttgcaaggattcctgaaataacatga

SEQ ID NO: 23923 - DNA, 731 bp, Glycine max
  Peptide Sequence Number=SeqID_115608
atggtgaaagttgggacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 23924 - DNA, 639 bp, Glycine max
  Peptide Sequence Number=SeqID_115609
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttggatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgagaaaaaaggctgcaccggtgcgtcagcagaatatgtgatacaggatatattccgcttcctcgctcactga

SEQ ID NO: 23925 - DNA, 162 bp, Glycine max
  Peptide Sequence Number=SeqID_115610
atggatgggctagtggatctagcgacgatcaacgctttccttgcttatcaccatagcaaggaaagtatggtcgttgctattttggctgatgcctatgacacctttgactggagatgcgagaagaacagcgcaaggattgtctgttgcacacccactctctat

SEQ ID NO: 23926 - DNA, 367 bp, Glycine max
  Peptide Sequence Number=SeqID_115611
gtgcaccgaagaaaccgatgaaaagaagtcaaagatccacaaagcgtgatccgccttactgggagtatgttgatgcttttcattctgttcaaagcaacaactctccagtgaaacgaagtgcatcatgttctcaaccgcctcaaccaacaaggatcatcccgatgttggatcaatttgcgtcattctttcaaggtttcattcgtgacgttgtggatgtgaaagcggacggtaactgtggatatcggtccattgccgctttatcaggtatgggggaagattcatggccgttagtgcgtaatgaattgattaaagaacttggcagtaggcctacgcctctcgggaacatcggcaacatcctcgtcagcag

SEQ ID NO: 23927 - DNA, 695 bp, Glycine max
  Peptide Sequence Number=SeqID_115612
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttggtgttcccaaaagtgatcaagaacacttttaagaacgaagtaatcgacttcattcatcttataatcgattatcaagcttatcgataccgtcgacctcgagggggggcccggtaccagcttttgttccctttagtgagggttaatttcgagcttggcgtaatcatggtcatagctgtttccttcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggagatgccaggaagatacttaa

SEQ ID NO: 23928 - DNA, 289 bp, Glycine max
  Peptide Sequence Number=SeqID_115613
ttgatgataaatacatggacgttccagtggacattatgcacttgttacacaacaacccacttagaggaagggccaagcagggaggacaacgggtaggcgaaatggaggtttgggccttggaaggatttggtgttgctcttttcacaagagatgcttacgttataaatctgactcatatgaaatccaagcaaacgggtgatttaggaggtaaattaacacctcaaatggcaaaagaatttcctcgtattcccccgaagatagattattacgagctatacttggcattcag

SEQ ID NO: 23929 - DNA, 162 bp, Glycine max
  Peptide Sequence Number=SeqID_115614
atggctcaaaaatactggaaagagcaaaattttacacatagtgaaaagaaaagtgagaaagcatacattacatgggatgaaaatgatatggaatcctctgagagtctggccttaagcacagcctgcttagcgttagtcaattatgcgacaaaggctatctag

SEQ ID NO: 23930 - DNA, 252 bp, Glycine max
  Peptide Sequence Number=SeqID_115615
cttgggaggattgatggggacccggtgttgagagaaacgaggatatgggctacgtgggagtacatgagctcagatggaggtgggcaacaggggatgagtggtacctggagatatgtcgcgggggtcaggagaccttggggacgtcaggtggggtgctattgcccaaaatccaagcttgaccaatcccgacccaacccgggcatagtcttggtcagtgagaaccttgatgtagctaaacaggcgagctcctag

SEQ ID NO: 23931 - DNA, 276 bp, Glycine max
  Peptide Sequence Number=SeqID_115616
atgtcaggatttacacgcaattctcctcaaatttcagccagcccgcatcaattagaccttgcaccttacgcttcagagccctaccatgctcaatggaacgccccggggcttctccgtgacaagcacacgttgcgttcgagtcgtattctcggagaaatggaggttgatgaaccttggctagggttatggctaccattgaattatcaagtagatatgggagcaagtcagcataggacactggaattggggtggtgttcgccattggaagtgcggtag

SEQ ID NO: 23932 - DNA, 651 bp, Glycine max
  Peptide Sequence Number=SeqID_115617
ggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttatgtaaccttgacctaatcatagatgaaggtgcgtcatttagaaacatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccgcggaaatggcttacgaacgggcggagatttcctggaagatgccaggaagatacttaacagggaagtgagaggccgcggcaaagccgtttttccatag

SEQ ID NO: 23933 - DNA, 363 bp, Glycine max
  Peptide Sequence Number=SeqID_115618
gcgaaaggcccaagtggagaagggcgaaggcccaagtggagaaggataaagcccccgagtgtagatggatgaaggcccaagtggagaaggatgaaggcccaaagtttctctccgggttccttgttgaaccaattatcagacttatcaaggtaatccttgtggcgtctaccctgacttatcttccttcaccggaagtggcgtctacccagacttatcttccttcaggaagtggcgtctaccctgacttatcttccttcaccggaagtggcgtctacccagacttatcttccttcaccggaagtggcgtctatcctgacttatcttccttcactggaagtggcgtcatccaaacctccgtagcat

SEQ ID NO: 23934 - DNA, 687 bp, Glycine max
  Peptide Sequence Number=SeqID_115619
atgacccaagagctggtagcccgcggagacaccttacggttatccgcacctcgtcattcagtgaccccaagtgtgattgatgagcagaggccaatatggtcatctgcgctctttccggagatgtcaacatcttccggtggagactttttcaagtctcacaagttatctagaactacgagcacgagcattgcttttgtcggccgccccacaagatctgtcatactgaccctgaggtcatgtgacacgcggagacaaaatttggtcattctgcacccctttaccattcagacacagtcgtgtccgatggcgcgcagagacaaaatttggtcattctgcacccttgtgtcatccagaggcggcgggcccgatgacacgcggagacaccttacggttatccgcacccttgtgtcatccagaggcggcgggcccgatgacacgcggagacaccttacggttatccgcacccttttgtcatccagaggcggcgggcccgatgacacgcggagacaccttacggttatccgcacccttgtgtcatccagaggcggcgggcccgatgacacgcggagacaccttacggttatccgcacccttttgtcatccagaggcggtgggcccgatgacacgcagagacaaaatttggtcattctgcacccttgtgtcatctggaggcggcgggcccgatga

SEQ ID NO: 23935 - DNA, 294 bp, Glycine max
  Peptide Sequence Number=SeqID_115620
atgggatcgcacccacaaagacactcggtggacccggaaaagtcaaacagagccctgggatttccagctctggttacgggcctctatcagtcctacagggtgcccgtacccccccggcaaggtcacgtcatcatagggattgcgcctgtagtggacccgaagaagtccaacagggtcttggagttgtcaagctctaattacgggtctctcaagggcatcaggccccctactaatcgagctttcatcaagaagtactgcgcccccagacgggtgcagggcgagacaccacagtag

SEQ ID NO: 23936 - DNA, 282 bp, Glycine max
  Peptide Sequence Number=SeqID_115621
atggacgtatggggtgctaataccttccccgcgcgtaaatacaactcccgagcctttcacttaaaagttcgtagatcgcgtcttttccggtttttccgacgttttcctcaaataaacgttggtggcgactccacgcgtattcctttcgtggaacacgcatcccgcgagtcacacgtcgccctcccgccgaaggacttcactccccgtaccgctccagacgatttgagccaagcccctaccttcgaggggcaactccctcctcacgccgactatcctctgtag

SEQ ID NO: 23937 - DNA, 378 bp, Glycine max
  Peptide Sequence Number=SeqID_115622
atgaggcaccgaatccctatgataggtggtatgatgaatatgttgagtggtgcaaccctcttttgtaaaatcacttatgcacccaacatcttcatgatttgtgtacataaggactcattaggtagtgatcaaggggttccaatgaaccctaagaaaataaagctcattcctgagtgggctactccaccaagtataagaaaaatttggggcttccatgacttaacaaactcttacaaaaggtgtcgaggaaaaagcccaaagtttcaagaacctcgggatttgaggtcaatccttttcaagggggagggaatgatgcaatcctaccccacaaaggcattcgatagaagactcaaagtagattgggccagtgatgcatga

SEQ ID NO: 23938 - DNA, 207 bp, Glycine max
  Peptide Sequence Number=SeqID_115623
atggcagccacatcagcaaataatgctcaaccatcatatgcatcaaccgacattcaagctgcgatgcatactctttctatggctcctcctgatgatcagtggtacatggataccggggccacctctcacatgactgcaaatggagtgatatttggacgtcccctgtgctcagctcaggtggacatcgttattatgctttgttcctag

SEQ ID NO: 23939 - DNA, 836 bp, Glycine max
  Peptide Sequence Number=SeqID_115624
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttggcgaattggagctccaccgcggtggcggccgctctagaactagtggatcccccgggctgcaggaattcgataatcaaggcaacacccttgtcgatcccaaaaatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 23940 - DNA, 218 bp, Glycine max
  Peptide Sequence Number=SeqID_115625
gtggacccttgggtactagtacctatcaccttaagaggactatatgtcctcaccatcagaggactgcacatcctcgcctgcagagggttgcacgcccttgcctttagagggctacgtgtcaacattttcagtgtgctccatatccacaccttaggagaatataaggtcctttgcccttggatgcttaaccaagacttgcgctcccggttaaggggcca

SEQ ID NO: 23941 - DNA, 172 bp, Glycine max
  Peptide Sequence Number=SeqID_115626
gagaatgatagatctcctccagcacaagttgttgcagcccagatacgcacactgctatataaacatgaaggctgcacggggttgaggaccaaccaccttgatgttatcctaacttcaagtgttggacctgagtgtgtagagttgatctcttttgttcagagagcaatctctg

SEQ ID NO: 23942 - DNA, 186 bp, Glycine max
  Peptide Sequence Number=SeqID_115627
atggttgccgcccagctcgcccaggcgagcaaggttgcttcctccagaagcaacaacttctggagggcccaagtgggcctgctttcgaagaagttacggaaacccacggattgcgcaaaaacacctctttttgacttccaccacattacggaatttcacggatcgcgcaaacctgcttccttttga

SEQ ID NO: 23943 - DNA, 434 bp, Glycine max
  Peptide Sequence Number=SeqID_115628
atggcctcgaggaaacttgcctcaaagagatctaggaaggataaagcggctgaaggaaccagttccgctcccgaatatgacagccaccgctttaggagcgctgaacaccagcagcgcttcgaggccatcaagggatggtcatttctccgggagcgacgcgtccagatcagggacgacgagtacaccaatttccaggaggagatagtttgccggcggtgggcatcgctggtcacccccatggccaagtttgatccagacatagtcctcgaattttatgccaatgcttggcctacagaggagggcgtgcgtgatatgaggtcctgggtgaggggtcagtggatcccgtttgatgcagatgcgatcagccaactcctgggatatcctttagtgctggaagagggccaggagtgcgagtatggccagaggaggaaccg

SEQ ID NO: 23944 - DNA, 156 bp, Glycine max
  Peptide Sequence Number=SeqID_115629
atggggatcgattatatcaagcccaggcccatttgggccctccagaagattcctccagaaggcggttgcttctggaggaagcaaccctgctcgcctgggcgagctgagctcgcctgggcgagctgggaggcaaccacctcccctattttgctataa

SEQ ID NO: 23945 - DNA, 291 bp, Glycine max
  Peptide Sequence Number=SeqID_115630
atgccgatctccccctgtggaaggatcgcacccacaaagacacccagtggacctgaagaagtccaacagggccctggagtttccagctctggttacgggcctctgtcggccctacaggacgctcgtttcccccaacaaggagtgcctgtcgccccagcaaggtcatcaggccccccctaccaatcgagctttcatcagaagtactgcgccccaggcaggcgtagggcgaaacaccacatcagcattgggatggccggtagtgggcaacagacgcaccgccatcacctctag

SEQ ID NO: 23946 - DNA, 363 bp, Glycine max
  Peptide Sequence Number=SeqID_115631
atggggatcgcacccacaaagacacccagtggacccggaaaagtccaacagggccctggggtttccagctctggttacgggcctctatcagtcctacagggtgcccgtaccccccggcaaggtcacgtcatcatagggatcgcgcctgcaagacacccagtggacccgaagaagtccaacagggtcttggagttgtcaagctctaaatacgggtctctatcagttcaagggagtgcctgttgcccccagcagggtcatcaggcccccctaccaatcgagttttcatctagaagtgttgcgtccccaggcaggcgcagggcgaaacaccacagcagcattgggatggccggtagcaggcaatag

SEQ ID NO: 23947 - DNA, 314 bp, Glycine max
  Peptide Sequence Number=SeqID_115632
aacgaaagttgggggctcgaagacgatcagataccgtcctagtctcaaccataaacgatgccgaccagggatcagcggatgttgcttttaggactccgctggcaccttatgagaaatcaaagtctttgggttccggggggaggcatggtggtgcagccgttcttagtggtgaggagcgattagtggttcgattccgtacgaacgaggtctgtgagtgccctggtagatgttctggaagccgcacgcgcgctacactgatcgtaattcaacgagtctatgaggcaagcttggccgacaggtccgggtatctttga

SEQ ID NO: 23948 - DNA, 535 bp, Glycine max
  Peptide Sequence Number=SeqID_115633
atgggaagatttgtccctcgatttcatcataggactgccatcatcccacggtttcacggtgatattagtggtcgtagaccgattttccaagggggctcattttggtgctcttcctgcccaccatacagcatacaaggtggccgtattattcctcgacatggtctgactgaaattcatgtggccctgcaacaccgtttacgcaaagcacaggaagccatgaaaactacggcagacaagcatcaccatgatgtttccttcgctgtaggcgattgggtgctagaacggattgaaccagtagcgtacaaattgcaattgccggtttcttctcgaattcatccggttttccacatttccctcttgaagctccatcaggaaccattacctccctctccagcagaactttcccgagccaacttcaataatcattcacttaagatacttcatgggaattgtgggatgatatactccagacacaaccttgaggacaaggttgttttcggggaagggggtgttgacagcaataacaacacagcag

SEQ ID NO: 23949 - DNA, 335 bp, Glycine max
  Peptide Sequence Number=SeqID_115634
gactacacgtcctcgcctttagagggctgctcgccctcacctttaaaggactacacgtcctcacctttagaggactacgcgtccttgccttcagagggcttctcgccctcacctttagaggactacacatcctcgcctttagaggactgcatgtcctcacctttagaggactgcacgtcctcaccttcaaagggctacacgtcctctccttcagaggactacacgtcctcaccttaagagggctacacgccctcgccttcagaggactacacgtcctcaccttcagagggctgcacgccctcgccttcagaggacaagatgtcctcgccttttaa

SEQ ID NO: 23950 - DNA, 486 bp, Glycine max
  Peptide Sequence Number=SeqID_115635
atgttcggggtctttaatctagacttcctgctctacataaagcacgaagacctctccaaaatcgcacacggtggtcaatgtcttagcatatcaatgttacagttgtggattcttggacactggcagatggtggtcatcgtgcccaaggaacacctagttgtgtggttttgtttattgcataacaggccagacaactaccttaaggggataattatcagtgctttaaaaggtcttgatgatgctccacaacctaaatcaaaggctccggctaggtggattgtcgccaagtgtaatagacaaaaaggaagtactgagtgcggctattatatcatgcactggatgtccaccatcattttaggaagtttcaggaataactgggaagcgtattttaacgatcctagaccattggagccagagagattaaaggcgctgcggatccagtggcacattattatctccgagttagagctcagagctaggatttag

SEQ ID NO: 23951 - DNA, 267 bp, Glycine max
  Peptide Sequence Number=SeqID_115636
atgggggtgcaaatagcacccaggcccacttgggccctctggaatattcctccagaaggcggggaggaagtgaagaaggaaggggttcagccccttaggcactttctctctttcgaatttgcttggaaaattgtttccgtgaagaaatctaagccgagcgcttccgaacgtttccgtaacgttttccgtgaggaatttcgcaaaggtttcgaccgttcttcgacgttcttcatttgttcttcatcgtcttcgatcttcaacgggtaa

SEQ ID NO: 23952 - DNA, 345 bp, Glycine max
  Peptide Sequence Number=SeqID_115637
atgattttgaaattcccaacggtgagaatgttcaaaattgggttgcgaacatggtactcaaatttcacgacgtccaacggtgaacgagtccgagatcgttgtttttctgagataggtttggtgggctgcgagaaaaagaaagagatgaatgacatcggaatagagaaggaagagagagagagagagaggagacgccaattcaaggtgaagatgagtctagaagaagctcaccaccataggaggtcatggataagagcttggaggaagaaggagatgaatgaagggagagggagagaagagcacgaaattttgtgctctaagagagctctgaaatctgaaatttaa

SEQ ID NO: 23953 - DNA, 540 bp, Glycine max
  Peptide Sequence Number=SeqID_115638
atggaagggttagtggacctagcagtgattgacgctttcctagcctttcatcatggcaaggaaagcccggtcatcgccattttggccatgtatgacacgttcgaccggggatgtgaaaagagtggcgcaagaattgtttgttgtgcactggctctctatgtgtggctggtttcacacctttttctccaacaaggtaggcctgtctatccgctacaacgtcaccgctcgcgcatcaaacaaggaaaggcgaattgggaccaactcttggctagcatggaggggcgtctgggttgtattaattataatcccggcctcgccataagacagcatggctaccccatgagaggagtgccatcagacgaaagcatcacgcctctcatcatacggggtttcagtgactacaatgcaaaggtactccaaggagttcgcaaggcatgggatgcggcggcagcaatagtgagctcaagctccgaagaggtgaaaggaatcatcacgggtcaaaggcatgatcttgaaggacgagctaaaggcttgccttag

SEQ ID NO: 23954 - DNA, 213 bp, Glycine max
  Peptide Sequence Number=SeqID_115639
ttggcccagggcttccccggtatcaacaagggacaccaggatttatttattctgcgaagtgatcttccgtcacagtggcttctgtttctatcagctgtccctcctgttcagctactgacggggtggtgcgtaacggcaaaagcaccgccggacatcagcgctggcaagtgtagcggtcacgctgcgcgtaaccaccacacccgccgcgcttaa

SEQ ID NO: 23955 - DNA, 414 bp, Glycine max
  Peptide Sequence Number=SeqID_115640
atggtaatcgattatagctttgtaaatcagtttgaaaagaatgttggctactgcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 23956 - DNA, 222 bp, Glycine max
  Peptide Sequence Number=SeqID_115641
catcctctccaagcttcttatccaaggcttatcttgggtggtgaagctccttcttccaaggcttattccctagtggatggcgcctcccctctcctcttcctcctttgtcttccgctgcatctccatggtggaaaatcaccattaaaggacctcattaaagctcaaagatccagcctccatagaagccccacaagaaagcttccatcacttaagctctcttga

SEQ ID NO: 23957 - DNA, 297 bp, Glycine max
  Peptide Sequence Number=SeqID_115642
atgcatgacacgttcgaccaaagatgtgaaaagagcggcgcaagaattgtttgttgtacaccggctctctatgtgtggctggttttgcacctttttctccaagaaggtaggcccgtctatccactacaaggtcaccgctcgtgcatcgaaaaaagaaagacgaattgggaccaactcttggctagcatagaggggcgttgtcgcaacctacccttcggcgggagggcgacgtgtgactcgcgggatgcgtgttccacgaaaggaatacgcgcggagtctccaccaacgtttatttga

SEQ ID NO: 23958 - DNA, 288 bp, Glycine max
  Peptide Sequence Number=SeqID_115643
atgtcatcgggctcgccgcctctagatgacaaaggggtgcagaatgaccataatttgtctctgcgtgccatcggacacgatcgaaggacggaaaggtcgcagaatgaccataatatgtctctgagcgccattggacacgatcgcctctggaattgcggcgaaaagggtgcagatgactctaatttgtctctgctgtcatcctcaatgggactcatcgaccttctggatgaagctgtagagactaatagctcgtgttttcttcatgctaaaatcgaacatgcttggtag

SEQ ID NO: 23959 - DNA, 342 bp, Glycine max
  Peptide Sequence Number=SeqID_115644
atggtcatcattgtcaatgcggaagctcgtggttacatgagcatgaactactaccaatatatagatgttgtttacacaaatgagcacatcttaaaagcttactccgcacaatggtggcctcttgggaatgaagcggttattcctccttctgatgacgcatggacacttatccctgacccaactacaattcgtgcgaaagatgtggtgtacaaggacacaaccgacgcaattgtcctctacaatctaaccagggaaattgttaacatcgaattcctgcagcccgggggatccactagttctagagcggccgccaccgcggtggagctccaattcgccctatag

SEQ ID NO: 23960 - DNA, 669 bp, Glycine max
  Peptide Sequence Number=SeqID_115645
atggcctctggtaatcgattaccaatgctgtgtaatcgattaccaggcctagagatgggatcaggaacgttttatgttctgaagctgtgtaactcgagtttggtctctggtaatcgattaccaatgctgtgtaatcgattactagaggagaaaagccttgaggcacaccttttaattgcatgtagtggttatgagacgctttgtgttgctattgtagctagatctctcgtgaaagagtctacccctatcttttcttccttgcagatcatgatggcagcgcagttcatccatgaccgagtagagatggagtgcctagagggagtttgggagaccctcaaaggcaatgcgaggtgccgattccgtgacacgatccgactcatggctacttcgttgcgcactgtggagtggatattacctacacctactccatatctactagtggagccagtccaagtgattgacgtgacgtcatctgaggaagaccacgaggaggaaccagaggagctacttcctgagcctgttgtggatgctcttgactttctagagggtgatgaagacccactccctgaggtggattctcccgaggacgtcatgtcggtatctaaggcagactctacggaggagagcggtcccggagggatagcgactagtggaggttcttcatcatag

SEQ ID NO: 23961 - DNA, 818 bp, Glycine max
  Peptide Sequence Number=SeqID_115646
atggtgaaagttggaacctcttacgtgccgatcaacgtctcatttcgccaaaagttggcccagggcttcccgtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatcaaggtcatacaatgctcaatggaataccccaggactcctccatgataggcacatgtgcttatcatggaggagttatggggcattccattgagcattgtaggaccctgaaacataagttgcaaggtctaattgatacaggctggttgatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 23962 - DNA, 195 bp, Glycine max
  Peptide Sequence Number=SeqID_115647
atggactcgggaaggttccaagttagtgtaccagggccctacaatgttcctcaatggaacgctcccggggcttcttccatgacaagcacttactgttgcatgaatcaagagtcgtattatactcggagcctcaaatggaggttgagaaccttggctggggttatggctaccaactgcttgaatcctatcgagtag

SEQ ID NO: 23963 - DNA, 195 bp, Glycine max
  Peptide Sequence Number=SeqID_115648
atgcgggtaccagtttctctcactcggtccggttaccctcggatcattccgtctcatcataggcgtatgattctgaagaaggatgagaaagcggacatgctgtcgctatgctccctggataaaacgtatacccctggaacaaacaagggttacggtttgaaccaacctggaaagccttgccgacacactcattga

SEQ ID NO: 23964 - DNA, 336 bp, Glycine max
  Peptide Sequence Number=SeqID_115649
ccagatgtagtcccagttgcaatcacagatccaatcacagagacttcactgcctccagagcctgaggttggtccctcagctgctcgtgttagcacaaaggggagttgtgttgatccctcgtcgaccgttctagagacgggtgactcaaacaaatgtgggttgtacatcgaagacaatccttcccgcctggttaccctaggaagagtttatgagggatccacagcggttcacaacatccctttgttgcatggccaagtcaaggtaggtgttgaggaggttaaagatgcagaggctcccgttcctatacccactcacgaggttattttagtgggacag

SEQ ID NO: 23965 - DNA, 809 bp, Glycine max
  Peptide Sequence Number=SeqID_115650
gtcaggacgaatcaagactatggcacagaagaagagcactccgatcactcctaccacatccagacggagcaaagttgcaatcccttccaagaagaggaaagaaatttcctcatctgactctgatgatgatgtcgaactagatgttcccgacatcaagaggaccaagacatcagggaagaaggtgcctggtaatgtccctgatgcaccattggacaacatctcattccactccattggcaatgctgaaaggtggaaattcgtgtatcaacgcagacttgccttggaaagagaactgggaagagctgccttggattgcaaggagatcatggacctcatcaaggctgctggactgctgaaaactgtcaccaaaggaaaatgtgttagattctcccctgctgtaatcaacaaatacctgggcagaccaactgaaggagtggtggatattgctgtttctgagcatcaaattgccaaggaaatcactgccaaacaagtccagcattggccaaagaaatggaagctttctgcagggaagctaagtgtgaagtatgcaatcctgcataggattggcgctgcaaactgggtacccaccaatcatacttccactgttgccacagaatcttttgctgtcaaattacccattgccttcccaactgtattgtgtggcattatgttgagtcaacatcccaatattttaaacaacattgactctgtgatgaagagagaatcggctctgtccctgcattacaaactgtttgaggggacacatgtcccagacattgtctcgacatcagggaaagctgctgcttcag

SEQ ID NO: 23966 - DNA, 227 bp, Glycine max
  Peptide Sequence Number=SeqID_115651
atggggacaaatcaaatcggcaagaggttttacaaagtcaaggttaaaggcctagataccaccagcatcaaggaattagggcggttgatggaacctctccaaatgcaagctttccgcaagatttacggaaagatcttagaagacttccaattagtaccaaccattgaagaatttgaggaaattctaggatgtcctctcgggggaagaaaaccatatctttcctccgg

SEQ ID NO: 23967 - DNA, 303 bp, Glycine max
  Peptide Sequence Number=SeqID_115652
atggcttcaatgatagagcccatgttaggaatgagacaactcatagagaataacgtggccactgctgccgttgttagttcggttgccgaagcagacccaactctcccagctatcgcgcaccatcctctcccaaacgcagtaggacgagaaaggagcacactggggcacatcagcaacccccatttgggatacaaccgggtggcttacccttatggattaccacctaattacacgccaccaatcaaacgtgatgacgcgggtcatgtcccttcccccatccttgaaggggagcctcctcgatag

SEQ ID NO: 23968 - DNA, 129 bp, Glycine max
  Peptide Sequence Number=SeqID_115653
atggtgggagcaggagggtctcttaatgccttcctttttcttctcatggagttatttcacaaagactgccatgtccaaaaagaagggtgcgagtacaagccactttggagagcgcagtacaacggatag

SEQ ID NO: 23969 - DNA, 534 bp, Glycine max
  Peptide Sequence Number=SeqID_115654
atgtgggcttttcatacaggccgacaaattgattgggcacacttagtccgatatcgcatgcataaggcattgcgattaaatgctccattgccatatccacacctagtcactctcttccttcaacactttaacatccctcttgattctgaatcttatgttccaatcaagagatccttcttaatcagtgccattgtgattgcatcttttggttaccgtaaagagcatgatggctcttgggtagaaaaggtgctcaacccattgatgaagaaggaaacttaccagttggagaagattgctcttttcttcaaaggattttggacaggttcgatggtcttcaaacctttgttggtgaaaggtttgatgctctggaattgcaagtggacatgcgattcgatgagatggatacaaggatcaccaaggtttgtcatcataaaaaatggggagattgtagaagcaagcttcatgatgatgaatcaagttgattcaagtatttttaatgatgacaaaaatgatgagaaaaagcccaaagaatga

SEQ ID NO: 23970 - DNA, 231 bp, Glycine max
  Peptide Sequence Number=SeqID_115655
atggcgttagtgagggccaacatcaaagaggactctgaagacacaatggctcgtttccagaatggtctaaaccctgaaatcatagatcaaattaaaagaaaaagtgcaacaaggaggaactcacccaatacttacaaccaaaactgggccaacagatccaagaaggagggaggtaattcgttccgacctgtagccacatcccgcatggaaagtcagcagcgtccagtgtag

SEQ ID NO: 23971 - DNA, 156 bp, Glycine max
  Peptide Sequence Number=SeqID_115656
atgactatagaacgtcaaaagggggtacggaaagaaaatgagggaggagcttgccacccagctcgcccaggcgagctaggttgcttcccgccttctggagaacttcctggaaagcccaagtgggcctggtttctatttacaccccctgtttactaa

SEQ ID NO: 23972 - DNA, 129 bp, Glycine max
  Peptide Sequence Number=SeqID_115657
atggataagagcttgaaggtaggagaagatgagtggagggaatgggggagaaggagtacgaaattttgtgcctcaaatgagcctaataatctaaaatcaagttcaagattctccactaagtgtgcttag

SEQ ID NO: 23973 - DNA, 396 bp, Glycine max
  Peptide Sequence Number=SeqID_115658
gtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagaattcgatatggattatacagatgcagacaaagtgatgcaatcctatcccgtaagggcattggatagaagattccaagtagactgggccttcttcaacagctttgacccaatcttcttggagtcttctatccaatgcccttgggggtag

SEQ ID NO: 23974 - DNA, 402 bp, Glycine max
  Peptide Sequence Number=SeqID_115659
atgatggtggcttgggtgatgttgggatacggctacgagcccagaatgggtttgggcaagaacaatggcggcagaaccagcctggtgagcaccaaaggaaatcacgggaagtttgggttaggctataaacctatgcaagcttacataaggaaaagtatctcggaaaggaagaacagacgcctaggctcgtggttgggacaacaagccgaaggggccctgccctgccacatcagtagaagctttataactgcggatttaagacacaaagaccaagtcgccgcgatatgcgaggatgactccctgaggagatcagatttggtacggccatgtcctcctggtttccgactaggaaattggcgagtggaggagcgcccagacgtttacgccacaagcataatgtaa

SEQ ID NO: 23975 - DNA, 597 bp, Glycine max
  Peptide Sequence Number=SeqID_115660
atggttttaggagtattgagacaatttggaatgcaacaaccaattccagagtctccttcgcagcccttgaacattcatggcataacactgaaaggaaaacatgacgaaaattgggggcaattgttcgccccaatgattgatcagtggaacaattgccatgcttttagggtcgacgcttatccccgacaagaggacctattgatctttaactccgactacatggctgaagttgcggagacattacaatacatggtgtctcctcaagggaggaatacatggacagttgatgatctcgtgccttatgtggagaaaattatgattttattcgaagagcaagagagaatcactgagcctgtgccacatggtccagcatcaaagtgtcaatttccagcacaagcgtttcacattcttcagtcaattgttgaaactcagggcataggcagacgaagggaggctgttgaagcgaaagaatattcccaacaaatgacggagcgtgccatggaatatgcatatgagtctggattttttccaccttcctgtttgttcaggggttacagattagggcttatgggttactggttagggcttagggcttag

SEQ ID NO: 23976 - DNA, 336 bp, Glycine max
  Peptide Sequence Number=SeqID_115661
atggcgagtccgatgacatgcgggggtaccgtatgcttatgtgcacctttcgtcaaccaggggcaaacgagaccgttgacgcgcagagacttacgtcatcttttgcatattttgtcatctagagacggcaagtctgatgacatgcgggcgtatggttatccgcactgtttctcatcccgagacggcgagtccgatgacatgtgggggtaccgtatggttatccgcacctttcgtcaaccaggggcagacatgcccgttgacgcgcagagacgaacgtcgtcatttgcaccttttgtcaaccaggggcaagcaagcctgttgacacgcagagactaa

SEQ ID NO: 23977 - DNA, 1067 bp, Glycine max
  Peptide Sequence Number=SeqID_115662
ggacaatgactacgctgaggaagaaaactggactaaggtggtaagcagaagatcaatgaaggttatgcagaaatcctctttagcgggaagacaatcacaaaatctggagataggggacaacaacaaacactatcgccttaactggaggaacaatgccgacattacctccttttatttcacccatttccccgacgaagctaatgaagagttgctatggaggcacttcaaaaactggggtgacgtacgtgaagtatacatcgctaaaagactcaacaaggatggcaggagatacgggttcatgcggttcaagggagtctcggatgcaaaaggattggaggtgagactggacaacatcttcatcaacgattgtaaactatttgtcaaccttcctaggggggggtgccaaggagacaaaagggcagacgaggcacaaacaccaactattctgatcaacccagatgaaggtggggaatattggtgtaacgaaacctgggtgggcatgctaaagaaggtgatggaggtggaaaccttagaggatcgtatcacttgggagttaggatataacgtccgcactaagttcctcggagacgacatggttcttctccctgggatggttgtttggctccagctgtggggatttctgatacaggtgtgggaaatgaaaaatctcaggagggctgtagctgctattggggatgtcatcgagtcagacgatgacacagaggaccgccgacgattggaccgggctcgagtattggtgcggacaccgcttccgccgttgataaggtcggaggtcatcgtccgtgtgggggagcttgagtatcgggtatggattgtggaagagacagggttcgaaggtgggtcgaaccggaaaggaagctcgccgtccgatgggtggtcggagatgataacatcagacgacgaaggggaggttggcgatgttcttgacgacactaataccaatttctccttctcgccggagctgcccaaccagaaattgtctccgtctcgtacccaacgggcagaaggagggaccgatgtgcgctgttgtgatcttagacccctgg

SEQ ID NO: 23978 - DNA, 408 bp, Glycine max
  Peptide Sequence Number=SeqID_115663
attgattccttcacccgagtgttacatggactatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 23979 - DNA, 1007 bp, Glycine max
  Peptide Sequence Number=SeqID_115664
aagacaacagggagtgaagattgctgaaaaccctagccctgcaacaagtcctagggaagtagacacggagatggacaagaaaatccgcggtattgtgagtagcattctgaaagatgcttctgtgcctgatgctgagaaagatgttccaacatcttccaccccagatgtttctgtgcctgatgtcaataaagatgttccaacatcctccgctccaaatgctgaagccctcccttcacccagtgaagaggaatcaacagaagaagaggatcaagcctcagaggagacccctgcaccaagggcaccaggggcgtgctccaggttggcacctggcattgcggaaagacttcaaaacagaaagagaaaaaccccccttaagaggtctggacgaatcaagactatggcacagaagaagagtactccagtcactcctgccacatccagaagaagcaagggcccagaaatctggaagaaaggtgcctggaaatgtcctgatgcaccattggacaacatctctttcactccattggcaatgttgaaaagtggaaatatgtgtatcaaccgcagacttgcggttgaaagagaactgggaagagatgccttggattgcaaggagaccatggacctcatcaaggctgctggactactgaagacagttaccaagttgggagactgttatgaaagcctagtcagggaattcattgtcaacattccctctgacataacaaacagaaaaagtgatgattatcagaaagtgtttgtcagaggaaagtgtgttagattctcccctgctgtgatcaacaaatacctgggcagaccaacagatggagtggtggacattactgtttctgagcatcaaattgccaaggaaatcactgccaaacaaatccagcattggccaaagaaagggaagctgtctgcagggaagctaagtgtgaaatatgcaatcctgcacaggattggagctgcaaactgggtacccaccaatcatacttccactgttgccacag

SEQ ID NO: 23980 - DNA, 175 bp, Glycine max
  Peptide Sequence Number=SeqID_115665
atgaggaactcagccgtattctatacttgtgagactcgaaaaagtctccgccagaagatgcctacctcggaaaagggcgcagatgaccatattggtctctgcttgtcatcgggcccgacactcgaggtgcggataaccgtaaggtatctccgcgggctaccagctctgggtcatg

SEQ ID NO: 23981 - DNA, 314 bp, Glycine max
  Peptide Sequence Number=SeqID_115666
atgaccttcggacctatcctctcagtagtggcagccgtgttccgtcttatcccatcagttgcaacagctatacgaaaaaactccaaccattgcagcgttccgatcgtactccgaatacaacagtagttgaactcgacttgcggattggagagcttgaactactaggtgctgcggctggaatggtcgctttcgtactagttgccaacttttgtttgcccatccccgctcatccgcgtttgttcaacagtactgttgctagctctgatgcccatgctcgcgctcaagctgtactcaatcaagtaggccgggtcgag

SEQ ID NO: 23982 - DNA, 656 bp, Glycine max
  Peptide Sequence Number=SeqID_115667
atgggtgaagtagaggagatacaagagaagatgaaagccgacatagaggccattaaagagaaaatggccacaatgatggaggccatgatgagcgtgaagaagataatggaagccaatgcggttgccattgccgctaccagcgttgttgctaaggtgaacctgatgtccccatccggcatcaaccaaatgaatcatccaacctcagatatgagtgttcctagaacccaatatcatcaccctcccaagttcaaggtgctggaccttgacaagtacaaggggactacttgtcccaagaaccatctaaaagatgtattgtcagaagatgggtatcagtgcaattttgatatggttctggataggatgcaactacagaacatttgcaaaaagggggacggatctttcaaagaacacgcccaaaaggtggagggatctggcggcccaggtggtacccccaatgatggaaagggagacgatgatcgtgatggcaaatttgatcatcctactaggacgactgagaaaactggggcaaatgaagagggtgagaaagagggagaaacccatgctgtgactgccattcctatacggccaagtttcccaccaacccaacaatatctttactcagccaataacaaaccttctccttacccaccacccag

SEQ ID NO: 23983 - DNA, 180 bp, Glycine max
  Peptide Sequence Number=SeqID_115668
atgaccaagagcaagtgcaaggatccacttgaaggacttggaggacctatgacaagggctagagcaaggaaagccaaggaagctcttcaacaagtgctgtccatactgtttgaatacaagcccaagtttcaaggagaaaagtccaaggttctggtacgaaaattgaccaagaggagttga

SEQ ID NO: 23984 - DNA, 138 bp, Glycine max
  Peptide Sequence Number=SeqID_115669
atgagcgaacgaggacgtggatttggtgtcattgctgctgttctactactgttgctaagccaccaaagaagcagcataggagacggacacacggaaagaggagtacgcgagaaagtagttacactcgcttcatcataa

SEQ ID NO: 23985 - DNA, 561 bp, Glycine max
  Peptide Sequence Number=SeqID_115670
atgtggctgcaggtcggaacgaattacctccctccttcttggatctgttggccaagttttggttgtaagtattggaaatttgaaaaaaaaagagagagagagaagaaagagaaatcgaattcctgcagcccgggggatccactagttctagagcggccgccaccggggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaaccccgtcagtagctgaacagggagggacagctgatagaaacagaagcccactggagcacctcaaaaacaccatcatacactaa

SEQ ID NO: 23986 - DNA, 453 bp, Glycine max
  Peptide Sequence Number=SeqID_115671
atgccgcctttctccaaatatatgccttcaactactgttgaagaacaagaggatgatgtatatgcaaatcgtactaatcatgacaagggtttatgggagaacattcgtacggtcatggcaacaccaccaatgtcaccgtcgcaattagaaaaccctccagaggttactttgaaaaggacaagacaatccacgaggctccgaagtctgacgagtagaagaatagatggcccgcaggcagttgtgaacatcaatccggctacaagtagagggtcagaacctcataaagagatatttcacagttatttaggggttgtcgcaagggaaaaaattcctattgtacacgtgaactggaatgttgtccctaatgatctaaagaccttaatatggaaagatattttgcacaagtttgatatccctgaaggtgagaatgcaaaaaaaaggcgatgtcaatag

SEQ ID NO: 23987 - DNA, 722 bp, Glycine max
  Peptide Sequence Number=SeqID_115672
gaaggcataggtcacatcttagacctcactcccatataagagaaaatgaaagaaagcctcaagaggctaacattaagctcccatacttccatgggaaggacaatgtagaggcttacttagattgggaaataaggatagagcaaaaacttaaaagaaagtctactttaaaatattatggatctcattcttatccaaagaaagaccaaggtctaggcatcttaggggcagcaccttctaagcccaaatatgataagggaaagacaatagaaaaacaaccccctaaggctagtatgcaagagaaaactagctctataaaccaagataaggctactacttcaccttcctctagtgaaagtgaaaaagcaaaaggggaagaatttagtgaagaaatctaccccctagaagaaggacaaccattagtggttaaagagaagtgtaaggaggtaagtgtctcctccaagaggttagctaagaaagaaactcattttacaataaagacaaacattaaagaaactttccctctagacaacctccacatttctctttgtaaaaaggcacttgctagcattgccacacctcttgggcttgagtttatcctcaatgatcgaggggttcccatgaaccctaagagaataaaggtcattcctgagtggcccactccaccaagtataagaaaaatttggagcttccatgacttaacaaacttttacaaaaggtgttga

SEQ ID NO: 23988 - DNA, 643 bp, Glycine max
  Peptide Sequence Number=SeqID_115673
atggcggaaccatcgaagaagcagaaaggcacttcaagtcggagtcaacggcattccaggtcacaggaaaccccaattcctccctccattccctctggatcattgttttcatcagaggaacagcgtatacgatacacaaacctcttttcatctcgttccattatagatccaaaattcatagatatggagttcttttcaaatgagaattttgaatgcttccaagcatttgaaaactccaatcttattccattcatgtctctaaaattacctgtctattctgaattagtcaaagctttctattctaatttagaaatccatgaaggtatcctaatgtctaaaatctatgggattaagatggtcatcagacaatccctattttacgatttaacaaaattgcctagtgaaggtgtgccttttgagggtgcactgattgatgattggaaattcgatttttctgtgcatgatgcccgccggttggtttgcaccaaccaagcggatatgaccggaaggcttcttgctggttcattggcttttgagagccgcatcctccattaccttattgttcgcatcttactccctaaatctttaaaccttgcccaggtttctgaagaagatctcattgtcatgtgggcctttcataaag

SEQ ID NO: 23989 - DNA, 189 bp, Glycine max
  Peptide Sequence Number=SeqID_115674
atgggggtgcaaatagcaaccaggtccacttgggccttccaggatgttcctccagaaggtggttgcttcaggaggaagcaacctagctcgcctgggcgagatggaaaatcatggcagaggcgcttccgcatcgtttccgtgggtgatttcgcgaagattttcaaccgttcttcattcttcggtggttaa

SEQ ID NO: 23990 - DNA, 272 bp, Glycine max
  Peptide Sequence Number=SeqID_115675
gtcgatacaaagcggggcttttgctcctactaccctccttggagagataactcagacctacgtagttcttcttatgcgtgaatcaagtgattctttttactgcgaagggttttcctctaaggtcagatatgattttgaaattcccaacggtgggaatgttccgaattgggttgcgaacgtgatactcaaatttgacgatgatccaacggtgaacgactccgagatcgttgtttttcggagatatgtttggtgggctgcgggaaaaagaaagg

SEQ ID NO: 23991 - DNA, 827 bp, Glycine max
  Peptide Sequence Number=SeqID_115676
ggctacacgccctcaccttgggtactagttgccctcaccgttgagaggactacacgtcctcgccttgagaggactacacgtcctcaccatcagagggttgcacgccctcacctccagaggactacatgtcctcgccttgagagggctacacgtcctcaccttggagggctacacgccctcaccttgaaaggactacacgtcctcgccagcagagggctgcacgccctcacctccagaggactacacctcctcgccttgagagggctgcacgccctcacctttagagggctacgtgtcctcattttcagtgtgctcgacatccacaccttaaaagaatttaagggccaactgtgcgagcacaaccagagagggaaggctatcacacagctactatgcatactgaggcaagatttcacccgtgccgctgcaaagagaagacgaccgcaatgccaatctccccctgcggaagtatcagttggtctgtgccgtcccgacatgggaatcgcacccacaagacacccagtggacccggaaaagtccaacagggccctggggtttccagctctggttacgggcctctatcagtcctatagggtgcccgtaccccccggcaagggatcgcgcctgcaagacacccagtggacccgaagaagtccaacagggtcttggagttgtcaagctctaattacgggtctctatcagttctacggagtacctgtaacctccagcaagggcatcaggccccctactgatcgagctttcatcaagaagtactgcgtccccaggcaggcgcagggcgaaacaccacagcagcattgggatggccg

SEQ ID NO: 23992 - DNA, 258 bp, Glycine max
  Peptide Sequence Number=SeqID_115677
atggtggctggaaatacaacaacaaaaaagcctagggaaaattggagtgaggaagaaagaagacgagtacaatataacttaaaagccaaaaacataattacatctaccttaggaatggatgattattttagggtatcgaattgtaaaaatgcaaaagacatgtgggataccctacaaaatgaatacaaatgtgtagaagcaagcttcatgatgatgaatctagtagttttgatgatgacaaaaagccccaaagaatga

SEQ ID NO: 23993 - DNA, 261 bp, Glycine max
  Peptide Sequence Number=SeqID_115678
atgcagatgaagttcatccgtatgattcatacagatgaagttcacccgatcatggttagaaccagagggttaggtcgtgccctaagtagggttataggcagagcccttgggagagaggatcatcatgattcagatgatgttccccagcagcaaaggcctacaacatccgcacgtaggcaacaggaagctacccctgttgttcatgatgctcttgatatgactgagaacgtacctgctcatggtgcattagctattgattga

SEQ ID NO: 23994 - DNA, 1150 bp, Glycine max
  Peptide Sequence Number=SeqID_115679
atggcaaagattatcggtattgacttgggtacgactaactcgtgcgtggctgtgatggaaggtggaaaacctcgtgtgattgagaacgccgaaggcgcgcgtaccactccttctattatcgcgtatcaggaagatggcgaaattttggtgggtgcacctgcaaaacgtcaggccgtgactaacccaaaaaacaccctgtttgcggtgaagcgtttgattggtcgtcgttttgacgaaaaagaagtacaaaaagacatcgacttaatgccttacaccatcaccaaggctgacaacggtgatgcatgggtagaagtgcgtgacaaaaaacaggcgcctccacagatttctgctgaagtgttgcgcaagatgaagaaaactgccgaagactacctgggcgaagaagtgaccgaggccgtgattaccgtgcccgcttactttaacgacagtcagcgtcaggcgactaaagatgctggccgtattgctggtctggaagtgaaacgtatcatcaacgaaccaaccgctgcagcgctggcatttggtttggacaaacaggaaggtgaccgcaagattgcggtgtatgacttgggtggtggtaccttcgatatttccattatcgaaattactgaaatcgacggcgaacaccagtttgaagtgttgtctaccaacggtgacaccttcttgggcggtgaagacttcgacaaccgcatcatcgactttttggcagacgagttcaaaaaagaaaatggtttggacttgcgcaatgacttgctggcaaaacagcgtctgaaggaagctgctgaaaaagccaagattgagttgtccggtgcacaacagaccgaagtgaacctgccttatatcacggcagatgcgactggtcctaagcacttggtggtgaaaattacccgtgccaaactggaatcactggttgaagacctgattgagcgtacgatcgcgccttgtaagactgcattgaaagatgcgggcgtgtctccttctgacatcgccgacgtgattttggtcggtggtcaaagccgtatgccaaaagtgcaagagaaagtgaaagagatttttggcaaagagccacgtaaagacgtgaacccggacgaagccgtagcggtaggtgctgcgattcagggtggcgtgttgaaag

SEQ ID NO: 23995 - DNA, 759 bp, Glycine max
  Peptide Sequence Number=SeqID_115680
atggggcagggtaagccactagtcttgttgcacggttggggcatgaatagcgccgtctgggagcgcatcaccaagcgcctgtctgacaactaccgactgttcctggtggatttgccaggcatgggtcaaagccgcccggtgtacccttatcatttgcatagcttggccgaggcggtggcggaagagatccctggtgtatccagcattttgggctggtctctcggaggcctggtcgcgcaacaaattgcactcaatcagccggaccgtgtagaaaagctgatcctggtggggactaatccctgttttgtcagcaaaccggactggtcgcatggaatagacgcgcgtcatttcgagcagttcaatgagcggtttgccaaagactttaatgccaccttgctcaatttcctgaccttgcagtgcatgcatgccaaagatgcccgcagcaccgtgcgccaattacgcattgcctttggcgccaaacctacgccaacgcaagatagcctgaaccaggcgctggatatcctgctacagacagacttgcgcgaagaagtgggacgcttgttccagccgacactgatcatacacggcgaccgcgataccctggcgccagtctcggccgcacactggctggccatgcatttgcagagggcgcgcttgcgagtgatcgctggtgctgcacatgcccctttcctgtcgcatgcagatgctttctgtgagactgtcgaagcctttatggcggatgagtcggcggagaactaa

SEQ ID NO: 23996 - DNA, 210 bp, Glycine max
  Peptide Sequence Number=SeqID_115681
atggttatcctcatctttcgtcaacaaggggcaaacgagcccgttgatgcgcagagactaacgtcgtcttctgcacgttttgtcatccagggacagggagtcaggtggcaggcggagataccttatggtcgtctgcacctttcgtcaaccaaggcgaacgagttcgacggtcttttactctcatcgtctggagacattcaagcccgatga

SEQ ID NO: 23997 - DNA, 204 bp, Glycine max
  Peptide Sequence Number=SeqID_115682
atgctgagcattgaggagttccttagtcaggtggcctggccaggagtccagccttctcctttgggagggggtgaggtgatggaagcttgcttgtggaacttctatggaggctggatctttgagcctcaacgaggtccttcaatggtgattttccaccatggagatgcagcggaaggcaaaagagaagaggagaggggagactga

SEQ ID NO: 23998 - DNA, 270 bp, Glycine max
  Peptide Sequence Number=SeqID_115683
atgtcaccggtgagaaaagaggccgcttatgtatgcttcttcctgtccagcaagatgtcttctgtcgagaagctgacgcagcaagacccgaggaatcagatacggatctttttcagtctctttcgctggggcaaagcaaagagggaggactttcggaagaaggcgtcgtccgctgatgatcttgaggttgggaggcaggatagataccctatggtttggttggtctctatgcctgcttcacttcgtagcattaaggggacagtgcaatga

SEQ ID NO: 23999 - DNA, 351 bp, Glycine max
  Peptide Sequence Number=SeqID_115684
atggtagctggcccgagaccaaccttctcttcacaaggaagatgcaggtcccacagcccagagccatttgttataagagaagaggcagaggagacacaagtgagacaggtagctgctgccacacctgagcgatccattgaggctactttagagccttttgcacaaggggaggatataccctcacctcagtctgcagcaaacccctccactcctcttctagagatgccagaggacctagctacattagtcctggctatggacacttctcctccagctactccagtattgcatctgacagatgaggaagatgttcaaacacaggatacctatgaccagtcacaggaattgtga

SEQ ID NO: 24000 - DNA, 474 bp, Glycine max
  Peptide Sequence Number=SeqID_115685
atgattggcgagcgggtttgtttttacgttgggccgatcctcttgaaacgtcagtcattcagtgtctatcaaatgttggaccttgtatttaagggccaggaatttttcggtggagtggtccggggttttcccatggtacgtgcaagttgtgtcatgatcataccattttgggaaaggatgttggtagatcttcccgggagttattatggccatttggttggcgatgagggacggcaagaggtcttcgtacatcattgggatcggggtgaattctggaattggccttgggggaagttcctcatcgcgttggaaccggcaccaaagtgggcattgccggccaggcgagtcgtggttggagtcggagcttggggggcctccctctggatgggggtgggagctctaggctgtgcaggtgctggattggaggagttcccggcgcgagctaagaagcttggatgctgttgcgcgtactga

SEQ ID NO: 24001 - DNA, 255 bp, Glycine max
  Peptide Sequence Number=SeqID_115686
atgaatattgaggaatccattcatgttacttttgatgaatctaatgctatcttgtcaagaaagaatatgctagatgatattgcagaatctttagaacaaattcatattcatggacaagattctaaaggaaaagggaaaggaagcaatgaagatcctccagaagaagccaaatcaaataatgaacttccaaaagaatggaaagcctcaaaagatcatcccttgacagcattattggtgatatctcaaaaggggtaa

SEQ ID NO: 24002 - DNA, 855 bp, Glycine max
  Peptide Sequence Number=SeqID_115687
atgtccttaaaattgccacattatcctgaacttgtaaaggtcttctactgcaatttaaaaattcaggatgacattatttcttttgaggtgcatggtattcccatgatcattgatcaatcattgttcttttctttaactcatttacccaatcaaggtgcaccttttgagggcaccattgttgatgtctggaaatttgattattctagtcatgatgctcgtcgtatggtctgcaatgaccaggctgaaatgaccggtagattattggccgggtcattaacatttgataatcgcatcatgcactatatcattgttagaattttgcttccccggtcttcaaatttggcacaagcctctgaggaggatttgattctgatgtgggctttccttaccggtcgtcagattgactgggctcacttggttcggtaccgaatgcataaggcattacgggccaatgcacctctcccttaccctcaattgataactttgtttctgcgtcattttcaaattccgcttgatgatgaaccatttgttcaagtcaagcgttcctttgcaattggtgctggtgcagtgacttcctttggataccgtaaggatcggaatggtcaatggctaaagaaagatgcactccctcctcaagatgagcgtactccttcacctcctcctcaacaagatgattcagcactcatgactgaagttctttccgaattagggggtcttcgttcttatgttggtgaacattttgactcactggatactcgttttgctagaatggatattcgcctcacacagcttgaagaggatgtgggttacattcgtcagagtttcgatcttccaccaccacctccaccttcttag

SEQ ID NO: 24003 - DNA, 204 bp, Glycine max
  Peptide Sequence Number=SeqID_115688
atggagggtaaaggaaatagctataaatgtttcactcaatttggagtgcttcttattccaatagctcttaaggtggttggccccttgcttcttgactcaaattcttcaagatatggcaccaatcctccttcccaattccctatatggcaactcataagcaaggaaacaaagagacaagcaataaccaaagaccaaaaaaaatga

SEQ ID NO: 24004 - DNA, 1316 bp, Glycine max
  Peptide Sequence Number=SeqID_115689
gagggcaacagctccgggctgtccgccggcgaagagccgttcctggtgccgctggcgatcccgctggtggccgggccgtcgattctggcggcgctgatgctgctgtcgcaccagtatccgcatcagctgccccatctggtggcggcgctgttgatcgcctggggcctctctgcggccattttgctgatgtcgaacctgttcctgcgcctgctgggcagcaaaggcgtcagcgcgctggaacggttgatggggctgattctggtgatgctgtcgacccagatgttcctggacggcgcgagcgtgtcagcgaccacgccgtccagcggctggttgatgtcgatcgcctgcacatccggctcctgctcgcccggctcttccagcgtggcgaactgcgaaaccagcatctgcggtttgaagaagtggcccttgcgctgtttcaggcgctcctcaatcaccgtcttgtcccctttcaggtagaggaaatgcaggttgcgattgccttcgcgcaggcggtcacgatagctttttttcagcgccgaacacaccagcagcgacaccggattggtgcgttgcatggcgaagatggcgtcgttcaaggccgccagccacggggcgcgatcgttgtcgtccagcgcgtgcccggcggccattttgttgatgttggcgcgcggatgcaggtaatcgccgtccagcatggcggcatcggcctcgcgggcgacggcgctggctacggcggatttgccgctgccggatacgcccatcaggataaatacgcagcccaccaggccgcacaccgagatgatggtttccagcaccgaccaggatttgatggtttccatgatgctcaggttgaagtactccttgaacagccagaagcccggatcattaacgtgcgagaagataacgctgccggaaccgaccgcaatcaccatcagctcagggctgacgccggtggtggcgatcagcggggcgacgatgccgccggcggtgatcgccgccacggtggcggaacccagcgccagacgcagcgcggcggcgatcgaccaggccatcagaatcggcgaaacgttgctgccttccatcaggccggcgatgtactgctcgacgccgctgtccaccagcacctgcttgaaggcgccgccgccgccgatgatcaacagcatcatggcgatgattttaatcgaatcggtgatggtgcccatcacttcatccatggtgcggccgcggttcaggccgaaggtgaagatagcgatcagcacggcgatcagggtcgccatcaccgggtcgccgaagaactcggcgaagcgcagcaggct

SEQ ID NO: 24005 - DNA, 210 bp, Glycine max
  Peptide Sequence Number=SeqID_115690
atggcttacacccacattccggtgaaagttgaaaatcctgacctcgcaccctacacttcagagccctacaatgctcaatggaacgccccggggcttctccgtgacaagcacacgttgcgttcgagtcgtattctcggagaaatggagacagactttgtggttgatttagggatggcctttgtggataactgggtggtgggtaaggaggag

SEQ ID NO: 24006 - DNA, 398 bp, Glycine max
  Peptide Sequence Number=SeqID_115691
aggttacttggcatggtgtcaaggtatgcttaaatcagattactgctcagtttaagcgtgtacactatgctggcaaaaacccttctcgttgtggatgtgtcatgagaactactcacggtcttccatggttatctgagccccaagtgaccataaccaaagagatagaaaccatatccaagcgatttgaagagcgtgatgtttgtggcaaagttattctaaagagtaaactctgggaaattgcctaccttaatgtaaactctatgtgtcctcttctagaaaaggtcaacactaaaggtgctaagaagaaaccgatgaccaaacatcaaagatcaacaaagcgtgatttgtcttactgggagtatgttgatgtagaagcaaagcttcatggtgaatcaaag

SEQ ID NO: 24007 - DNA, 408 bp, Glycine max
  Peptide Sequence Number=SeqID_115692
atgcttcacatctttaataacttagaagttccgttatctttcacaggatggaaatcatattcagcatatgcaggggtaaaagatgctatcgtacaatggtggtatggtcacaatgcagtagcattcgtattaacaactccggttttaggtttgatgtattacttcttgccaaaagcggcagacagaccggttttctcatataaactgtctattatccacttctggtcattaattttcgtatatatctgggctggtcctcaccaccttcagtatactgcacttcctgcatgggcacaggcagtaggaacagggttctctattatgcttatcgctccgtcatggggaggaatgcttaatggtcttcttaccttaagaggagcatgggataaagatttactcaaggtttga

SEQ ID NO: 24008 - DNA, 576 bp, Glycine max
  Peptide Sequence Number=SeqID_115693
atggatcttattgaaaatatggttgcaagtgacattgctattctcagagatagagcccacgtaccaacaaagaaaagtcttctggaatttacatcgcaagatgcattgttggcatataacaagttgttgttcaagcaactggaagcattgaccgaaacactaaggtgtgccatctgtggtggagcacacaattatggctgttgtatccccaatgaagaaccaactcatgaagtcaattatatggggaaccagccaaggcaaaatttcaatgtatgtatgtcaaaccataagagcacagagtcagccattaagaatctggaagtccaagtgggacagctggcaaaaaggttggtggataggccgtcaagcagctttagagctaacactgagaagaatccgaaggaagaatgtaaagctataatgacaatgagcagaatggcaattctggttgatgaaggtagagctaaagaaaaggtggagggatataaacaacagtcgacagctgagctggcactggaactagtttttgattttgttgaacttgaggaagttttggaagatgaagatgaccaatag

SEQ ID NO: 24009 - DNA, 222 bp, Glycine max
  Peptide Sequence Number=SeqID_115694
atggtgccctcaaaagagaatgtcaaggaaggtggaattggtgccgtgtgtcgcaacgtgcccttttgcgggcgagcgaaggcgagactcacgggtgcgctttccaaaggaggaaagatgcgcggagtcgccaccaacgtttatttgtggaaaacgtcgggaaaaccgaaggaaaccggtcaaaatgaaaattctaagttcgggagttgtatttacgcttga

SEQ ID NO: 24010 - DNA, 285 bp, Glycine max
  Peptide Sequence Number=SeqID_115695
atgcctgcagatgcagactcaataagggatattattgttaaaactcaaaatggagaattacaaagaatccatgaattacactctagctatctaggactgcagtaccctttactcttcccttatggtgaagatggatatagacctgacatacttcaccgttctacatctggcagcaaaaaaaggaagagaaatcgtctaacgatgagagactggtttgcttatagacttcaatccaggtcaaatgaagcacaaactttgttgcattctagaaaactattccaataa

SEQ ID NO: 24011 - DNA, 783 bp, Glycine max
  Peptide Sequence Number=SeqID_115696
catgtcctcgccttcagagggctacacgccctcaccttcagaggacttcacgtgctcaccttcagagggctacacgccctcaccttcagaggactacacgcccttgccttcgtagggctacacgtcctcggcttcagagggctacacgtcctcaccttcagaggactacacgtcctcaccttcagaggactgacactgtcctcgccttcagagggcatgtcctcgccttacaggactccacgtcctcgccttgagggctacgtcctcaccttagagggctatacgccctgccttcgaagggctacactgccctcacctttaaaaacacgcttgccttcagagggctacatgtcctcgccttcagagggctacacgtcctctgaagggaggactaacaggaacgtcctccctaaagaggactactgcgccctcaccttcagaggactacacgtcctcgccttcagaaggctacacgtcctcacctttagaggactacatgtcctccccttcagagggctacacgccctcgccttcatagggctacatgccctcaccttcagaggactacatgtcctcgccttcagagggctacacgccctcaccttcagaggacttcacgtgctcaccttcagagggctacacgccctcaccttcagaggactacacgcccttgccttcgtagggctacacgtcctcggcttcagagggctacacatcctcaccttcagatggactacacgccttcaccttcagagactacacgtcctcgccttcggaggctaa

SEQ ID NO: 24012 - DNA, 675 bp, Glycine max
  Peptide Sequence Number=SeqID_115697
atgctggtaggaactttgctctgtggattttcatacgcgatgcttgcttttgattacacaatgctaacgttgcttatttccatgacaatgctatgcgtcggtgaaatttggactttaccttttatgtctacgattacagctttaaggtcaggttctaataataaaggtgcttatatgggattgaacgggatatcattttctatagcttttattgttactccctatgtaggaactttgattgcagagaaactgggatttaaggttttatggttaggaacaggaacccttgctgctcttattgcagttgctttttattttattgttccatggatttcatttttctcttcccaaataagagattcggctgaattgatttcggaagtcaaaatcgatgcctataaaaaaccatcttcatacttacgttcgacaaaatctgttgctgtcattactcaagatcttttgagccagaatacaccggaacggcttctggaatcggttaatcaaattgccggagcaagaatggaagagcgttccccgggaagttacaggatttctgttcggggcagttggagatctacaaaggaccggagggtggagattatggtgcagctacaggaggaaccattcttcttaaaacgagatcttcggaaaatacatcagcaaatatttcaatag

SEQ ID NO: 24013 - DNA, 615 bp, Glycine max
  Peptide Sequence Number=SeqID_115698
atggagaggagtatgattgatgctgccagtggtggagctcttggtgatatgacccctgctgaggctaggaatttgattgagaaaatggcttccaactcccaacaattcagtgcaagaaatgatgctattatccttagaggagtccatgaggtggccatggattcatcttcatctgctaaaaataaaaagcttgagggaaaacttgatgccttagttaacctagtaactcagcttgcaatgaatcataaatctgcacctgttgcaagacaatctggagtcaatgagcaacctgaagcttatgttgcaaacatttataatagaccccctcagcagcaaaaccaacaacaacagaataattatgatctttcaagcaacagatacaatccaagttggagaagtcattcaaatctgagatgggcaagtcctccacaacaacaacagtctgtccctcccttccaaaatgttgctggtccaagcaagccatatgttcctcctccaatacagcagcagaaactgcaacagtcacaacaaagacaacaagcaactgaggctcatcctcaaccttccttagaagagttagtgaggcaaatgaccatccagaatatgcaattttag

SEQ ID NO: 24014 - DNA, 198 bp, Glycine max
  Peptide Sequence Number=SeqID_115699
gcaagcggagggagaactagacgtatcttgctaggcaaagacaggttagaatggatagcttcgcgaggtgccgcgcaatctgctgctgctgggatggatcataggatcagatgtgatctctggtgtctccaccataatgcccagaagccggtggttatgctggaaaaggctattctcgtcacgttcaacgcggggtga

SEQ ID NO: 24015 - DNA, 152 bp, Glycine max
  Peptide Sequence Number=SeqID_115700
atgggatgcccataccaaagcacacacgttctttcgagcaggagtaatcatctcacaggtcgtgacttctacttaggtagtaaacagcgcgctctttcttcccggatcgtcatgtgcccagcatacaccccattgattcgtcagattgtcat

SEQ ID NO: 24016 - DNA, 375 bp, Glycine max
  Peptide Sequence Number=SeqID_115701
atggaggtttgtggtggctactggtggttgtgggtgatggagaaagagcttggaatgttggaagtggttttggaagaaagaaggataagaaatgacgtttttcctaagctacacgaaaagcaaaggctaaaacactcaagtgtttatgctcgcgggaaaggaagcatcgtggacaagtgtcctgtgaagcgacagaccaaatttcaagaagatccaatggttaatgaaggttgggcattgtttttaccgagacagcttcatgtagattccttgagaaacttcattaagaggcttcctcgtggcttctttgagaagcttttctcgagaggcttctttgagaagctagatccttatctacccatacctctctattaa

SEQ ID NO: 24017 - DNA, 390 bp, Glycine max
  Peptide Sequence Number=SeqID_115702
atgagtcatcattcatctagtgttaatggcgagggaaggcataggtcacatcttagacctcactcccatagaagagaaaaggaaagaaagcctcaagaggctaacattaaactctcatacttccatgggaaggacaatgtagaggctaacttagattgggaaataagggtagagcaacaacttaaaaagaagtctacttcaacatcttatggctctcactcttatctaaagaaagaccaaggtcaaggcatcttaggggtgacaccttctaagcccaaagatgataaggctagtatgcaagagaaaagtagctctataaagtgctttaaatgtcttggaagaggacacattacttctcaatgccccaccacaaaaaccatgattatgagg

SEQ ID NO: 24018 - DNA, 241 bp, Glycine max
  Peptide Sequence Number=SeqID_115703
gttatgcatacacggagaagatgcactggcgacatcttggggatatcaatgcgaataagccaagtgcagctgaatggcttgatcaattacccaaacaaaattaggtacaatccttcgatgaggggaaatgagacatatttcaagagcgcacaactcttctctattaaaggtcgacaaactcaggcaatgatcaactccggttcacagtattctgaagtcctctctgatgcaatgaatagcg

SEQ ID NO: 24019 - DNA, 399 bp, Glycine max
  Peptide Sequence Number=SeqID_115704
atggatgaatactttagggtgtcaaattgcaagagtgcaaaagatatgtgggataccttacaagttcaacaaatttctaagaaacaaaggaaatcaaagaaaagagcagaagattcatcctctcttccaaaatgttatgaatgcaatcaaccaagacatctaagagttgattgcccaagttttaagaaaagaattgaaagatctgaaaagaaatctttcaatgataagaaagcaaagaagccctacatcacttgggaagacaacgatatggactcatctaaagattcagaaaatgaagttgtgaacctgagtctgatggccaaaaattatgaaagcaatgaagaggtaatcgattacaggattagtgtaatccattacaggtttaacaatttgaattaa

SEQ ID NO: 24020 - DNA, 291 bp, Glycine max
  Peptide Sequence Number=SeqID_115705
atggtggtggagcttcttctagactcatctctccttgaagtggcatctcctctctctcttccttctccattccgcttccattcatctttcaagaagcaaaggaatccattgatgaagaagatcctaggcctacaagctctaatggagcttacatcatttgatttcagagctcttttgagcacaaaatttcgtgctcttctctccctctcccttcattcatctccttcttctccaagctctatccatggctcctatggtggtggagcttcttctagactcatctctccttga

SEQ ID NO: 24021 - DNA, 420 bp, Glycine max
  Peptide Sequence Number=SeqID_115706
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccctgagtgcacaaatagagaggtgacttgctttaactgccaagtcgggaaacctgtcgtgccagctgcattaatgaatcggccaacgcgcggggagaggcggtttgcgtattgggcgctcttccgcttcctcgctcactga

SEQ ID NO: 24022 - DNA, 549 bp, Glycine max
  Peptide Sequence Number=SeqID_115707
ctgttccagcagccgcatgacggtgtgaccggggtgaacaccggctatgacgatctcaacaagaaaaccgccggcctgcagccgtcagatttgattatcgtcgccgcgcgtccgtcgatgggtaaaacgacctttgcgatgaacctcgtcgaaaacgcggcgatgttgcaggacaagccggtactcatctttagtcttgagatgccctccgagcagatcatgatgcgttctctggcatcgctgtcgcgcgtggaccagacccgcatccgtaccggtcagcttgacgatgaggactgggcgcgcatctccggcaccatgggcattctgctggaaaaacgtaacatctatattgatgactcctccggcctgacgccgacggaagtccgttcccgcgcgcgccgtatcgcccgcgagcatggcggcattggtcttatcatgatcgactaccttcagctgatgcgcgtgccgtcgctttccgacaaccgtacgctggaaatcgccgagatttcccgctcgctcaaggcgttagccaaagagctgcacgtgccg

SEQ ID NO: 24023 - DNA, 735 bp, Glycine max
  Peptide Sequence Number=SeqID_115708
atgacaagctatggttctgaaagaatcactaataaaattccacatctagaagcccatttactcagaaatttagacaaaaatggaattgtgatcctcgggtcgtgggtagaaacgggtgatattttagtgggtaaattaacacctcaaatggcaaaagaatcctcgtattcccccgaagatagattattacgagctatacttggcattcagaaacgtgaaattaaagtaggagataaagtggctgggagacatggaaataaaggtatcgtttcaaaaattttgtctagacaggatatgccttatttgcaagatggaagacccgttgatatggtcttcaatccactaggggtaccttcacgaatgaatgtaggacaaatatttgaatgctcgctcgggttagcaggagtggaacattatgcacttgtttacacaacaacccacttagaggaaagggccaagcagggaggacaacgggtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaaggaagcttaa

SEQ ID NO: 24024 - DNA, 213 bp, Glycine max
  Peptide Sequence Number=SeqID_115709
atggcggcgcagctaatccgtgatcgagtagagatggagtgcctagagggagcttgggagaccctcgaaggcaacacgaggtgccgatttcggggcaccattcgattcacggctacatctttggtgcatccagatgaacctgcacggacgcttcagcgcacggtaacgtcatccgaggaagaccctgaggaggatcttgcggggatcctctag

SEQ ID NO: 24025 - DNA, 774 bp, Glycine max
  Peptide Sequence Number=SeqID_115710
atggcatatttttcttcatggcattacaatattttagagaattattggcaattgaagaaacatgtgcctatcgaagaagagtttgtttctcagatcagaaattcatccatactgagaaatgaggattatttttcttcatgtgctatgctatctcttaatgtcaaggatcctcgagaattgccatggaagaagactgttgttctagtggagtccatttcaactaagactccgagtgatgcagaagaaaagaaatacaaagaggttgctgaattgggaggaatattggaagagaatagagatttatcttcattatcaagagggttgaggcctctagtggaagacagttatctttctaaggagaaacaccatgaacgtatggttaatttctgccttgatgatatacattctggagaggccaactcttcaactaaggtgcagtgctcgagatgttgccctattcttcttttaaaaaatgatatgaaggaattgactataggatggtctgttatacttcccttaagctgggtcaaagccttctggattcctctcatctctaatgggggtttgggggatggggggtttaggatttggggtgcattcctctcatctctaatgggggttgggggtgcattcctctcatctctaatgggggttgggggtttaggattgggggtggcgggatgggggtggggggatggggattggggattggggtatagggattggggattggggattagggtttggggtttggggtttgttggggtttattag

SEQ ID NO: 24026 - DNA, 795 bp, Glycine max
  Peptide Sequence Number=SeqID_115711
atggctgaagctcattcgatctcttctcccatggtttctaactacaaattgtctaaacatggtgctgatgtttttcatgatccttctctctatagtacatatctgacatgcaagtgtttgttaatttccttgaaggcaaaagagatcgatcgatcagttacgatgatgaacgataaaagtgagtccaaaacagaagagatgaaagggtggagaaaagttatagaaaatgtaggtaattggctggcaaacaagaataaggatgaatggttgaaggacatgagggggaacccgagtttggcagcaacactaatctcaactttgacctttcaaactgctattaatccaccaggtggtgttaggccagcaaaagagagtggacatgtgttatgtccaagatcagaagacatgttagatgggaagaatccatgtccaggagaagccatccttgctgttgttttcccagacaaatatttcaaattcctcttatggaacactatatgcttcgtttcatccttagctgtttgtctcttgcttgtgagtgggttccctctgaatcaccgattcttcacgtggcttttgtcaatagggatgtgcctcaccatcaccagcctcactcttacctacatggttggtgcagaaatggtcaccccatatctcatttggagtacaaccaacaccatgtttagtaaagttatttatatttggattacactgctaggactcgtcactcttgtccttttcctacgcctgtttgtttggattctgattaaatgcagtgacaaacgtaaacggtga

SEQ ID NO: 24027 - DNA, 1894 bp, Glycine max
  Peptide Sequence Number=SeqID_115712
ttcttttgctgccttgaaagattttggggatgttggttctgttgcttatgaagatggggcagcagaatttgatgttgcagataggaagaggagaatgagggctgaacagcaagtcttgggaaggctgtgggtgaggatgaatttgcaacaaattgggcagcctaaatcatctaatggatatggtcatcagaaatctgaaaaagaaggggcaactaagtctgataataagctcccatctgtaaagtcaaattctagcagcagattagcaggagtagtgactggcaataaaggtggtggttatgggagtccttcacatgatcgattagtatatttaacaacatgccttattgggcagcatgtggaagtccagaatttgacattttttactgcttatgtcatcattactgttctcttaggaatcattttgaaaatggctcgcttgacaaaggctgcctctttgcaaggacagggatctggtgtagaatttgtcagcgaagctccttctaagactttaattatacctgccaacgaccttgcacaagttatagcaaaggatgttgctgtttccagagatggcctacctagtgaatctcactatgatatgcatcacgaaatcatggttgattcagtaatatctcaatcctgtcatgttgagacagggagagaattacagcgatgggtacctgatgaagatgatcaacaatgccctgaactggaaaatatctttgatggcccttggaataggggatgggatcagtttgaaacaaatgaaatgttgttcggtgtaaaaagcacattcaacgaggatttctatacaacaaagcttgaaatagggccccagactagagagttggaaaagcaagctttaagaatagcaagagaaattgagggtgaggaaacacaagatcttcatctagcagaggaaagaggcctttaccataactttgatattgatgaagaaaccagattctcttcagtctataggggtaaaggtgttgatgatagtggatatgatgaaaatgaggacaggctcttggattcacataattctgaaacttttgataatatttatggtttagtcaataagagcccaggtgaagcaagtggtcggaaaggcagtaatggagctcaaacgtggtcaaatttctcctctgtgaatcactcagagttatctcagtcaagttctggtgtggatttatgtcgctctggttctaaagatcatgctaagcagttatcatctgaactccctgccctgagttgctcattttcagatggagaaagcagtgcagatttacagtcatcacttaagttgaagaaagatggctctgatgaagggggtttatctactaatgtggccttgtgtgccccttctactcgtattttatcaaagactcctaaagaaactgggtcagttggggaatcaaagtctgtaatttcacgtggaagactaggtagatcattgggttctgattatgtggcagcaacctctggtcctggtctatcaccaagttcttcagttggttcactgtcttcggaaaaatcaactctgaatcccaatgccaaggagttcaggctcaaccctaatgcaaagagttttattccgtctcaatcacatgctaggccccgctcccccatgtctgatggttccttctatttcccagctactgtatccaccataccaaatatgccagccatgtccatgggtattggagttgggactacttttgcagggccacaaccagtcgtatataatccacaagcggcacaaatgccatcccaaccatattttcatccaaatggaccacagtatggacaacttcttggtcatcctaggcaagttttatacatgccaagttacctccctgagatgccatataagggacgggatcattga

SEQ ID NO: 24028 - DNA, 1296 bp, Glycine max
  Peptide Sequence Number=SeqID_115713
atggacaagtgggacaataaaccctcaagaaaacagcaccacagagaaaacccttcattctcttccactcttcttgacgttatctaccgttccatcgacgaagatccaacggaggagaaggaagaagcccaactcatcttctacagagaaaccatgaggaagcagaaacagggcaattgtttcagagaagaaaaacccgaagctgagaagcacaactctcgcagggccaggaaggtggagaattggatggagaagagagccagcgagaaggttctcatggggagaaactcactgacggaatttgaaagaagaacgcgaagcaattcaatttcaaacacactctccatgtattcaagctcaacctcctctgagtctagctctgttggagggttctcttcttcagagtcagagtccttctattatggagtgcaaaggccaaagccaattaaaaccagtgtttctgataaaaccaaaaccaaaaccaacttcgatgcttcactccacagtcacaacttcaggagccactcttcccaaagccaaaagccaaagcatgagaacggttttggcaaaaccaagtccaaagccttgaaaatcctctatggtgagttgaagaaagcaaagcaaccaatttcacctggtgcaaaacttgctagcttcctcaactctctcttcacttcaactggaaatgccaagaaagcaaaggtttcaacaacaacaacatctacttatcgtcccgtcctgatcccgattgcgacagatcgtgttgctgatactaaatcagtatcagcagcacaacaacaacctggttccacttgttcatcagcatcttctttttcaaggtcttgtttgagcaaaaccccttcttcaagatcaggtgcaaaaaggtctgtgaggttttgtcctgtgagtgtgatagtggatgaagattgcaggccttgtggtcacaagaatcttcatgaaggtgaagagagtttggtggattcccgtggaaagaacagaagtgaggaacttaggctgcatgtcatgcaggagagtcgcagggtggaggagttagcaagagacttgttgaagaattatcagaaaaagagtgaagtggagtttgatgatgtcatgcattatgaagatgaagaagaagaagaagatgatgatgatgtggctagttgtgcaagttctgatctttttgagttggataatctatcagctattgggattgagaggtatagggaagagttgcctgtgtacgaaactacccatttcaataccaatagagccattgccaatggtttcattctgtaa

SEQ ID NO: 24029 - DNA, 435 bp, Glycine max
  Peptide Sequence Number=SeqID_115714
atggaagtcgtgtctgagttaatgggagatgccattgatgatgctttggaatatgatgaagagacggaagagcttgtgaataggttcttgatgagattggaattgacgtcaactcagagtgcggcacagtgggcatccaaaatgagaggcaagccacttataaatgcaagaggtgtggaagatgtgcctgcaagtgtgaagcttccatacactgtcctcttcttcaaaacttgtcaagcagataacacattcagtctgagatcacgtgtgattggtaatgcaccatccgagcttggtgagagtgaaaaatgtgaaagaaattaccagtgttccagctatgagaagcccaggccgtgtcatgatatggttggcgataactatgagcacaacaacaaccatttcggtctcaacaatgctggaggctggagcatataa

SEQ ID NO: 24030 - DNA, 453 bp, Glycine max
  Peptide Sequence Number=SeqID_115715
atgaacgttgaaagcgagaggaaagatgaacaagaggtgaaagggtggagaaaagctttaaaaagtgtagggaattggctggcacataaggataaggatgaatggttgaaggacatgaggggaatgctgagtttggtgtctacggtgatcgcaacaatgacctttcaaagtgctttaaatccaccaggtggagttagacccggaaacgagagtggagttgttcaatgcccagtaaacaaagcagataataatccatgtcccggagaatctatcctagctgttgtttaccctgatgaatatgaaaaattcctcatttggaacacaacatgtttcatttcatctttagcagtggatgtgcatcaccatctccagcctcactcttacctacatgtatggtgcgggaatggtcaccccggataccctttggaaatcaaccgcatcatccttgtttga

SEQ ID NO: 24031 - DNA, 456 bp, Glycine max
  Peptide Sequence Number=SeqID_115716
atgatccaccatctacccacgaccttcctcaaccaattcaagccttactccacaaattcagcctattattccaaaaccccacaccaccttcctccgtcgagggacaccgaccaccacattcatcttctacccaacactgccccggtgaatgtgaagccttatcgttatcctcattatcagaagcgagaaattaagactcagatgtggaaaaggaggtacaacaagcaaaaaggagcagaaataaaggaaaaaaagaagaagaaaataagaaaaaggcccaagcccaagtttgcacctataaataagagggtcagcctaggaaaaagaacacacttcctaggagctcagttttcagacctctggcactcagttctctccttttccttttcttatattcctatttctttctttcacccctcctctcattgtaaagccctcatgaccatgagtggctaa

SEQ ID NO: 24032 - DNA, 1026 bp, Glycine max
  Peptide Sequence Number=SeqID_115717
atggcgcatctcaacgtcatcatggtcaccgacctccttctctcccaatccggtttcgccaaccactatttcagagaatactacatgtccaaattctttcggcttcttagaatcattattcagaaatcgttcgaggttctgagccccgatttgcttctggtgctgggcgacgtctccgcgggaggctcggagctaacgaggagcaagtgggtgtcggttctgcgtaggttttacaaagtgttgggcccctttgtcggcgacagggatgtcggagagtgtggggacatcgagggtaacagagttggttggattgcgaacaagttgcccgggttggactctgctggcttcgccgcgcttgagattgggaatgttagttttgtgaggccgaatgcggtggctttgctctgtgggaatggtggttgcttgcggtttgaggtggagaaggtgattgagagggagagcgtgggaacgagaatgaatggttctgacgaggatgtgttgtatggattggggcctgtggttctcctgcatttgcctttggaccaaacgagggatgaacactacgctggggttggtcattttaagagatcttccaactctttcatggatgagttaaatgtcgtgccagaaagcagggaggtcattggtggcggcctgtataagttgcatcataccctgcctcttaatgcttctgagtacattttacaagctctgaagccaaggactgaactcgcgagattaccgtaccagcaatgtcatggaatgcaagagatgaccctggatttgtgtttgccacttttgaaaagacaggaagagcagatagcagcagggaagattatcctccccaaacgaacaaacaaacaaaaaaggaccgtaggaaaattaccagagaaaaagaataggatagtttttgggaaagctgaattccacaatattgttgaccccaccaattttcaaattgaagagatgttttgccgtgataaacctggttccatctcaagatgcactgaatctgtctcaagatag

SEQ ID NO: 24033 - DNA, 1716 bp, Glycine max
  Peptide Sequence Number=SeqID_115718
atgagtaactggttggggttctctctcactccacacttgaggattgatgaagaatttgagagagaaaaccaagagcgtggaggagggtaccatcatccttctccttcttgtcaccctcacttgtctgttatgccccttcgctctgatggctctctctgtgttgctgactcctttagtcactctgctgcatctcaagaatggagatatgatagtgcaataggtggagggaattccaatgaagaaggtccaaagcttgaagactttttgggttgctactcaaactcccccgctaaggtcttttgccaagactctcagcctgaccaaaaccaaagccagaacaatgtttccaaaatcaatgttaatgtggcaccaagcttttgcaccaacaattcagagattgaaactggggataatctcacaaatccttcttccttgctccattctttccatgcatataatgataactcacatgctcttatccccaccaatggcatgtacaagtcctggttggcacaaacccagttttcttctgatggaaaaccttcaaatgaggctaatgggtgcaatttccaatctttgtccctcactatgagccccagtgtgcaaaatggggtgggtgcaatttcctctgttcaagtgaatgaggatagtaggaaacgggtcatggcgaaatctcatgctagagaaccagttcctcgcaaatctattgacacttttgggcaaagaacatctcaatatcgtggtgttacaaggcatagatggactggaagatatgaggcccatttgtgggataatagttgcagaaaggaagggcaaacaaggaaaggaaggcaaggtggttatgataaggaagaaaaagcagcaaaggcttacgacttagctgcactcaagtattggggtccaacaactcacataaatttccctttaagcacttatgagaaggaacttgaagagatgaagcacatgaccaggcaagaatttgtcgccaatttaagaaggaagagcagtggattttcaagaggggcatctgtgtatagaggtgtgacaagacaccatcaacatggaaggtggcaggcccgaataggaagggttgcaggaaacaaggacttgtatcttggtacatttagcacacaagaagaagctgctgaagcatatgatatagcagcaatcaagttcagaggaacaagtgctgtgaccaactttgacataagtaggtatgatgtgaagagaatctgctcaagctccactcttattgcaggagatcttgcaaaacggtctcctaaagaatcaccagctccggttcctgcctctgacttcaattcgtgcggttcatcgccgatgccgctggtgtctcagccacctcctttggctataactgatggtgaacattctgatgagttgtccaacatgatgtggaatgccaacaacagtgatgagcaagcacagaatgagagtggtggtgctgaattcaacaacaatgtaactgaatcatcatcatcacaacaggtttcaccaagcagcaacaaggatgctttgaaccctcaaagccccaatgagtttggagtcagtggagcagattatggacatggctacttcacccttgatggaccaaaatatgatgatgggaacaatgaaaatgaccacatgagcaccaacaggcttggaaatttgggattggttaatcaagttcccatgtttgctttgtggaatgaatga

SEQ ID NO: 24034 - DNA, 744 bp, Glycine max
  Peptide Sequence Number=SeqID_115719
atgtcttatcccactggaagggatcatgtgccttttgttctaattgatgttggacggcggccaaatgctgagtatgttgttgtcaacatggatggatcaagacatccattacctctgacaaccgtttatcataaattgcaaccaataaatgcttctccttatactttcttgcaagcactttttgggcatgaatatccggttggactactagatgaagagaaaattcttccattggggaaggatatcactgctgttggccattgcagtttaaaaaatggaattgctgaaattaagtcctgcaaagatataccatattttttgtctgacttgagtaaagatcagatgatagtagatctttccatcaaggcgaaaatactgttttggggtggtatttcacttggttcgatgtcagttggggtacttggctatgcagttttgaggaactggattaagtggaaacggtggaaggtacagaggcagctccagcaacaaaggcaagcggtgagtgatgctgaacctcaggtggatgatgagattgaagatgttccagatggacaattatgtgtgatatgtctgatgaggagaaggcgttctgtcttcattccctgtgggcatcttttgcacccaaatgtcctgtttgtcgtcaggagattcgagattcagtgcggacttatgaatcttgaacagacacagactgatttttctgttcactctgcggcaggaaacttttatgactgctattga

SEQ ID NO: 24035 - DNA, 1953 bp, Glycine max
  Peptide Sequence Number=SeqID_115720
atggctactgcagcaggtgcagctgcccttttgtactacacattgaatcggaaattgcagactcacgatgcaatcgacgaagatggtgaagaaaatgggagtgatacgcccactgatacgccattaggtattggccgtgtttctcatcggttaatccaagcccctgcaacatggttggagacaatttcaacattgtcagagactctcaggttcacgtattcggagacacttgggaaatggccaattggggatttggcgtttggcatcagctttcttctaaagcggcaggagagtaatatggctaagggagactatcatgttgacagtgaattttgtggtacggacagtgtacagctgaaaggatctgagattactgctgaacttaagtatctcttaaacttgttgacattgtgttggcacttttcgaagaagccctttcccttgtttttagaagaaactggctacagtgaagaaaacgttctccttcgagaagccaaagcaggaattttgaaaccagcttttacaataatagctgatcatgagatgaaatgccttttgttattgattcgtggcacacatagtatcaaggatactctaacagctgttacaggaaatgtggtaccatttcatcacactgttgttaatcaggggggtgtcagtgatttggttttaggttatgcacattgtggaatggttgctgctgctcgatggattgcaaagctcgcaactccttgtctccttgaagcacttggtcactaccctgactataatgttaagattgtagggcactctttgggtggaggaactgcagcaattctaacttatgtgttgagagagagaaaggaactgtccgtcgctacatgtgttacatttgctccagctgcttgtatgacatgggagttggcagagtcaggcgatagttttattacttctattataaatggagctgatttggtgacagcatcagcatggataaatgacttgaggaatcaaattgagcaaacaagaatactcagtactgtctatcgttcagcttcagcattaggttctcgcctcccatcgattgccactgctagagcaaaagttgctggggctggggccattttgcagccagtttctaatggtactcaggttgtgatgaagagggccaagagtatggctcaagcagcatgggcacgtccaaaccttaatttgtcctcttggtcatgcatgggacctcgtcgcagagtcatgagtgctcattactccagagatgggggaagttcccctacatcctcttcctctaccaacattgaaagttccgatccccttcttggttctcccacaaaggcgattaatgcaaagaatatgaaccttcctgtatcttcatctatagaagagtggtcttctgagattgaatgtggcaatggaagtagttctgatactgaggtggatgttgatcatgatgacagtctgaacatgatggaccgtgacagatatgaggatcagatgagtgaagtggagttgtggcatcaactggaacatgagctgtatgatagacctgaaggtgaggagactgatgttgcaaaggagataaggaaagaggaagcagccatagcagaggaagtagggcaaatccagagctctgcaccagaaataaaagaaatccacagatttttccctccgggaaagataatgcacattgttacactccactctgacactgctgagcaggaaagtgatggtagccgaacctctgcaagttcagacagtagcgagctaaatgagactgagattgggatttttctaacttcaaggtctctatatagtaaacttagactttcacagagaatgatcagtgatcacttcatgccagtttatagaaggcagattgaaaggctaataaaagaactcgaggaagaatctaatgagggtcacaatacacgaggtagtgctatagtcaaagacagataa

SEQ ID NO: 24036 - DNA, 192 bp, Glycine max
  Peptide Sequence Number=SeqID_115721
atggggaattatacggcaaaatctgcatatattcaagataatttcgacgaggccgatgcaaaaagaacgcatgtgagaacacgtgtgtcaccggtgcagaaggttgcattgattactgtgataggctgcacggcgacgatggatttgccgttgtgggataaaaacttgtctaatatccccaatttccagtag

SEQ ID NO: 24037 - DNA, 2748 bp, Glycine max
  Peptide Sequence Number=SeqID_115722
atgggttcttcattgctagagaggtccatgtttgttccttcttcttcttccccttcatcattttttaactcaactcggttcttagttcctttggagaacaagagagttgtgaggatgaagagagctgcaaagtttcctgtggcagctataagtgaggatttgatgaagggttcttcttcttctccttcatcatcttcatcctcttcttctgtgtctacagaaaaaccagtgaaattcaaagttagagctgtgatcacagtgaggaacaagatcaaagaggatttcaaagagaccattgtgaagcatattgatgctcttactgacaggattggaaggaatgttgtccttgaacttgttagcactgagattgatccaaagaccaaatctgcaaagaagagtaatgaagcagtgttgaaggattggtcaaagaagtccaatcttaaggcagagagagttaattacacggctgaattcatagttgactctagttttggggagccaggagctattactgtgacaaacaaacaccagaaagagttcttcttggaaagcataacaattgaaggatttgctagtggaccggttcatttcccctgcaattcatgggtacaatcaagaaaagatcttcctggaaagaggattttcttttccaataagccttatttacccggggatacacctgctggacttagattattgagggagaaagagctgagaaatcttagaggtgatggcaaaggagttagaaacttatctgacagaatatatgactatgatatatacaatgatttggggaatccagataaaggaattgaacttgccagaccaaatcttggaggatcagatatgtatccatacccaagacggtgtcgtactggccgcgaaccaagtgatacagatatgtacgcagagagtcgtgtggagaagccactgcctatgtatgtgccaagagatgaacgtttcgaggagtctaagcagaacacattcactgtgaagaggctcaaggcagtgctgcataacttgatcccaggtcttaaggctagcctttcttctagcaaccaagacttcaatgaattctctgatgtcgatggcctttacagtgaagggttgctcataaagttggggtggggcttgcaagatgacgtgttgaagaaaatcccatttgtcagcaagatccaagagtccagccagggacttcttaagtatgacacccctaagattatttccaaggacaaatttgcttggctgcgagatgatgaatttgcccgtcaagcaatagcaggagttaaccctgttaacattgagaggcttcaagttttcccaccagttagcaaactagacccagaaatttatggcccccaagagtctgctcttaaagaagaacatattttgaaccaactcaatggcatgaccgttcaagaggcaataaacgaaaacaagctgtttatgattgattatcatgatatatatctacctttcttagaagggatcaatgcccttgatggtaggaaatcatatgccacacgcaccatctttttcttgactccacgtagcactctcaagcctgtggctatagaacttagcctccctcacgctggacctaattcccgatcaaagcgcgtggttacacctcctgttgatgctactactaattggatgtggcagcttgccaaggcccatgtttgctccaatgatgctggggtgcaccaacttgttaaccattggctacgcacacatgccaacttggaaccatttatattggcggctcataggcaattaagtgctatgcatccaattttcaagttgttggacccccacatgaggtacaccttggagataaataccttggctagacagagtttgatccatgctgatggaatcattgaaaattgcttcactcctggtcgctatgccatggagattagttctgctgcttacaagaacttttggcgctttgacatggatagcctccctgcagatcttatccgcaggggaatggcagtagctgacccaacacaaccacatggcctaaaactcatattggaagactacccttatgcagctgatggaatactaatatggtctgcaatagaagactgggttcgaacctatgtgaaccattactaccctcactcaagccttatatgcaatgacaaagagctacaatcttggtactctgagtcaatcaatgtaggccatgcggatcttaggcacgaaaattggtggccaacattgaacaatagtgaggatcttgtgtccattctttccacattgatttggaatgcatctgcacaacatgctgctctcaactttggtcagtacccttatggtggctatgtgcctaatcgtccaccactgatgagaaggctaataccagaagagggtgatccagaatatgcaagtttcattgctgaccctcagaagtatttcctgaatgcattgccaagcttgcttcaggccacaaagttcatggctgtggttgacacactctctactcactcacctgatgaggagtacttgggtgagaggcaacaaccttccatttggtctggcgacgctgagattgtagaggcgttctacgatttctccgccaaggttcaacagatagagaaggtgattgatggcaggaaccttgataggactctaaggaaccgttgcggtgcaggggtgttgccttatgagttgcttgctcctagctctgaacctggtgttacatgcagaggggtgcctaatagtgtgtccacataa

SEQ ID NO: 24038 - DNA, 325 bp, Glycine max
  Peptide Sequence Number=SeqID_115723
atgaggattccctccattgtctacgagattgtccccatttctaggatgtgcatgaggttctatcaccgatccactttccttgtgcaggatatcctcacttggattaaatctcaagatagtggagcttggggtacctgtatcgcttcgatgtggtggatttggaagtggagaaacaatcgcatttttaatgatgataaatggaatctgcagcatgttctgagggaatggatcactggtttcttttactttgacgggtcaggggatagcacagaggcagagatcttagccttgattcatgggctaaaaggcttacaccccctctgct

SEQ ID NO: 24039 - DNA, 90 bp, Glycine max
  Peptide Sequence Number=SeqID_115724
atgaatgaaaaagcggaggcaccaggcggtgatttcaagaagttcacgaggagaaaatcgtcaacagtggagagtgccgataatacataa

SEQ ID NO: 24040 - DNA, 573 bp, Glycine max
  Peptide Sequence Number=SeqID_115725
atggctcctcaaaacaattttcctttggaatcatcgattctaactcataagctattagctggaagctctatgtttggtgagctgaaatttgtgaataaagtccagttgaaaagggaaacaaaaacgtcatttgcactctctggtggcattgacactataatctcttgctccacggctgagctagaaactctgaaaattgtacaaagcacaattgcgaagcagctttttattgatgaagccactgttgaaatcatgatggctttggaagagaaatttgagatttccattggagagggtggagctgagaacatctccaccgttcaagatgctgctgatctgattgagaagggggagcgaggggtggtagatccagaaggagaagaagaagcagaggtggtggtgcttccgaaaccagactgggaccgaacaatggtgatgctgcgacttatcggaactgcctccgccaccgttgaccggacggagattccgccggagaacgaattgtactttcggagcttccccagacccgtttccggtgccggacccgccagcgtttcgtcccaaagcttgtga

SEQ ID NO: 24041 - DNA, 615 bp, Glycine max
  Peptide Sequence Number=SeqID_115726
atggtgataagcaaaaagcaattaacttttattgttgtgtttgattttgtttggatcagactcttgaggcattttcagccccaacagggaaaaccagcactatgggagctagattcagatcagcattacactgtcaagaaacatggcctgtatttagccgatgacagcattagattgtcgaggctaaccctttattttggtaggtcaactattaaaagatcgctatcagatggtaacattctcagtgaaagtgacactacaattaggaacttgaatgttacaaatggtcagaactcgtctgaaaaacctgataagcgtttcctttcggggtctactccagatatctttacctgtggaagtgatatttgtcattgcaggcaatctggggtcatgagtaggagttctaggaggaatcatgcaattaactgggacatgcattgtatggcactaaggcctgtaaaggagggtggatttggccaatggaatctggtgtctaaaaatatttatggatggaagggagggaaaggtgaggtttcaagcaaacctcaccagtgtctggatttttttaatgaggggttattgtgcagtgcagcccctggaaaccctctcttttaa

SEQ ID NO: 24042 - DNA, 966 bp, Glycine max
  Peptide Sequence Number=SeqID_115727
atggccaaaaacagtactaccttaagtgcctgcctagaaggagaagcttcggcaatttcaaggttaaataataatgcttttcccaaaatgcttcacgagctagagaaacagctaaagggattcaaatactcaattaccgagttatatggtgcacttactgaattaaaatatgagagtgctgctgagcattttgccaagttaatgtggagtggaaatagagatgtcactgtcactgagtatgcagagttgccactaattccaccatacttgcatcctggataccatgatcatcaatacatttatggggtgaattttgcatcttccggagctggagatttgcctgaaactaatccaggactagtgattgacctgaaaactcaagcactgtactttgcccaagttggcaagctattgaggaaaatattaggagaagagaaagccaagaaattgttgtccacagctgtctatatcttttccgtgggaaccaatgactatgcagtccctttctatacaaactccaatggcactgtggttcttccataccctcaacaaatttttatagacttagtcatttgcaacattacaacagcaattaaaggaatttacaatgaaggtggaagaaaatttgggtttgtaaatgtggctcctctgaatcgctctccgtttctaaggacatttgtaaatggaacaacaatagatgcttgtcttaaagaacaaggttccaaagaggggaatgttgcttgttgcggaggtgggccctacatgggagattatagttgcggagggaaaagggagattgaagaatatgaactatgcaacaatgttgatgagtatgtgttctttgattctcctcatccaacggagagtactgctgaacattttgcccagttaatgtggaatggtaacaaagatgtgattgacttttacaatctcaagcagttgttccatgttgaatctatcagctag

SEQ ID NO: 24043 - DNA, 144 bp, Glycine max
  Peptide Sequence Number=SeqID_115728
atggcgagtttccacaagtatatcagcatgcaagatgtggcaagtattgcgaggaaaggaggcggaagggatttcatatcgttcaagtccaaaataatccacacagtgagttggagacgtgtttttttcgtagtggaatcttga

SEQ ID NO: 24044 - DNA, 312 bp, Glycine max
  Peptide Sequence Number=SeqID_115729
attatcctttatgttgcacaaaggggaagtcatgcagatttgaaacatgacacgccaaatgcaagaagtggggaggtaaaatctcttggaagtgtccgtactagtcactcatcagaaaatggtttcaataagcattttggtcgtcgtggaccatcacatggggtaaaggatgttgatggctattcagtttcaagtgaagggaagcatcctagaagatctagtacatctgcttatggttccaacgaggtccctaaatttgatttctccatggcagtacacggcatattcttttctggttcaataattgattaa

SEQ ID NO: 24045 - DNA, 480 bp, Glycine max
  Peptide Sequence Number=SeqID_115730
atggctattattgatatactgcaggtttttggtgagaaagcttttgagaaatttggaaaaggtttaatttcattgcatttctccgaccagcaccctggtatacacaaaaagatattgttgttcaagtttgtgcttccagctgctaaggacatggctgatatgactcgactggtggctcttgttccgtattatattgacttgatcggacgatacaaattaagttctcaggtggggaagtcatgttaccaagctcggtctaaaacagaggctgcacgacaaaaggctgctctagaagcacagaaagaactccgaaatgcgcagcaagaagccatgcagagaagaaaagcagagaggaaaaagatggtggaggaggctgaggcaaagctcagtgcagaggctgttcgaaagaaagaagcaaaagagcgtgctcgtcaaatgaagaaggcaatgccaaggatgaaaatgtctcgtggtgcctaa

SEQ ID NO: 24046 - DNA, 1338 bp, Glycine max
  Peptide Sequence Number=SeqID_115731
atgacagagggtaacattgcaagatggttgaagaaagaaggtgatagaatctctcctggtgaagtgctctgtgaagttgaaactgataaagccactgttgaaatggaatgtatggaggaaggttttctggccaagataatccgtggggatggggcaaaagaaattaaagttggtgaggtaattgccgtaactgttgaagatgaaggggatattgcaaaattcaaagattaccaaccttcagcatctgaaccaagtgaaccccctgccaaagaaacatctgccccacctccaccaaagaaagaagaggtggtagaggagcctgcccgagaacctgagccaaaggtttctaaacccagtgcaccaccttcatctggagatcgcacatttgctagtccccttgctcgaaaattggctgaagagaaaaatgtacctctctctagcattaaaggaacaggacctgaagggctcattgtcaaggccgacattgatgattacttggcttctggtgctaaagaagtttcggcatcctccaaggccaaggttgcagcagatgcagcattggattataccgacattcctgtctctcagatacggaaggtcacagcttcacggttattattatcaaaacaaactatccctcattactatttaacagtagatacatgcgttgataaactcatgagcttgcggacccaactcaattcattgcaagaagcctctggtggctctcgcatatcagttaatgaccttgtaatcaagaacttcatgaatcttagcttaaaacgattcaaagagcattacagtaatatgtgtccccattgtgaacggaaaagtcaggctgctgctttggctctccgtaaagttcctcaatgtaacagttcatgggcaaatgattatattcgccagtatcataatgtgaatattaatgttgctgtgcagacagataatgggctctttgttccagttgtcagggatgcagacaagaaaggcctctctaaaataggggaagaggtcaaacaattggcaaagaaagccaaagaaaacagcttgaaaccccaagaatatgagggaggtacatttacagtgactaacctgggagggccatttggtgtcaaacaattctgtgcaatcatcaatcctcctcaggcaggcattcttgccgttggatctgctgagaggagggtcgttccgggttcgggtgctgaagaattcaagtttgcttccttcatgtctgtgaccctcagctgtgatcatcgtgttatagatggtgcaattggtgccgaatggttaaaagcattcaaaggctatattgaaaatccagagaccatgttgttgtaa

SEQ ID NO: 24047 - DNA, 249 bp, Glycine max
  Peptide Sequence Number=SeqID_115732
atggatgatcaaatagatggtagaacattagttggggcttatgtcagtgcagataggcctggggagtttagatggcaacctgggtcacttacccaggctgtgcagaatggtttgtggatagtttttgaggatatcaacaaagcaccatctgatttacactccatattaatgcctttattggaaggggctgtttcatttgcaacaggacatggggaggtggttactttactttgcaaccggcatggttaa

SEQ ID NO: 24048 - DNA, 426 bp, Glycine max
  Peptide Sequence Number=SeqID_115733
atgttaggtggtggtgaacatcaattggatggggcacaaagattcttgttggatgctctcaatgctcaaatgcaaagactattgagagagaacaacaaggtgttgtatgaaagaattgagcgattagagaatcgtgaacgtcatgaggaagaaagggaaggaggaaatggtggtggtccaaggccaaaccgaattgaaggagtcaagctcaacattcctccctttaaaggaaaaagtgatccagaggcatatttggagtgggagctcaagatagagcatatcttctcatgcaacacctatgaggaggcccaaaaattgaagctagcagccgcgaattctcagattatgctcttgtgtagtggaataaattgcaaagggagagagctacaaatgaggagcctttggtggaaacttgtgttgacatga

SEQ ID NO: 24049 - DNA, 480 bp, Glycine max
  Peptide Sequence Number=SeqID_115734
atgtcttcaagacagatactcaccccaccactagagaatgagcttaccataagaaaggatatataccaacagatcgagaaacatagaatctgtggtcactacaaggaggttcgtgcttccaagttgcaaggtgctcaaggtggtgacttttggtccgttggtgttcgcaaggtgcttcgtgctcccaagataagttgttgtttggtggacctcaactactgggactctattagtactcttgttggggaagtggttctaggctattgtttcccccttttggttgccactagtgttgttcctctcaatagggagttatggactgacgggtggtggcttcaagctactactgtaatgtcaaacatggaaatgtttattgccgaaatgagcagtgactcattccagcttctagggatggtagagaggggcatgttacttgagttcttcagcaagaggtcatgttatggaaccccatatacttga

SEQ ID NO: 24050 - DNA, 231 bp, Glycine max
  Peptide Sequence Number=SeqID_115735
atggagcctagcaatctcttacgtggaaggccttggcagtatgataaggatgttgttcataatggtgtcacaaacaaatttgcatttgtacataaaaggaaaaaggttaccctcacacctatgtctccaagtgagaagcgtttgagaaggcttgatttcaaagaagggagtggaagcactactagaaatataagtttctacgacacgatggttctaagtggaccgccttag

SEQ ID NO: 24051 - DNA, 416 bp, Glycine max
  Peptide Sequence Number=SeqID_115736
ggtttcctcaatggtccccctttatccgatacccttatgaccaaaagaatgaagagagatctccatggtctacagagaccgctgagagtaccatccactctctttcgggtctagacacttcggtgagtctattgactcaggctcccctggtagactatcgcaatctaccgaggctggcgctgtctgccaccgataggtggcccctcagtctgaagactcaccttattagaactttatttggtaagtctgttggagattgtttagatgcaatcttcagcagatctatgaagtaccctttcttcgctcagttcgagagaaggtgtacccaggacagcgctttactaggtatgccattcttggagacgatgtttgtatcgccgacgagaatgtggcctctctttatcgccagacagtaa

SEQ ID NO: 24052 - DNA, 486 bp, Glycine max
  Peptide Sequence Number=SeqID_115737
atggctactctagctcagacatggagtgttctttccttctctaacctgattcctacctcccacacatctgatgtcactcttgacaaagccaaactcatttatggcatcattatgaagattgatatgaacctggggtacctcatctcccatcagatctccctcatagcacaacatgacacatctagactaggattccctaccttgagagtaacttttagaggacccaggaaggccaggggtaagagatctgaggccccttccacttcagcatcagaggcaccaacaccttcttcttctacagtaccttcctcttcatccactcagattccagttattcctccagtacctttacagaccccacttccagctcctctctctgcagatgctgcactccatgctctagagcatgcacagggggcagtccatcatcatgcagagccttcagggcttgggcttgccctctattatgagcatggaggagtttga

SEQ ID NO: 24053 - DNA, 513 bp, Glycine max
  Peptide Sequence Number=SeqID_115738
atggataagggccaaattgaagtctgcagtgcgagaaaaggggaggggaatttatgcatgcagtcagatgataaaaacccgagtaagcccaagcctttggtgatccacttcactagggatgtcgccactcagaagccccgaggtttccagcccgttacagttaagaagcctacgcccttcccttacaaaagtgataaggcggatgtgggcatccgtccgcccgaactaccggtgtggtccaaagacccaaaagggaaggcaaaggtggatgtgggcgagagcgataaggcgggcctgaccctggatgacgaggtaccggttggaaagattactaaggaagggagtgacttctgcaagaagggaatatccgctgaggaggtgaccgagttcctgaggatcatccaacatagtgagttcaagaatgagtcctatgaaagtaatgataccgaggacccggatgttgattttgagcaactaataaatcaagtcgagaaagaagaagatgaggattag

SEQ ID NO: 24054 - DNA, 414 bp, Glycine max
  Peptide Sequence Number=SeqID_115739
atgacgttgctacttagcaacattccacccgacgaccacaatgccgatctccctcctgtggaagtatcagttggtctgtgccatcgtgacatagggattgcacccacaaggcacccagtggacctggagaagtccaacaggaccctggggtttccagctttggtttcgggcctctttcattcctacagggtgcccgtccccctaacaaggtcatgccatcgtgacatagggatcgtgcccacaagacacccaacggacccggaggagcccaacagggcccaggggtttccagctctggttacaagcctctgtcagtcctacagggtgcccgttccccccaacaagggatcgtgcccgcaagacacccagtggacccgaagaaatccaacagggtcttcgagttgccaactctaa

SEQ ID NO: 24055 - DNA, 369 bp, Glycine max
  Peptide Sequence Number=SeqID_115740
atgaccatgattacgaattcgagctcggtacccttatctccgtcgccatcaccgtcatcatcaagctctaaaaagcgagcgagagacaacaacaatagtagaaacaacagcaacaagcattctgtgtatagaggtgtccgaatgcgcacgtggggcaaatgggtgtcggaaatccgcgagccgcgaaagaagaaccgaatctggctcggcaccttcgccaccgccgagatggcggcgcgtgcccacgacgtggcggcgctgacgataaaaggctcatccgccatccttaacttccccgaacggggatcctctagagtcgacctgcaggcatgcaagcttggcactggccgtcgttttacaacgtcgtga

SEQ ID NO: 24056 - DNA, 378 bp, Glycine max
  Peptide Sequence Number=SeqID_115741
atggagtcgagcataaggccaatgaccaacccaattcccacgaagccgatgccgatatgcaggccggacttgaagcaatcgcccagtttcatccccagcagtttcgagaagataatgatgacaatcggcagcatgacggtgggaccgaggtcgaggatataccgcatgatttcgggcttcgataccgacgcccgatacaaacggcatcccatgaatcaccggaatgtcaccaaacgatctgtcgacttttgccgtggtgcagatcaggtctgcaccgtccatataggtttcaatttcggtcacccgacactgaaccagatccagcgctatgtggtgggcttcacacagttctttgatctcttcagccgccatggttga

SEQ ID NO: 24057 - DNA, 269 bp, Glycine max
  Peptide Sequence Number=SeqID_115742
atgtaccctctcttgttctcagttacaacaacccaagtagatgtaccctctacttgtaccacaaaggatgtaccctccaatatgttaagacaaagttttcaggcggttagtcctttgaaactttgtgaaggggatacaaaagatatcttaggcggttattcctttgaaatcttttgtataagggaaagggaagaatcaaaagaattctcagactgtgtcattttgaattctttgaaaagggagaagggagacgaaaaagaattcaggcg

SEQ ID NO: 24058 - DNA, 332 bp, Glycine max
  Peptide Sequence Number=SeqID_115743
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcgactctagaggatcccctcatgatactactgttgccagcacatcaggttcagatgtgtatgtttgggatactgatagtgggactttggtgaccattgtggtaccgagctcgaattcgtaa

SEQ ID NO: 24059 - DNA, 822 bp, Glycine max
  Peptide Sequence Number=SeqID_115744
atgggaacaaatcaaaacggcaaaagattttatcaagtcgaggttaagggtctagatgtcaccagcctcaaagaattgggacgattaatgggacctctccaaaggcaagccttccgcaaagtgtacggaaagattctagatttgaccacagtgaaggtatttacggaagctgtcgtatccctcgcccaatacaatgatcagccgttgaggtgtttcacgtttggggacttccaaatggtaccgactgttgaagagtttgaggagatattaggatgccctcttgggggaagaaaaccgtacctgttcttcgggtttcttccctccttgagtaagattgcagctgtggtcggagattcggcaaaggagttggatcgcatgaagcaaactcggaacggcgtagtaggcctgccgtggaagtacttggaaggcaaggcaaggggcatggcaagccaagagaagtggggcccgtttgcggatacactagctttgctgattttttggggttgtcctctttccgaacgtggacggacttatttgatacctttgaccgaaggtgcgagaaaaacagtgcacggattgtctgttgcttacccgctctctgtgtgtggcagcgcaatcaattggtttcctcgatggaaggaaggcaaggagggagttcttttcacgtgtggggactaccctaatgttccattgatagggacgaggggatttgatgcaatcctccctaggaagggaccaatcactagaaccatgagcaagaggctccaagaagattgggctagagctgctgaagaaggccctagggttctcatgaaccttagg

SEQ ID NO: 24060 - DNA, 858 bp, Glycine max
  Peptide Sequence Number=SeqID_115745
atggccaagtttgatccagaaatagtccttgagttttacgccaatgcttggccaacagaggaaggcgtgcgtgacatgagatcctgggttaggggtcagtggatcccgttcgatgctgacgctatcagccagctcctgggatatccgatggtattggaagagggccaggaatgcgagtatggccagaggaggaaccggtctgatgggttcgatgaggaggccatcgctcagctgctatgtataccggggcaggattttgcccggactgctgcaggaaggcgagtgcgaatcatgcgcaccaacatgaccaccctgacccagatatggatgacgttgctcctcagcaacatcctgcccaccgatcataattccgacctccccatgccgaagtgccagctggtgtacgccatcctgacacggatgagcatccatgtggctcagttgatcgctgatgccatctatatttttgcagtactgcacccagagacaggctcaggggaatgctcacaggccgcgggcgcgccaccaccacctcatcaggctggcccggctgggtcatttgacatggagcagtatttacggcatttggtttgccagcaggcggccaaccaccaggcacatgtacagacccatgattgtctgtaccagctgagcctcagcatgcagagccagggcttcgcttctttttcatgccctactccagaccagttcagggcagaggtcgcatggcccggggattggcccgaggcccaagcaggagaggcacccccagaagctcccggcgatggagaggaggcccacgaggacgaggagatggccgatttgcttgacttcttgggagggagtggagctacgtga

SEQ ID NO: 24061 - DNA, 312 bp, Glycine max
  Peptide Sequence Number=SeqID_115746
atggacttcagacttttgttggtgacaagtttgatgccatggaattgcaagtcgacatgcggttcgatgccatggaatcaaggatcaccaaagttgaagaagatgtctccttcatccgtacttgctttgatccaccaccaccgcctccatcatcatcttagcttaaggattgtcatcatcaaaaagggggagattgtagacaaaggatcaagccgatgttttgatgatgccaaaagatcacatgcgtctcaaagatgtattcaagacaaagcaattaaagatattcagatagatgatcaagacagtctatag

SEQ ID NO: 24062 - DNA, 555 bp, Glycine max
  Peptide Sequence Number=SeqID_115747
tcaagttagccgctacacaaacccggaaggaatgtgccggattacgggaagagaatgcaactaccgtaagagcccttgaacaagagaccaagagggctcgcaaggaagagtatggccgtaacaaatttcgcgaagctctgtggggtagcaacagtgaactcaagctgcgaagggaagagagggaccagtcgcgagcacatagcatggtcttgaaagaggagttagttgcctattcaaggtccaaaaggagcttgtctcagcgtttatgcgagacggaaaccaacatgctagctatcgtcgccaagtaccaagaagagttaagtctagccacggcccacgagcatagggtcgcggacgagtatgcccaagtatacgcggaaaaagaggctagaggaagggtgatcgactctttacaccaagaggcaaccctgtggatggaccggtttgctcttaccttgaacgggagtcaagaacttccccgattgttagccaaggccaaggcaatggcagacacctactccgcccccgaagaaattcatgggcttctcggctatt

SEQ ID NO: 24063 - DNA, 462 bp, Glycine max
  Peptide Sequence Number=SeqID_115748
atggaggccatgaaagagcgaatggccacgatgatggccatgatgagcatgaggaagataatgaaagccaatgcggttacaattgccgctaccagcactgttgctaagacacatgaaattccccatcacaatctagccgacttcgagccttggctcggatatgtcactgaagggcaagcagttggtggtataccccttgaaaacacttcggaaggccctcagtatcacccacaactacacctcttgcattccccaacaagtaaaaaccctcatgctatggcagaaatgggaaagttggaccatctagaggaaaggctcagggccattgaaggaggtgaagattatgcctttgctaacctagaagaattgttcctagtacccaatatcatcacccttcccaagttcaaggtgccagactttgacgagtacaaggggactacttgccccaagaaccatctatag

SEQ ID NO: 24064 - DNA, 759 bp, Glycine max
  Peptide Sequence Number=SeqID_115749
atgtctcctttccttgtgagggatttcggcgcacaaaattccaagactatacaaagaatccataaggcatgggaaaccccgttaaggaaagatcaagaacttagaggcattcgtaatggcatcattggtggctaccatgaatggctgaaagagaagttcaagttggtcgctacacacgttcggaaggagtgtgccgggttacgggaagagaatgcaattaccgcaagagcccttgaacaagagaccaagagggctcgcaaggaagagtatggccgaaacaaatttcgcggagctctatggggtagcaatagtgaactcaagttgcgaagggaagaaagggaccagtcgcgagcacatggcatggttttgaaagaggagttagttgcctattcaaggtccaaaagaagcttgtctcagcgtttatgcgagacggagaccaacatgctagctatcatcgccaagtaccaagaagagttaggtctagccgcggcccacgagcataggattgcggacgaatatgcccaagtatacgcggaaaaagaggctagaggaagggtgatcgactctttacaccaagaggcaaccacgtggatggatcggtttgctcttaccttgaacgggagtcaagaacttccccgattgttagccaaggccaaggcgatggcagacacctactccgcccccgaagagattcatgggcttctcggctattgtcagcatatgatagacttaatggcccacataattagaaatcgttag

SEQ ID NO: 24065 - DNA, 99 bp, Glycine max
  Peptide Sequence Number=SeqID_115750
gccaaggttcaaaaaggtctaaggttgtgtctcaatggggtgttgatggaagcttgcttgtggggcttctatggaggctggatctttgagcttcaatga

SEQ ID NO: 24066 - DNA, 444 bp, Glycine max
  Peptide Sequence Number=SeqID_115751
atgtgggcctttcataaagttcttcaaattgattgggcacatcttgttagatatcgcatgcataaggaattgcgattgaatgctccattgccatatccacatctagtcactctcttccttcaacactttaacatccctcttgattctgaaccttatgttccaatcaagagatccttcctaataggcgcttcagtcattgcatcctttggtgctcgacatgttggtgaagaaggacatgatggagaagattcatctcttctttcaaagattttggacaggtttgacggtcttcaaaccattgttggagaaaggtttgacactttggaattacaagtgaacatgtgcttcaatgagatggagtcaagaatcaccaaggttgaagaagatgtttcttatattcgttcaagctttgatctaccaccaccgccgccaccatcatcatag

SEQ ID NO: 24067 - DNA, 443 bp, Glycine max
  Peptide Sequence Number=SeqID_115752
gaaagaacgcgctttatggcacccttatcgagtgcgtgccagagctagagtaatgagtgaaatagaggaggtgcaagagcggatgaaggccgacatggaggccatgaaagaacaaatggccacaacgatggaggccatgatgagcatgaagaagataatggaagtcaatgcgactacagttgccgctaccaacatcgttgctgagaacaagcatgccttcctgccatatggcttgcctcctaactatacaccacccaatgtggtgcacactcccaatgagaatgtcaataactccactcccatactcattgagagccaacaacctcaatctaatcatgcacaggtctctcaatccatgggggagacacatgaaataccccaccacaatctagccgactttgagccttgcctcggatatgccactgaggggcaagcagttggtg

SEQ ID NO: 24068 - DNA, 247 bp, Glycine max
  Peptide Sequence Number=SeqID_115753
cccgcatcaattagaccttgcaccttacgcttcagagccctacaatgctcaatggaacgccccggggcttctccgtgacaagcacacgttgcgttcgagtcgtattctcggagaaatggaggttgatgaaccttggctagggttatggctaccattgaattatcaagtagatatgggagcaaactttgtggttgatttagggatggcctttgtggataactgggcggtgggtaaggagaagggttga

SEQ ID NO: 24069 - DNA, 189 bp, Glycine max
  Peptide Sequence Number=SeqID_115754
atggcttcctatggtggtaagcttctccttgaagtggcatctccaatcatctttcttccttctccattccgctgccatgatcttcaagaagcaaaggaatccattgatgaagatccaagacctacaatctccacatggagctacatcatgtggttctatcatttttcagtcataatcttcttgtgctga

SEQ ID NO: 24070 - DNA, 105 bp, Glycine max
  Peptide Sequence Number=SeqID_115755
atggagctacgttatgtgatgaatggtagcggaatggagaaggaagagagagaggagacgccacttcaagaagaagatgagtctagaagaagctcaccaccatag

SEQ ID NO: 24071 - DNA, 555 bp, Glycine max
  Peptide Sequence Number=SeqID_115756
atgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccctgaccgcctgcagggcggcgggttgctggacactaatcgtgacaatgtcatcgcggccagcgaaggcgtctcactggtgcaggtgaccggcagcgccagcgccgacagcttcaggctgagcaatggctatatggcagccgggccgtggcagtatggtctgtacagctttgcaccgggcagcagcgcaggcggcaacgcatgggactatcgtctggcaaacaacttcatctgcagcgatggctcgctgtgccagccgcaggcgggcagtgcggttaaggcggtgcgtccggcggtcacgccgcag

SEQ ID NO: 24072 - DNA, 575 bp, Glycine max
  Peptide Sequence Number=SeqID_115757
gaaggtgtatcaatctctcttcccccgatggtacaatcccaatgcgacctgtgcctatcatggtggacagtccgaatgtgaggactaatccactcgccagtcatggaggctcgacagttaatgcagtggaagagtgggagcctcgggggctaaagcagatgaaggatgtgtcaacctctagaaggttcattttggaagcattgggcaaagttggtatgattcgccttaatggtgacaagggagattcctatttaatgcatccaggggaatcgcacgatgtggagacggccaatttgaagtttgcagtgcgaagaaacggagggggggatgtgtgcatgcagtcagatgacaaaaacccaagtaagcccaagcctttggtgatccacttcactaggaatgtcgccactcagaagccccaagctccatgcgtgcttactgcgatagaagaatctggcagagcatcaatatcaaggccgcgcgctaagcgcaagatcagtgcgctaagcgcagcggttgtcttcggcttggctcaatgcatgactggggctaagctcaaatccatttactcgcgctaa

SEQ ID NO: 24073 - DNA, 156 bp, Glycine max
  Peptide Sequence Number=SeqID_115758
atggatggccctaggcctatccttgatcctattgtagattggcatgcaatggctccaaagaagcttctctctaagagggcaaggaatgacgccgcgggagaaggatccagtgtggctccacaagcggacatagaacttgacggacaccatttctga

SEQ ID NO: 24074 - DNA, 279 bp, Glycine max
  Peptide Sequence Number=SeqID_115759
atgaaaccctatatgcagcatatggctgaccagcaggcggccaatcataggggccaggtgcagttgaatgagagcttctatcagtataccttgcatcagcagcgccaggatccctgtcctaactcgtggcctactcccgagcagttcagggccacagtcgcatggtctggagacaggcctagttttcaggcaggggcaggacccgtagggcccccaggagatgaagacgaagttgaggaagatgatgacatggccgatgtgatgaacttcttcctttga

SEQ ID NO: 24075 - DNA, 645 bp, Glycine max
  Peptide Sequence Number=SeqID_115760
atggagagaagtatgatagatgctgccagtggtggagcccttggagacatgacccctgctgaggccagaaatttaattgagaagatggcttcaaactcccagcaatttagtgccggaagtgatgctattgtcattagaggagtgcatgaagtagccacgaattcatcaggtgagactaagaagcttgaaggtaaactagatgccttggttaacctggtaacccagctggccatgaataaaaaatttgcacctgtcgccagactctgtggtttatgctcctctgccgaccaccacacagacctttgcccttctgtgcaacaatctgaagcaattgaacagcctgaagcttatgctgcaaacatctacaacatacctcctcaacctcaacagcaaaatcagcctcaacagaataactatgacctctccagcaacaggtacaattctacggatggaggaatcatcccaaccttagatggtcgaatccttcacaacagcagcaacaacaacaaccttattttcaaaatgttgctggcccaagcagaccatacgttcctccaccaatccagtaacaacaacaatagcaacagccccagaaacaacaaacagttgaggcccctctgcaaccttcccttgaagaacttgtga

SEQ ID NO: 24076 - DNA, 558 bp, Glycine max
  Peptide Sequence Number=SeqID_115761
cgtggagctatgagaaagcgcacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccccaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 24077 - DNA, 491 bp, Glycine max
  Peptide Sequence Number=SeqID_115762
atggtgcctactaggcaccctctagacccagataagtccaatagggccctagggtttccggcactgatcacgggcctcttccagtccaacggagttcccgtcacccccagtaaggtaatccgaccgccgatcacccgagccttcatcgagaagtactgcacgcctaggcaggtgcagggtgatgcacatcaggccgcaggcgcaccgccaccacctcggcaggccgatccagctggcccactgggcgtggagcgttatctacagcatttggttcaccagcaggtggccaaccaccatgggcaggggcagggttccaccccttttatatgccttaccccgaagcagtttggggctgaggtcgcatggcctggagactggaccgatgcccaggcaggggaggagcctgcaggatcccccggtgaggcggatgaatcccgtatagacgaagatatgactgacctgctcgatttctcgggagggagcgaagccac

SEQ ID NO: 24078 - DNA, 447 bp, Glycine max
  Peptide Sequence Number=SeqID_115763
atggaacttcaacgtctcaaccaaaatgaagagaccgaaaaaaggaaaagaagcatagcactcaaagcctcatcttcaatgcaagaagaagaagaagaagaatttgatgatgaagaggacttctcactctttatgaagaagtttcataaattcgtcaaaaatagaagaatggagagaagccataacttcaacaatgggaagagatcccaagaagtttctcctacacttaaattctataagtgtaatcaacccggtcacataaaggcaaactgcccctcaaatgagtcatggcccgagaagaatgagaagaaaagctataaagaaagaagatccaagaaggcatatattgcttgggatgacaatgactcatccgatggttcagagaaggagatcaatcttctatccaaggactatgaaagtgatgagaacatctctcaagaagtttaa

SEQ ID NO: 24079 - DNA, 399 bp, Glycine max
  Peptide Sequence Number=SeqID_115764
atgccgggagcagacaagcccgtcaggcgcgtcagcgggtgtggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccgctgcactagtaggataccaaaaacatgtacaacaaaaatgtaa

SEQ ID NO: 24080 - DNA, 318 bp, Glycine max
  Peptide Sequence Number=SeqID_115765
atggaaaacgccagcaacgcggccttttacggttcctggccttttgctgccttttgctcacatgttcttctgcgttatcccctgattctgtggataaccgtattaccgcctttgagtgagctgataccgctcgccgcagccgaacgaccgagcgcagcgagaaacagctatgaccatgattacgaattcgagctcggtaccctcaaagaacacagactcttaaatgactctgcccctgaaaccaaaagagattccatgtgttcacagttttcgattgggagacttttgagatttggaaagggaattccagatttttaa

SEQ ID NO: 24081 - DNA, 723 bp, Glycine max
  Peptide Sequence Number=SeqID_115766
atggagagaagtatgatagatgctgccagtggtggagcccttggatacatgactcctgctgaaaccagaaatttaaatgggaagatggcttccaactccaagcagtttagtgccagaaatgatgttatagtcattagaggagtgcgtgaggtagctacaaactcagctgcatcatctgaaactaagaagcttgaaggcaaactggatgcattggttaacttggtaacccagctggccttgaaccagaaatctgtacctgttgcaagggtctgtggtttgtgctcctctgctgaccaccatacagacctttgcccttccatgcagcaacctggagcaattgagcagcccgaagcttatgctgctaatatttacaatagaccttctcaacctcagcagcagaatcaaccacaatacaaccctggatggaggaatcaccctaatcttatatggtctagccctcagcaacaacaacaacagcctgctccttccttccaaaatgctgctggcccaagcagaccatacattcctccaccaatccaacaacaacaacagccccagaaacagccaacagttgaggctcctccacaaccttccctcgaagaacttgtgaggcaaatgactatgcagaacatgcagtttcaacaagagaccagagcctccattcagagtttaaccaatcagatgggacaattggctacacaattgaatcaacaacagtcctag

SEQ ID NO: 24082 - DNA, 408 bp, Glycine max
  Peptide Sequence Number=SeqID_115767
atgaacaacgaggaagtcccatcattaccttccacatctgcaacaccagggactcccggtgctcctctctttggtggcctcaggtttgagaaacctaatggtagtgttgttaggaaatcgtccttcctcaaaagttgcaaatgtttcagtgttgcagaatggactttagaagacggagccatgcctagagtctcttgctctttaccatcccctcatatccctctcgcaaaaaagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 24083 - DNA, 57 bp, Glycine max
  Peptide Sequence Number=SeqID_115768
ggtgcggataaccgtaaggtatctccgcgcatcatcaggcccgccacctctggatga

SEQ ID NO: 24084 - DNA, 504 bp, Glycine max
  Peptide Sequence Number=SeqID_115769
gggttatgtgagacggaagtcaacatcaaggaagagatagagatcatatctaaaaggtttgatgaactggatgtgtctggcaaagtaactctgaagagtaaacttcgagaaattgcataccctgatcataactctatgtgccctcctccgtcaaaggagtatgttgatgcttttcattctgttcaaagcagcaactctcccgtcaaacgaagtgcatcatgttctgaactgcctcagccaacaaggatcatcccgatgttggatcaatttgcgtcattcattcaaggtttcattcgtgacgttttggatgtgaaagtggacggtaactgtggatattggtccattgccgctttattaggtatgggggaagattcgtggccgttagtgcgtaatgaattgattaaagaacttgacaggtggtcgcatgagtacatgaacctcttcggtggcacagagagatttgaacaattaaaattgtccctacttgttgatgggttttcgaag

SEQ ID NO: 24085 - DNA, 501 bp, Glycine max
  Peptide Sequence Number=SeqID_115770
atgtcagccagcacgcaggccgccacatggtcctgtcaacacagacagcaaaaacagtacggccgcactcagtaccaccgccggtccggcaggcagcgcatagtgccaggagagcaacaggccgataaaggcggcgatcagcgccagcagcatggcaatcgccagcatgcgagtaaggtgacggctccagaagcgcgcgctggtggcgggcagcatcatcagcccaacggacatcagcgtgccgagcacctgaaaacccgccaccagattcagcaccaccagcgtgaggaaaatgccgtgcaccagcggtgcgctccatctcccctgcgcacgcagaaaatcaggatcaaaggcatcaatgaccagcggcctgaagatcacggccagcatcagcagggtgaacgcggcgatgctgccaaccagcacaatcgcgccgttatccaccgccagcagcgagccgaacaacacgtgcagcagatcgacactggaaccgcgcagtga

SEQ ID NO: 24086 - DNA, 320 bp, Glycine max
  Peptide Sequence Number=SeqID_115771
aaaagctgtgattttggttggtgtgttgagcagagttttctgcctttgccccgttttgcttggctgtgatagcttgtgctgtttgaatgttgttttgcttggatgttgtggaagcttgggaggattgatggggacccggggatggtgggtttatgcgcacattgtggatgtggaaaacttgttgtgcaccatcgcccgaccgccacctaagtggtacctagagatatgtcgcgggggtcaggagaccttggggacgtcaggtggggtgctattgcccaaaaccaagcttgaccaatcccgacccaacccgggcatagtcg

SEQ ID NO: 24087 - DNA, 468 bp, Glycine max
  Peptide Sequence Number=SeqID_115772
atgccaatctccccctgcagatgtatcggttgggatcgtgcccacaagatgcccaatgggcccgaagaagtccaacagggccctggggtttccagctctggttacgggcctctgtcagtcctacagggtgcccgttccccccggcaaggtcacgtcatcatagggatcgcgcctgcaagacacccagtggacccgaagaagtccaacagggtcttggagttgtcaagctctaattacgggtctctcaagggcatcaggccccctactaatcgagctttcatcaagaagtactgcgtccccaggcaagcgcagggcgaaacaccacaacagcctgggaatggccatcagtgggcaacagacgcaccgccatcacctctagagttcacctcagctcatccacaaaaggttagagcgttgcctacgacccatggccgagcaataggcgaccaagtccagagccaaaggtaa

SEQ ID NO: 24088 - DNA, 174 bp, Glycine max
  Peptide Sequence Number=SeqID_115773
atgtcttcggctaagcccagcacaagagtgcttagcgagtcaagggaatctggaagggcatctgctacacaagcttgcgcttaccgcgatatcagctcgctaagcgagtcgtctgtcgctttccaggctcagtgcaagattggcgctaagctcaaattcacttactcgtgctaa

SEQ ID NO: 24089 - DNA, 313 bp, Glycine max
  Peptide Sequence Number=SeqID_115774
atgactagaggcaatccatctgacttacaatcctttgatcctgagatagataggacatttcatagattagttagacatcatttagtaccttttgagcatcctgagcattctgttattggtgactttgagcattataattttgaacattctgagaacatggcacaacctccaccccgcgagaggactctaagggaaatggctgcacctgatttcacctacgaaagcttatgcatccaataccctgatgaggatgtcccatatgttcttaaaaatggactgatccatttgcttccaaagtttcatggccttgcag

SEQ ID NO: 24090 - DNA, 81 bp, Glycine max
  Peptide Sequence Number=SeqID_115775
atggtgctgtcgctcgaccagcgcgacaggctggccaacgctgacatcaataaagtgaagcaggatcccaccaccggttga

SEQ ID NO: 24091 - DNA, 497 bp, Glycine max
  Peptide Sequence Number=SeqID_115776
ggttgcgctcgtgcgggacttaacccaacacttacggcacgagctgacgacagccatgcaccacctgtgtccgcgttcccgaaggcacccctctctttcaagaggattcgcggcatgtcaagccctggcgggatacttaacgcgttagctacagcattgcacgggtcgatacgcacagcgcctagtatccatcgtttacggctaggactactggggtatctaatcccattcgctcccctagctttcgtctctcagtgtcagtgtcggcccagcagagtgctttcgccgttggtgttctttccgatctctacgcatttcaccgctccaccggaaattccctctgcccctaccgtactccagcttgacgctttacgcccaatcattccggataacgcttgcatcctctgtcttaccgcggctgctggcacagagttagccgatgcttattccccggataccgtcattgcttcttctccgggaaaagaagttcatgaccc

SEQ ID NO: 24092 - DNA, 629 bp, Glycine max
  Peptide Sequence Number=SeqID_115777
gtgtttatcctgattctgtaggaataaatgatcttggaaatccaattcgaaatactttagcaaatggtggaggggtcatactaccaggtgtaatgcaagatcctaataacccaggtagctatattccaaatacaataagattggataaatcacaatcaagccagggaatgtcagtgagtttaattgggaataatctatggattatgcataagaatttaccatattcagatccggaagcagggctgtcttcaggatgtacaacgggagatgatgtaaatttggatccacatgcagcttataatacgactcaggagtctttagttacttttgcacaaaaagaacttagtgattacatgaatacgccaagtgtaaatgagaataatttcagattgacgatgcaatactggcaggaaacgatttatgtgaatgaaagtaattatgattttaccaatcggaatgtatccaataatgtctggactgataactatgtaaatgttttgaaaaatttagaccaggcagagcagataattaaagcatatgtaccaccaccttcggaattgtctacctggcctgcaaaaaaaacaaatcaattagctatagtggatatgatgaagatctatacttatcag

SEQ ID NO: 24093 - DNA, 492 bp, Glycine max
  Peptide Sequence Number=SeqID_115778
atggtgtctccacaagagagaaatacatggacattggatgatctagtgtcgtatgtggagaaaataaccattttatctaaagagcaagagagaatcactaaacctatgtcacatggtccagcaacaaaacatcaatttgcagcacaagagtttaatattctcccgtcaagtgttgaaactcaaggcatagccagacgaagggagactgttaaagcagaatcatatttcattttctcagtatccgacatagatatgtatcagtatccatttgaaggtcatcaaagtgatacttctgcaagcgaacattcattaggtggtgttgcggaaacatatcccaatttttcatggcctattatgaccccttcacaacaacatgatgctccaattctaacacataattccccattaggtactcaatgggatgtacccgaagcgatgcctgatatggatgacgtagtagttgttgatgtatgtcaccacttttctgcttga

SEQ ID NO: 24094 - DNA, 150 bp, Glycine max
  Peptide Sequence Number=SeqID_115779
atggctgagtaccctagcccatcaaaccagtctcagaaaaacgacgatctcgaaccccgttcaccgttggatcgttgtgaaattttagtatcatgttcgcaacacaattccgagcattctcaccgttgggaatttcgatatcatgtctga

SEQ ID NO: 24095 - DNA, 228 bp, Glycine max
  Peptide Sequence Number=SeqID_115780
atgtgtcacctgactgcatatgtttgtgtttactatgacgaccaaatttgcaatactaatgaaggcaccaccttcgttagtaacaacataaaaacttcaatggtcaataagacaatcaacatggctcaacctctaatcttgaggacttatcagatgaatatgagacttgttgggtcaaaaaccatgatagtgatactgactcctcttccgggcccggggatcctatag

SEQ ID NO: 24096 - DNA, 246 bp, Glycine max
  Peptide Sequence Number=SeqID_115781
atgaagcttgcttctacagataacacatacacggttactctaaccaaattgacttttgaggttgatttgtgtttgtgtttcatgctgtcaatttctaggttgtccttcaagagaatggatgagtcaacaaacaggcataatgataatttgggtgtgaacaaaatggggaaaaacattaggaagaccaaaagagaccagcccaattatggcaagaacaacaacagcaacatgaatgggggtagatag

SEQ ID NO: 24097 - DNA, 600 bp, Glycine max
  Peptide Sequence Number=SeqID_115782
atgggatggcgcgctcaactcctcaaggaggcatttagttctttgaggatcagaacccctcaatcccttccttttcccctcaaattccacgcctccttctccttcaagtctccgacctcaaccttccgcgcctttttcgacgccaaggaggacgaagaagacgatgaagaagaagaccaagatccgctgaatgtttcaagcgaatgccgagggagattccgacaagcttgtagatccaccgaaggtggaggacaagatcggtgttgtgcctcatggcctttcaaccgattcagatgtcgtcaagatatgatctcgaagagatctctccgaagcaatgcggagaagtttgagttccaagcggaagtgtcgtggctagcttatggattgtgttctgccccaaaaaccctaatcaaaagcccattcagagcctcaagggccatcatgggcgacagtaactatatctgtagggtatcgttttctagttctggttgcgggaaaaatttgcaaatggaagaaatgaaggttgcttcagacttgttggtgggtgaccctgcttcactggagaagaaaattgatgcaattcatttcggtggtccctag

SEQ ID NO: 24098 - DNA, 63 bp, Glycine max
  Peptide Sequence Number=SeqID_115783
atggcgccagaggatgtggaaaagaccatgtttgtcaccctgtgggaaacgttctgctataag

SEQ ID NO: 24099 - DNA, 282 bp, Glycine max
  Peptide Sequence Number=SeqID_115784
atgaatgagtacaatctaatcccttacgaggatccattggagggcaagtctggtgccagcagcgcgcatgggataacaccacaggattctgatcctattgtgttggccttcgggatcggagtaatgattaacagggacagtcgggggcattcgtatttcatagtcagaggtgaaattcttggatttatgaaagcacgtgaacaacgtgtcgctaaacggcttcctgtggccacgtgtgggattgtttctcatgggtatgcagtgaacgaaatgggtggctga

SEQ ID NO: 24100 - DNA, 645 bp, Glycine max
  Peptide Sequence Number=SeqID_115785
atgttccacaaggaatatggcgaagtgttcgacggcgacgctaactggcaggcgatccaggtgaccggctcggcgacctatcagtggcaggaggattctacctatattcgtcatccgccgttcttcagcaccatgaaagtgacgccggatccggtgcaggacatcaaagacgcgcgcattctggcgattctggccgactcggtgaccaccgaccacatctcgccggcgggcaacatcaagcgcgacagcccggcggggcgttacctgagcgagcacggcgtggcgccgcaggatttcaactcttacggctcgcgccgcggcaaccacgaagtgatgatgcgcggcaccttcgccaatatccgcattcgcaacgaaatggtgccgggcgtggaagggggctatacccgccatatcccgtcgcagcagcagctgtctatctacgacgccgccatgcagtatcagcaggaaaaggtgccgctggcggtgatcgccggtaaagagtacggctctggctccagccgcgactgggcggcgaaggggccgcgcctgctgggcgtgcgggtggtgatcgccgaatccttcgagcgcattcaccgctccaacctgatcggcatggggattttgccgctggagttcccgcaaggg

SEQ ID NO: 24101 - DNA, 477 bp, Glycine max
  Peptide Sequence Number=SeqID_115786
atgaaatttttttcctgtgaccatcactgcgtgtttgacatacatttcataccaccactagagcggcaaacttgtggcagacagaggcattcatccagaaagcatatttggactgttcgatttactcaggaaatgctggatgctcctgaacccctgcagtttatcaattttacttttttctatctccaaaaactgccgcgttgtacagaagttcctcttaaagcttgcggtcaccacatgactgtcttaaggcgatctggtcctccattgcaatggaaagttgaaaccctgaatcctgctattggtggaaaaggcgttgttcaaccatggtatgattttcttgaagaaatggactttgacgatggagatgaaatctctatttactatagatattatgaaaaaatttggtatattataattagaaggcaggaggattgggacgatagtgacacgattaaactgctttctgtagtctga

SEQ ID NO: 24102 - DNA, 552 bp, Glycine max
  Peptide Sequence Number=SeqID_115787
atggacactaacgatccgcagcagcttgaaaagcttaaagacagattaaaagaccggatgggtattccggtcggctggcatatgtcaggaataccgctggtaggggctatgattctgagcatgttcgcttttgccctggctcaaccttatctctggttggcggtgttcgagctatttgggctgccgcagtatgccgtgatggcggcgattgtgcctgtatcgctaatttatagtctgataatggtactgacgatgtacttcgttgccagaggcaattttctggcgcttaaattatcactggctttgatggcttttagcggtctggttgcgattgtttattttctttctgtttgcctcggggcattattcggcgccggactaaaaccaggatttctcattagcgccgtgctggggctagtattcattttaggcggtatccgatgcattaatagccagactttttaccgtgcaaacgccctttatctacataacagggtttggcgaaaacagcttaatattcagcgccagacgctgcgccgcgcttcacgttag

SEQ ID NO: 24103 - DNA, 120 bp, Glycine max
  Peptide Sequence Number=SeqID_115788
atgaaggcaaagaaggcctatatcacatgggatgataacgacttagaatcatctgatgattctgaaaaagaaatggttaatctatgtctaatgggcaaaaattatgaaaacgatgaagag

SEQ ID NO: 24104 - DNA, 454 bp, Glycine max
  Peptide Sequence Number=SeqID_115789
atgaaaacgattgaagttgacgaagaactctaccgttatattgccagccacacccagcacattggtgaaagcgcgtcggacattttgcgccgcatgctgaaattcaccgccggccagagcgcacctgctgcgtcagcgaccagtgctgcggtaaaagaagcgccagctgtacgcagcgaagcgcgtcctcaggatcgcgtgcgcgccgtgcgtgagctgctgctgtctgacgagtatgcggagcagaagaaggcggttaatcgctttatgctgatcctgtcaacgctctatcgtcttgatccggcggcgtttgctgatgctactgcttcgctgcagggccgcacccgcgtttactttgcgggcgatgagcacacgttgttgcaaaatggcacccatactaagccgaagcacgtacccggcacgccgtactgggtgatcaccaataccaatacag

SEQ ID NO: 24105 - DNA, 1716 bp, Glycine max
  Peptide Sequence Number=SeqID_115790
atgatccacaaagcgctgaagggaaacaaccgtttgttggtcgttttaaaacaaaaaaggcaggaattgcttcctgccttcagtgacgatcaaaacgtgttaatttttgacttcgtacagcggcgtaacgcctgccaccacggtaccgcctgccagcagattcagaccagcaaaatcatcgctgttgctgaccaccaccgggctgatcatcgaacgcgcattggcgttgaggaagtccagatccatttcgaggatcggctgacccgccgtgacggttgcgccctcttccaccagacgggtaaaccctttaccttccagcgcgacggtatcgagacccatgtgcacgacaatctcaacgccattttcggcttcaaggcagaatgcatggttggtgttgaagattttcaccacggtgcccgccaccggcgcgacgacggttttatcgctcggtttgatcgccagaccatcgcctaccgctttgctggcgaaggcttcatccggcacgttttccagtgctaccacttcgccactgaccggtgccagcagcgttgcaattacctttttctcgctgttgcgcacggcctggggctgagcagcagcaggcgcggcggtggttgccgcagcaggtgccgctgcgccggctaccggacctttgctcagtacggttttcatcgcggtcgcaatgctttcggcctgcgtaccaacaatgatctgcacgctctgcttgttaaggcggatcacgccagaagcaccgaggcgtttagccacgctttcattcacctgcgccgagtctttcacattcagacgcagacgggtaatgcaggcgtcgatgttggtcaggttgtcagaaccgcccaccgcgccgatgtagcgacgtgccagagattcggtttcgctctcaccgttgctgctgtgatcaacgttgacgtcgtagccgtctgtctcatcaccggcagccagctcgcgacccggcgtcagcaggttgaatttctgaatggtgaagcggaacaccacatagtagatgacgaagaacaccagaccctgcgggatcagcatccaccagtgcacagccagcgggttacgcgtcgacagcaccatgtccaccagaccggcactgaaaccgaaaccggcaatccagtgcatgctggcagcgatgaagaccgaataccggtcagcacggcgtggatgacatacagcaccgtgatagattgccagcgccgcacccggcagaccgaacatcatgatcgggaagaagcccgcttgatagcgaccggtgatacccgggatgccggtaccattggcaatagactgcgcgccgcccatgaattttggaatatcgttgatgcccgccgggggggagccgggaacaccgagttcagcgcgtggtgcaggccaaccggaatcagcagacggttaaagaaggcgtacacgcccgcgccgaccgagcccagtttctggatgtgctcaccaaagctcaccagaccgccgaaaatgatcggccagacatacatcaggataaaggcgaccacaatcatcaggaaggagaccaggatcggcaccagacggcgaccgctgaagaacgacagcgccttgggcagctcaacgtggctgaagcggttgtacacttccgccgagagaatgcccaccagaatgccgacaaactggttattgattttaccgaaagcggcaggaacctgctccaccggcattttctga

SEQ ID NO: 24106 - DNA, 222 bp, Glycine max
  Peptide Sequence Number=SeqID_115791
atgagtgctctcctatccgacttccccagagcctccggtagcacagccgagacagcgatgggttctctgccccagcggggatggagcgaaagaagttttgagaattcaagagaaggcgtagaggaaccacaccaatccatcccgaacttggtggttaaactctactgcggtgacgatactgtaggggaggtcctgcggaaaaatagctcggcgccaggatga

SEQ ID NO: 24107 - DNA, 166 bp, Glycine max
  Peptide Sequence Number=SeqID_115792
ggatcgcacccgcaagacacctagtgaacccggagaagtccaacagggtcctgggatttccagctctgattacgagcctctgctttcatcaagaagtactgcgccccccaggcaggcacagggcgagacaccacaacagcctggggatggcggcagcgggcaataa

SEQ ID NO: 24108 - DNA, 424 bp, Glycine max
  Peptide Sequence Number=SeqID_115793
gccaatgtattcccattgaagaaaacactcaagaagttcactatatgggaaatcaatagagacaacgatatactcaaggagaattttcaggcttctagcagggtccttataaccaacaaggacagtggagatcgcaccttggcaatcaattcaacaaagaccaaggtaacaatgtcaaatcataagagcaccgagtcagcactaaaagaccttgaggtcaaggtgagacaactggccatgcagatagctgacaagtcatccaatagttttgtggcgaatacagaaaagaatcccaaggaggaatgcaaagctgtaatgacaaggaataagaggtttgtggagaaagagaatgagaatagtgttgtatccaagaagaaagctgctgaaaagaaaggtattgatgatatgaaagatgatgtgagag

SEQ ID NO: 24109 - DNA, 510 bp, Glycine max
  Peptide Sequence Number=SeqID_115794
gcgaaatttgaaatccctaaagcttctgacagtaggacaaagaagaaaattcttcagactgtcgacgagcagtggaggcagtttaaatctgacttgaccaggaaatgggcacttacagccgacaaggacggtgtagacaacactgtctgtgaaaaatacggcattagccaggagaaatgggcccagttttgtcagacccgtagagacccctcgtgggaggatgtgtggaaaaaggcacaggccatccagaagcaaaacactgccccccacgtgttgtctcgtgggggttatgaatatttagaacaaaagctcatggctgagaagacaaagaaaagactggaggaagctgcccagtctggaagcactgagggcatcattgaccctccatctcccataagatgccacgtgaagtggaagatggcccgcacaaagaaaactgggcagatgacgtctgaggcagcaatggaaatagctgagaagattgattctttggaggagcaggcatcataa

SEQ ID NO: 24110 - DNA, 159 bp, Glycine max
  Peptide Sequence Number=SeqID_115795
atggagtccagtcctggcgcacaaggaaggaaagaaaaggaggggtatcacaccggtgtaaaccttgatcacagggatgggaaaagaaaagtaccggccgggaccccaaaaaaagggatcaccatcgggaccggtaccgctactagattacccctgtaa

SEQ ID NO: 24111 - DNA, 219 bp, Glycine max
  Peptide Sequence Number=SeqID_115796
atggaaaacgccagcaacgcggctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccgaaatggaaattaa

SEQ ID NO: 24112 - DNA, 177 bp, Glycine max
  Peptide Sequence Number=SeqID_115797
atgacactaaagaaggcttgcaaaaagttatatgggaaaaatactcacgctcattcagaccgttttgattatctgcctgtctattatttcaataaaaaccatttcttcgaatatgtggtgatgatcgatgtccacggtgtgtcaattccaagaaactccactgcaaaggtattctaa

SEQ ID NO: 24113 - DNA, 423 bp, Glycine max
  Peptide Sequence Number=SeqID_115798
atgcgggccacattgcttctcccgtccatgaaaaaagaccctcctcagcagcccgacgaagtccataaagaccctcaagattatgctcggagggatgtcgagttttatcccccgatccccgaagggccggcaccaggcacgttgcctcaacccaacctcgcagcatcgccaatagttttgtctatggaagggccgcccccggcaactgaagaaaggaggaagctcgatctccttgaggaaagattgagggctgtggaaggatttggggactatccatttgcagacatgacggatctttgcttagtacccgatgttgttattcccgccagaaagttcaaaggtgccggccacttcgagcaagtatgcggacgagtatgctttccaaagatacgcacctcaaaaagagtgctagaggaagggtga

SEQ ID NO: 24114 - DNA, 288 bp, Glycine max
  Peptide Sequence Number=SeqID_115799
atgacacttgctagcattgccacacctcttgggcttgagtttattcctcaagtaaagaagttgttggatgagggtttggttcgcaagagcttaaatccttgtgctttgttggtgcccaaaataggaataatcaacataaaaatacagaaaaagatgtccgtgaaaggggttttcacaccttaccctactctaacatacccagagtatgaagaacctcgggatttgaggtcaaatcctttccaaggtggaggggatgatgcaatcctaccccccaagggtattggatag

SEQ ID NO: 24115 - DNA, 285 bp, Glycine max
  Peptide Sequence Number=SeqID_115800
atgttgcataagaagaagaatggcagtgaaaacggcaacaacaaggagaacgaagacaccaccatcaccgatgtcttgaaggtcgaagtgcactacgaaggttgcgctcccaagacgaccttgttgattcttgcaagcctggagattgagtggcaattgtggggatatataaggctctttgaaggaaaaggtagtgtgaatggagtatttaggactgttctcatagccaacaatgtttctcttctcaacaaagaggataatgcaccaatctacagtgttgaagat

SEQ ID NO: 24116 - DNA, 792 bp, Glycine max
  Peptide Sequence Number=SeqID_115801
atggggtggcagaggctggaggatgagcatgcaaaggtatcagctctgcaaattgaaagggaagcaagagagaggatgatagaatcattgcacgtggaagctatgaaatggatggataggttcgctctcactctgaatggaagtcatgagcttccaaggttgctagccagagccaagacgatggctaacactcgttgtcaaaaagtaaacataataaccaaaaagaatgaacacactttacgacacccctaccaaacacgtgccaaagccaaaatcatgagtgaaatagaggaggtgcaagagcagatgaaggccgacatggaggccatgaaggaccaaatgacctccatgatggaggacaacgcggccgcagttgccaccactagcgctaccgctgaggtggatacaactcacatatccggcataaaccaaataagttgtccaatcccagacgtggtaggtcagggaagaaaagtgttgggaagtacatgcggtccccatgttttgcaaagtaagaattctttcccaccatacggcttgccacctaactatacaccacccaaggcggtttttcaacgtttcagaaaaaaatgcgaaaaataccaaaagggaggccaaaagggtcattttggggttttttctcaccactggctcgcccaggctagcccctgccttgcctgggccataaaaaaacttagggttgaagtaaacagctcatctgggcgagcaaggttacttctggaggaagcgaccaacttgcttgggcgagctgagctcgcatgggcaagctga

SEQ ID NO: 24117 - DNA, 405 bp, Glycine max
  Peptide Sequence Number=SeqID_115802
atgacgtacgaagatcttctaccgtccctcatcgccaatcatttggccgtggtaactcccggaagggtcctcgaccccctttcccgaagtggtatgaccctaagcaactgcaagtaccaaggaggaatgcccgatgttgttcaattccctcgcaagttcaggagtgccggattcgacagtataacagttgacgacttaggtcccaagccatctcaaaatgaccttgtaagggatgggcgaacccactctaaagagaaaagcgagatcatacaagttctgaagtatgggaatcctgaccggaatgactcaactgctagaagtggcattaaaggaaaaggaagacctttaaagatatatgcgcagcgatcggagggggcggcacgaagtagctcctcccatggttga

SEQ ID NO: 24118 - DNA, 348 bp, Glycine max
  Peptide Sequence Number=SeqID_115803
atgcgagcattcgctaagcgcaacactcagtggctaagcgcgaggaagaatccagaagaagatgagttgtcaggttcgctgagcgcaccgctccaagtcatcaagtgcaccgcttcagctcattcgctaaacgagagaagcgcgctaagccacaatccacttatgcgcgctaagcgatccagatttgtgctaaaagcctctgcatgcaccagattctggccttggcttgaagcttttgcatgtttaggaagttctagagagagaaaggtccaagttccaaagagttgtgagagattttgctgtgtgaagatctgcagagacgagagctcgaagcggaagccgttctga

SEQ ID NO: 24119 - DNA, 810 bp, Glycine max
  Peptide Sequence Number=SeqID_115804
gggtcagtggatcccgtttgatgccgacgctatcggccaactcctaggatatccgttggtgttggaagagggccaggaatgtgagtatggccagaggaggaaccggtctgatgggttcgatgaggaagccatcgcccagctgctatgtataccgggacaggatttttcccggactgctgcagggaggcgagtgcgaatcatgcgcaccaacatgaccaccctgacccagatatggatgacgttgctcctcagcaacatcctgcccagcgatcataattccgacctccccctgccgaagtgtcagctggtgtacgccatcctgacgcggatgagcgtccatgtggctcagttaatcgctgatgccatttatatttttgcaggtatggcacctaccaggcatcctttggatccagataagtccaacagggccctgggatttccctcgttgatcacaggactctgccagtcattcggagtccccgcgcgccaccaccacctcatcaggctggcaggctgggcatttgacatgagcagtatttacggcatttggttcgcagcaggcgccaaccaccgagcacatgtacggaccatgattctgtaccagatgagccttagcatgcagagccagggcttcgcttctttttcatgccctactccagaccagttcagggcagaggttgcatggcccggagattggcccgaggcccaagcaggagaggcacccccagaagctcccggcgatggagaagaagcctacgaggatgaggagatggccgatttgcttgacttcttgggagggagtggagatac

SEQ ID NO: 24120 - DNA, 645 bp, Glycine max
  Peptide Sequence Number=SeqID_115805
atggcacaacctccaccccgtgaaaggattctaagggaaatggctacacctgatttcacctatgaaagcttgtgcattcaataccctaatgaggatgtcccatatgttcttaaaactggactgatccatttgcttccaaagtttcatggccttgcagtcattagaggagtgcatgaggtagctacaaactcatctgcatcatctgaaacaaagaagcttgaaggtaaactagatgccttggttaacttggtaaccctattggccttgaataagaaatctgcacctgtcgcaagagtctgtggtttatgctcctctgctgcccaccatatagacctttgcccttccatgcagcaacctagagcaattgagcagcctgaagcttatgctgcaaacatttacaatagacctcctcaacctcagcagcaaaatcaatcacagcagaacaattatgacctctccagcaacagatacaatcccggatggaggaatcaccctaatctcagatggtctagccctcaacaacaacaacaacagcctgctccttccttccaaaatgctgctggcccaagcagaccatacattcgttcaccaatccaacaacagcaacagccccagaaacaacaaacagttaaggctcctccgtaa

SEQ ID NO: 24121 - DNA, 690 bp, Glycine max
  Peptide Sequence Number=SeqID_115806
tgcttggccttgaagagcaaggtccaaggcttgatagaatccggatggttgacatttcaagaggacgggcccaacataaagacaaaccctcttgccaatcatggagggggagctgttaatgccatcgaggtgagtaggtcgcacgggcctaaacttttgaaggacgtaacgacctccagaaggtttatctacaaagccttgcaaaaggcgggcgtgattccccgtggcgagcacaaggaggattcatgtttaatgcatccggacggggaggaggaacaacatatatgcatgcagtcggcagataaggaaggtcctaaaaggcctaaacccttggtaatacacttcactagggacacgattccccaaaggccccaacacccctcggcagtgtcgggcgttagacctattctgtttccttacaagaacattcacgcagttctgtggaggtacgcccctccgggcggtagtaaggaagaagctaccgacgtcggctcactatcggccaaagtaaccaacatcaccgggctgagcggcataacccgcagcggtcacgtgttcacaccccctagcctgccaacacagcccacaaacgctaaagggaaaacaaaggtgaccgaagaacaaaaagtcaaggtgatccccgcaccggacgaggaggtttcgacggaagaatctgccgagggaagatag

SEQ ID NO: 24122 - DNA, 430 bp, Glycine max
  Peptide Sequence Number=SeqID_115807
gtgagggcgtgtagccctacaaaggtgaaggcacacgaccctttgacggcgaggacgtgtagtcctctgaagttgaaggcgaggactagtagtcctctggaggtgagggcgtgcagccctctgatggtgaggacgtgtagtcctctcaaggcgaggataactagtacccaaggtgagggcgtcagccctctgaaggtgaggacgtgtagtcctctcaaggcgaggacgtgtagtcctctcaacggtgagggacgtgtagtcctctcaaggcgaggacgtgtagtcctctcaacggtgaggccctctggtggtgaaggacgtgtagtcctctcaaggcgaggacgtgtagtcctctcaacggtgagggcgtgcagccctctgatggtgaggacgtgtagtcctctcaaggcgaggataactagtacccaag

SEQ ID NO: 24123 - DNA, 956 bp, Glycine max
  Peptide Sequence Number=SeqID_115808
gatcccacgatggaaggaaggaaaagaaggagtccttttctcatgtggaggatacccaaacattccgctggtaggaacgaggggttgtattaactacaatcccacgctcgctataagacaactagggtaccccatgaggggagcaccgacggaagaaagcatgtctcctttccttgtgagggatctcggtgcacaaagttccaagactatacaaagaatccataaggcatgggaaaccccgttaaggaaagatcaagagcttagaggtattcgtaatggcatcattggtgggtaccacgaatggctgaaagctcatatacgaggtttagattggctcgccaagttaaaagtcgtcagcgaagagagttttgaagcaccggaagaggacgaagaagtccaagctctcaaaagcgagttaggaaaagcaaaacttgccaaggagaagttcaagtggccgctacacacgttcggaaggagtgtgccagagaccaagagggctcgcaaggaagagtatggccggaacaaatttcgcggagctctatggggtagcaatagtgaactcaagttgcgaagggaagaaagagaccagtcgcgagcacatagcatggttctgaaagaggagttaattgcttgttcaaggtccaaaagaagcttgtctcagcgtttatgcgagacggagaccaacatgctagctatcatcgccaagtaccaagaagagttaggtctagccacggcccatgagcatagaatcgcggatgagtatgctcaagtatatgcggaaaaagaggctagaggaagggtgatcgactctttacaccaagaggcaaccatgtggatggaccggtttgctcttaccttgaacgggagtcaagaacttccccgcttgttagccaaggccaaggcgatggcagacacctactccacccccgaagagattcatgggcttctcggctatt

SEQ ID NO: 24124 - DNA, 530 bp, Glycine max
  Peptide Sequence Number=SeqID_115809
acgccagtggatccactcgatgggaagtcgttccctctacactccccaaaaactgaagttcgtagtggaggggcatttggtcattgtatcgggggaggaagacgtcttggtaagttgccagtcctctatgccataagtggaagccgcggaggagtcattggaacaaccttccaatcttttgaggtggtaagcattgcctccatagattccctctctgggcagccttgcttgtccgatacagcaatgatggtggcccgagtgatgttggggtatggctacgagcccgaaatgggtttaggcaagaacaacgaggccaaggttcgcggttgggatgacaagtcgaagggccccccctgccacatcagtaggagctttataagcgcaggtctaagacacgaaggccaagtcatcgcgatatgcgaggatgactccccgagtaggtcggatttagtacgaccatgtcctcctggtttccgactaggaaattggcgagtggaggagcacttggacatttacgcgacaagcataat

SEQ ID NO: 24125 - DNA, 235 bp, Glycine max
  Peptide Sequence Number=SeqID_115810
atggcgatacatttatacaaaacttctaccccaagcacacgcaatggagcccgtagacagtcaagccgtaatgccagaggaatcattaccgcagggcatagagggggaggtcataagcgtctataccgtaaaattgattttcgacggaatgaaaaaaacatatatggtagaatcgtaaccatagaatatgaccctaatcgaaatgcatacatttgtctcatacactatggggatg

SEQ ID NO: 24126 - DNA, 299 bp, Glycine max
  Peptide Sequence Number=SeqID_115811
aacagcaggtcaccctaagggctgaatctcaacactttgcaagtgtcaatgacgccaatccctgtgtagcttccatcccttactttgggttcattgatgaaatttgggagcttaactatgtgaaatttacgggcaaaacaattggtgttaatgtagaagatgatgattcatacatggacacctatgttagtcctttgaccgctcaaatcactcctaacgttgtcagagaagaagaagctgacgacgttcatgctaatcgaaatgatcataatgaaggagaattgattaacatcgtctaa

SEQ ID NO: 24127 - DNA, 225 bp, Glycine max
  misc_feature (220)..(220): n is a, c, g, or t
  Peptide Sequence Number=SeqID_115812
atgtgggacactcttcgattaacacatgaaggaactacagatgttaaaagatctaggataaatgcactaactcatgagtatgaattatttagaatgaatgcaaatgaaaatattgagagtatgcaaaagagatttacacatatagtaaatcatctagcagccttaggcaaagaatttcaaaatgaaggaacacgagatggaactattgagattgcaccanaatga

SEQ ID NO: 24128 - DNA, 252 bp, Glycine max
  Peptide Sequence Number=SeqID_115813
atgtcaggacttacacacgattctcctcaaatttcagccagctcgcatcaattagactttgcaccttacacttcgaggtcatacagtgctcaatggaatgccatggggcttctccatgacaagcacatgttgtgttcgagtcatatcctcggagaaatggaggttgaggaaccttggttggggttatggctaccattgaattatcgagtggatatgggagcaagtcaacataggacactggaattggggtga

SEQ ID NO: 24129 - DNA, 525 bp, Glycine max
  Peptide Sequence Number=SeqID_115814
atgagtcatcattcatctagtgttaatggcaagggtactagtcataaagaccctttatctagaatcttagatgagttgagttccctcaagttatggaaggaaaaacaagagagaaaagaaaaaggaaaaaaaagagtggaagaaataagtcaagatcaaagaaagaaaataagagaggaagaaagaagaaaaataatgaaagaaatgaaaagagaaaaacatgcctcctatagtagtcataactcttgcaaaagcctaagtgaagaacttcgtgactattacgaaggaaggcataggtcacatcttagacctcactcccatagaagagaaaaggaaagaaagcctcaagaggctaacattaaactctcatacttccaggggaaggacaatgtagaggctaacatagattgggaaataagggtagagcaacaacttaaaaagaagtctacttctaaaatcttatggccctcactcttatccaaagaaagaccaaggtcaaggcatcttaagggtgacaccttctaa

SEQ ID NO: 24130 - DNA, 666 bp, Glycine max
  Peptide Sequence Number=SeqID_115815
atgggctgtgaacgccgcgtggtgtatgactttgtcaacgttattcagggcgatgcgacgctgaatcaggcactgattcgcgacaagcgcaccgagcagctttatattctgcccgcctcacaaacccgtgataaagatgccctgacccgcgaaggcgtggaaaaagtgctgaacgacctggcggcaatggacttcgattttatcgtctgcgactcgccggccggtatcgaaaccggtgcgctgatggcgctgtacttcgcggatgaagcaatcattaccaccaaccctgaagtctcttccgtgcgtgactcagaccgtattctcggcattatctcatcgaaatcgcgtcgtgctgaaaacagcgaagagccggtaaaagagcacctgttactgacccgctataacccgggacgcgtaacgcgtggtgacatgctgagcatggaagacgtgctggaaatcctgcgcattcctctggtcggcgtgattccggaagatcagtcggtgctgcgcgcgtctaaccagggtgagcccgtgatcctcgatgcaaactctgacgccggtaaagcttacgctgataccgtagatcgcctgcttggcgaagaacgccccttccgctttatcgaagaagagaagaagggtttcctgaaacgcctgttcgggggataa

SEQ ID NO: 24131 - DNA, 138 bp, Glycine max
  Peptide Sequence Number=SeqID_115816
atgactgaaggagattggaagcatgggagaaaaattccgaggaaggcacagcaccgcaagttctcaggaacaagagaaaattttagggttcagagaaaaatgaggaggattcccgaaaaggagattgagaagctgtga

SEQ ID NO: 24132 - DNA, 357 bp, Glycine max
  Peptide Sequence Number=SeqID_115817
atgaggattcttttgataggccaaggttcaaaaaattataaggttgtgtctcaatgggggcttttatcgtgggagcccgatcttgatatctggcgtaaaacaaatttgggtgtcaaggtgtcggtctcgggccgaacttccatattattccacaaggcacgcgtgacaatgatgatttggaaacaacgtgcaaaattagtcatggccacagccaggtgggcactcaagcatcccatttacggcatcgtgatactacggtcgggaatttacacaaaacagacccaacgtttcccaatcatattctttcatcagttcaatgaattcatccattcttatctcggttattcaagaaaataa

SEQ ID NO: 24133 - DNA, 234 bp, Glycine max
  Peptide Sequence Number=SeqID_115818
atgtcgctgcatgttctttatctttatgcgttttctgggatttcccccagggatttcctgtctgttgtatctctcgttacaatctttcaaagaaatgaacgtggattcgaggcttttagtcctcacgggcaggatcatcttgagctaccttctggggtagagacaaaacatgaacggcagaaaccaatcaaggtacttaaggacggatgcaagtggggatggggtcatgactga

SEQ ID NO: 24134 - DNA, 276 bp, Glycine max
  Peptide Sequence Number=SeqID_115819
atgtttgcacattcgattaaaggctgccgtcccttggggcggacgtgtggggtgctaataccttccccgaaatggccccgaggaaacttgcctcaaagagatccaggaaggataaagcggccgaaggaactagttccgctcccgagtatgatagtcaccgctttaggagcgctgaacaccagcagcgcttcgaggccatcaagggatggtcatttctccgggagcgacgcgtccagctcagggacgatgagtataccgatttccaggaggagatag

SEQ ID NO: 24135 - DNA, 198 bp, Glycine max
  Peptide Sequence Number=SeqID_115820
gtagttgtcatcatcaaaaagggggagaatgtaaatcatgaagattttgatgatgtcaaaaagatcaagccttggataatggttgtcatcatcaaaaagggggagaatgtgaatcatgcatatcttgatgatgttgaaaagaaatcacttgattgtcatcatcaaaaagggggagaatgtgaatgtatgtatacatga

SEQ ID NO: 24136 - DNA, 456 bp, Glycine max
  Peptide Sequence Number=SeqID_115821
atgctgagtcacaggcagcgcctcggaaagcgcggacgagccacatgcagggaaacttgcacgtgtggttctggccggggaccccggtatactgtactaatatgtgtaggtccccgtaattcgagtgagattgtcatggcgcaaaagcagatatggtccggtattcccttgttccctgtattggttatgttcttcatttctcgtctagcagaaactaatcgagctccgtttgatctcccagaagcggaagctgaatcagttgcaggctataatgtagaatatgcgcgggatgcgatccttaatagtccactgttggcggaagccaatgtcccggggtcccggggactcattctgactgaaacaaggggtggggtctttaccaacttaaaaatcgaagattttagggcgagtggcattagcccctctcccagcaagaggatgcgcgccttaacttaa

SEQ ID NO: 24137 - DNA, 66 bp, Glycine max
  Peptide Sequence Number=SeqID_115822
atgtcaatgatgaaggaagcaactgaaagtactttctgggattacaagtcaagcaaactcaagaag

SEQ ID NO: 24138 - DNA, 237 bp, Glycine max
  Peptide Sequence Number=SeqID_115823
atgtccaaatgccctatgtgtgggacttcacggtacaaagtgaaggatgaagaggaaaccaattatgatgaaaagtcaaagaagggcccgccagcgaagattttgtggtatcttccaatcattccaagggtgcaaatagcaaccaagcccacttgggccttccaggatgttcctccagaaggcggttgcttctggaggaagcaacctggcttgcctaggcgagctgagctcgcctga

SEQ ID NO: 24139 - DNA, 465 bp, Glycine max
  Peptide Sequence Number=SeqID_115824
atgtcagacgaaagagtaagatataatgattctgatttacaagagtttaaagcgatcattaaagaaaaaatagaaaaagcagaaaaagatttacaactgataagagaaagctttatcaatgaccagaataatgggactgatgacacatcgcctacattcaaagcgtttgaagaaggagctgaaactcttagtaaggaacaaaactcgatcttagcaggaagacaggaaaaatttgtccgtgatcttaagaacgctttaatcagaatagaaaataaaacggagaggattaagaacaaattctttcctgatcagcataaaaactatacaatcgatgatcagtttaattccgataaacgcgaaagggaaaaagaaattgacaaacttttaggtaagatgggcaaaaacggcatcaatgatctttctccaaaagacagaaaaagacttgacgaattatctaagaagtaa

SEQ ID NO: 24140 - DNA, 561 bp, Glycine max
  Peptide Sequence Number=SeqID_115825
atgggagtactgctccgttccagcgtaaaccaaggaatacggtgttgccccagtagaagttcgtaccgaagttcggttggtgccattgtcagtaatgatcttcctagggagtccgtatcgacaaatcaactccctctttatgaatctgaccactacactcctcgtgacattggtgaaggaagccacttcgacccatttggtgaaataatctattgccacgagaatgaagcgatgaccgttcaaagcctcaggttcgatggcccctatgacgtctatcccccacatggaaaaaggctaaggggcggacatgacattcagaggatgtggtggagaattgacattgtccgcaaacgcttgacatttatggcatttccttacatggatgcagcaatcactttccatggtgagccagtaataacccgctctcaggatcttcctggccatagcatgcccattggcgtgtgttccaaacgaaccctcgtggacttcctcgatcatgtggttcgcctctttggcatccacgcatcgcaggagagtcatgtcatggtttcttttatatag

SEQ ID NO: 24141 - DNA, 199 bp, Glycine max
  Peptide Sequence Number=SeqID_115826
cccgaaatctaccctaaggctcatcaaaaccctagggccttctcttgcatctctggttcaatcttcttggagtcttctatccaatgcccttgcgggggtacatccacttggtttttcaaagagaacaagggagggacatcccttgtggatctttggcctgcaaaggattttgcaagattgaaagaaatctcaagaaccg

SEQ ID NO: 24142 - DNA, 101 bp, Glycine max
  Peptide Sequence Number=SeqID_115827
atggctccaaagaagcttccagctaagagggcaaggaaagatgccgctggagaaggttccagtatggccccacaagtggatgtgaagtttgacggacatcg

SEQ ID NO: 24143 - DNA, 492 bp, Glycine max
  Peptide Sequence Number=SeqID_115828
atggccacaatgatggaggccatgatgagcatgaagaagataatggaagccaatgtggttacaattgtcgctaccagcactgttgctaaggtgaacccgatgcccccatctggcctcaaccaaatgaatcatccaacctcagctatggtaggcaaagatttgggaagtacgggcggcccccatgatgtgcaaattcaaaacgagcacgccttcctgccatatggcttgcctctcaactatacgcaacccaatgtggcgtacactcccaataagaatgtcaataactccactcctatacccattgagagccaacaaccccaaactgatcatgcacatggcaagcagttggtggtatacccctacaaaaccctttggagggccctcagtatcatccccagctacacctcttgcattccacaacaagtaaaaaccctcatgctatggcaaaatgggaaagttggatcatctagaggaaaggctcagggccattga

SEQ ID NO: 24144 - DNA, 465 bp, Glycine max
  Peptide Sequence Number=SeqID_115829
aatgcggcagccgtctcagactggtatttcaccaatggcaataccgtggaggggatccaggcccaggtggacgatatccgcgccaaggctgcggccaataagcatcacgtcaagattggggtcaatgcttttgtgattgcccgcgataccgaagaagaagccaaagcggtattgaaggaaattattgataaagccaaccctgaagcggtgaatgcttttggccatgaagtgaaaaatgcgggcgctgccagcccagaacgtgaaggtaactgggcgaaatcgagctttgaagacctggtgcagtataacgatggctttaaaaccaatttgattggcacaccccagcaaattgccgagcgtattgtcgctttgaaggccgttggggaagaggtcgcttattttggtgaaaaagtgctgccattggtgcgtgagctggaagctaaaaccttggccaaagcggcttaa

SEQ ID NO: 24145 - DNA, 771 bp, Glycine max
  Peptide Sequence Number=SeqID_115830
atggcaaggacgtgtagtcctctgaagatgagtgcgtggagccgtctgatggcaaggacgtgtaatcctctgaaggtgagggagtacagccctctgatggcgaggacgtacagccctctgatggcaaggacgtgtagtcctctgaaagtgagggcgtgcaaccctttgattgtgaagacgtgtagtcctttaaaggtgggggcatgcaggcctctgatggcaaggacgtgtagtcctataaaggcgaggatgtctagtcctctgaagtcctcagaaggtgacgcgtgcagccctatgatggcgaaggcgtgtagtcctctgaaggtgaggacgtgcagccctctgatgccgaggacctgtagtcctctgaaggtgagggcgtgcagccctctgatggctaggacgtgcggccctctgatcgcgaggtcatgtggtcttctaaaggcgaggatgtctagtcctctaaaggtgagagcgtgcagccctctgatggcaaggacgtgtagtcctctgaaggtgagggcgtgcaaccctttgattgtgaagacgtgtagtcctttaaaggtgagggcgtgcaggcctctgatggcaaggacgtgtagtcctataaaggcgaggatgtctagtcctctgaagaaggtgactgcgtgcagccctatgatggcaaggacgtgtagtcctctgaaggtgggggtgtgcagccatctgatggcgaggaagtctagtcctccgaaggtgagggcgtgcaaccctctgatggcgaggacgtga

SEQ ID NO: 24146 - DNA, 291 bp, Glycine max
  Peptide Sequence Number=SeqID_115831
atgggagaaagaaaaaggagaagaaaagaaggaaagaaagctcctgatcaaggatcgaaagaaaacagaagaaatgtgcagagaggtctttggaccggacgatatctgaacaatacagaattgtcaccaaatgaacaaaaaggaaggaaaggaaaccacgacctaaatgcatgtttgcattttagtggagaaaacaccgagactttttcaagtctcacaggttatccagaactacgtaggtctgagttcctcattggaggatacgtaggagcaagaggtgggatcctctag

SEQ ID NO: 24147 - DNA, 798 bp, Glycine max
  Peptide Sequence Number=SeqID_115832
atgcataaatctgttacattaaacgtgtgcatgagttccgctcccgattatgacaaccatctttttaggagcgctgagcaccagcagcgcttcgaggccatcaaaggatggtcattcctccgggagagacgcgtccagctcagggacgacgagtataccgacttccaggaagagatagttcgccggcggtgggcattgctggttacccccatggccaagttcgacccagacatagtcctcgagttttatgccaatgcttggcctacagaggagggtgtgcgagatatgcgatcttgggtgaagggtcagtggatccctttcgatgcggatgccctcagccagtttctgggatatcctttagtgttggaggagggccaggagtgcgagtatggccagaggaggaaccaggccgatgggtttgatgaggaggccatcgctcaattgctgtgtataccggggcaggattttgcccggactgctgctgggagacgggtgcggatcatgcgcaccaacatgaccaccctgacccagatatggatgacgttgctgctcagcaacatccagcccagcgatcataattccgacctccccctgccgaagtgtcagctggtgtacatcgtcctgacacggaggagcattcacgtggctcagttgatcgctgatgccatttatctatttgcaggtatggcgctgactaggcaccctttggacccggataagtccaatagggccctgggatttcccgcattgatcacaggactctgtcagttgttcggagtccccgtcgcacctagcaag

SEQ ID NO: 24148 - DNA, 781 bp, Glycine max
  Peptide Sequence Number=SeqID_115833
cctaagtgaagaacttcgtgactattacgaaggaaggcataggtcacatcttagacctcactcccatagaagagaaaaggaaagaaagcctcaagaggctaacattaaactctcatacttccatgggaaggacaatgtagaggctaacttagattgggaaataagggtagagcaacaacttaaaaacaagtctacttcaaaatcttatagctctcacttttatccaaagaaagaccaaggtcaaggcatcttaggggtgacaccttctaagcccgatgatatgggggaagacatttatagaaaagtccaagccctaaggctagacacattacttctcaatgccccaccacaagaaaaccatgattatgagggccaagacatttatagtagccaagatgaggctactacttcaccttcctctagtaaaagtgaagaagcaaaaggggaagaatctagtgaagagatctacccccaagaagaaggacaacctttaatggttaaggaggagtgtaaggaggtaagtgtctcctccaagaggttagctaagaaggaaagacattttgaaataaagacaaatattaaagaaatttcccttcttagacaacctccacattttctcctttgtaaaaagacacttgttagcattgccacatctcttaggcttgagtttattcctcaagtaaaggagttgttggatgagggtttggttcgcaagagattaaatccttgtgctttgttggtgcccaaaataggaataatcaacatgaaaatacagaaaaag

SEQ ID NO: 24149 - DNA, 663 bp, Glycine max
  Peptide Sequence Number=SeqID_115834
atgaaagaaatgaaaagagaaaaacatgtctcctatagtagtcataactcttgcaagagcctaagtgaagaactttgtgactattatgaaggaaggcataggtcacatcttagacctcactcccataggagagaaaatgaaagaaagcctcaagaggttaacattaaactcccatacttccatgggaaggacaatgtagaggctaatttagattgggaaataagggtagagcaacaacttaaaaggaagtctacttcaaaatcttgtggctctcactcttatccaaagaaagaccaagaggacacattacttctcaatgccccaccacaaaaacccatgattatgaggggccaagacttttatagtagccaagataaggctactacttcaccttcctctagtgaaagtgaaaaagcaaaaggggaagaatctagtgaagaaatctacccccaagaagaaggacaaccattagtggttaaagagaagtgtaaggagttaagtgtctcctccaagaggttagctaagaaggaaactcattttacaataaagacaaacattaaagaaactttccctcttagacaacctccacattttctcttttgtaaaaagacacttgctagcattgccacatctcttaggcttgagtttattcctcaagtatag

SEQ ID NO: 24150 - DNA, 969 bp, Glycine max
  Peptide Sequence Number=SeqID_115835
atgagagaccttattaagtattgcaaaagaaagggcctgctgatagagctgggcggggaggcgagactagttatcaggatcaacaacaatagctgcacggagtacggtagaattccccggtacggtcattcgggaagtccctccgaggacgactcccatacaattcttgcgagagctggagaagcgtctacggctgacgaaggggatgagcgaaacagggagtctactggacgggttccactagcggagactcttggaacagctggagtaagaagtccccaagtaagcgtattatgggggaccgtccagcacatctggcaaggatcaagggggatctcgttgttgcatagctcaggtcggagcaacgcgccatcggacgttcaagaggcagtcgcacgatcgggcatgagtgtccggaagttgtcattgtatactcccgcgggtcggaaggcggcgggggaaggaggaggacactgggcgggatctatcagcagcgaattccccatacagatagaggcgcctatcaaaaagatactccgaaggcttcgggatcgaggtatcattagccgaagaagaccctggccaatccacgtggcctgcttgacgaacgtcagcgacggagacatcgtaaattggtctgcgggcatcgcgataagtcctctgtcctactacaggtgccgcgacaacctttaccaagtccgaacgattgtcgaccaccagatccgctggtctgcaatattcaccctagcccacaagcacaaatcctcggcgcggcatataatccccaagtactccaaagactcaaatatagtcaatcaagaaggtggtaagacccttgcagagttccccaacagcatagagcttgggaagctcggacccggtcaagatccgaacaacaaggagcactccactactagtctagtcgttttttttctattagttgcgatgcgaacaggcgtttacttatga

SEQ ID NO: 24151 - DNA, 588 bp, Glycine max
  Peptide Sequence Number=SeqID_115836
atgacccaagacctggtagcccgcggagataccttacggttatccgcacccttgtgtcatccagaggcggcgggcccgatgacacgcggagataccttatggttatccgcgcccttgtgtcatccagaggcggcgggcccgatgacacgcggagataccttacggttatccgcacccttttgtcatccagaggcggcgggcccgatgacacgcggagataccttacggttattcgcgcccttgtgtcatccagaggcggcgggcccgatgacatgcggagataccttacggttatccgcacccttttgtcatccagaggcgacgggctcgatgacacgcagagacaaaatttggtcattctgcacccttgtgtcatccagaggcggcgggcccgatgacacgtggagataccttacggttatccgcacccttgtgtcatccagaggcggcgggcccgatgacacgcggagataccttacggttatccgcacccttttgtcatcgagaggcggcgggcccgatgacacgcagagacaaaatttggtcattctgcacccttgtgtcatccagaggcggcaggcccgatga

SEQ ID NO: 24152 - DNA, 453 bp, Glycine max
  Peptide Sequence Number=SeqID_115837
atgatacgcggagataccttacggttattcgcacccttttgtcatccagaggcggcgggcccgatgacaagcagagaccaagtttggtcattctgcacccttgtatcatccagaggcggcgggcccgatgatacgcggagataccttacggttattcgcacccttttgtcatccagaggcggcgggcccgatgacaagcagagaccaagtttggtcattctgcacccaagaggcggcgggcccgatgatacgcggagataccttacggttatccgcaccccttttgtcatccagacacagtcgtgtccgatggcacagcagagaccaagtttggtcattctgccaacccatgatacgcggagataccttatggttattcgcacccttttgtcatccagaggcggcgggcccgatgacaagcagagaccaagtttggtcattctgcacccatga

SEQ ID NO: 24153 - DNA, 262 bp, Glycine max
  Peptide Sequence Number=SeqID_115838
atgtcgcgtggccgttgtttgaagtgtagcacaccgcagagcaggacggtggctgtcacgggtgtcggctcagttgaactcggcgggctcgaagggaatgctctgcaccacctccagctcgtatccggccaggcctgcgtatttgagcggtggccccaggtgtcgcagtttgcccacgcccaagtcctggagaatctgggcgccagtgcccacttcggagtagaccttcgactggcctcgttggaatggcttgatcggctgg

SEQ ID NO: 24154 - DNA, 769 bp, Glycine max
  Peptide Sequence Number=SeqID_115839
atggcagggacaaaagtcttctgggcaaaaacgaataggaaaccgaagacagccaatgcggtattggctgatggggccaaacgttattatattcaacaggtggatcccgaaaccacctattatatctgggtagaatctgcaacgggaaattcgttggcaaaaggaaaagcatatacgaacaagaactggcagctggatggcgccgagctggatgaagtgaagaaaaatccaagttcaagagcggtaccgttaggtatggaagtctattggcaagacgagtttaatgaccaattccttaaccgcaataaatggacgaccaactatttttcgtcgttgaattatctgaatgcaaaatctaaggatgaaatgttacatgatcgtttgtcacaacctgcgtatacgttaaatggatcagcgatcaatctgtttgtcaatgatactattcccaagcggatctttacggagggtggcaaccaaaagatttcatccatccaaacttacgattggaagtccaatgaaaatctgctggacaacagcaggggaggctactttgaagtgaaagtaagacgtaaccgccaagggaatccaaagggaacgaataccgctttttggtttgattcacccggaccagatattcgctactatttacaggaaggaggggaagccgatggcattaaaggtatccgtccaaagggacaactttttgaaatagacgttttcgagtacatcactgcccagtttgtgattcatggccatgttgactcaaaag

SEQ ID NO: 24155 - DNA, 234 bp, Glycine max
  Peptide Sequence Number=SeqID_115840
atgaaaagtggtcaaggggttcccacagaccctaagagaataaaggtcattcctgattggcccactccaccaagtgtcgagggaaggagcccagaatatgacagaacctcagatttgaggtcaaatccttccaaggtggaggggatgatgcaatcctaccccccaagggtattggatagaagactcaaagaggataggctagagctactaaagaaggccttggggttctcatga

SEQ ID NO: 24156 - DNA, 207 bp, Glycine max
  Peptide Sequence Number=SeqID_115841
atgaggtcctttaatggtgattttccaccatggagatgcagcggaagaaaaaggagaagaggtgagaggaggcgccatccactagggaataagccatggaagaaggagcttcaccaccaagatgagccttggataagaagcttggacaggatgcttcaatggaggaaaagaaagagactaggtagcttccttgagaagctttcttga

SEQ ID NO: 24157 - DNA, 384 bp, Glycine max
  Peptide Sequence Number=SeqID_115842
atgtactacatccccaaggagagtaataccagagcagacttgctctctaagctggccaacactaagaaggtcgggcacctcaagactatcatccaggagatgctccaaactcttaccatagatgctaaggaaattatggccagagaagaggaggaaccaaactgggtgaccccctacaagaacttcctaatttggggggtattaccaccaaacaaggatgaatcacgacgcctcaagcaaaagggaatggacatattgggaccattaccaaaggccctaagagaaatcaaatacttactagtcgccaatgactacttcaccaagtggatagaagcaagaccacttcaggaaattacgaccagcgagatggagaaattcacctag

SEQ ID NO: 24158 - DNA, 483 bp, Glycine max
  Peptide Sequence Number=SeqID_115843
atggagaggagtatgattgatgttgctagtggtggagctcttgctgatatgacccctgttgaggctaggaatttgattgagaagatgacttccaactcccaacaattcagtgcaagaaatgttgctattgttcttagaggacttgccatgaataagaaatctacacctgttgcaagagtctgtggtctatgctcttctgcagatcaccattcagatctttgtccttctttgctgcaatctggagtcaatgagcaacctgaagcttatgctgcaaacatttataatagacctccacagcagcaaaaccaacaacagcaaaataattatgacctttcaagcaacagatacaatccaggttggaggaatcatccaaatctgagatggacaagccttccacaacaacaacagtctatccctccttttcagaatgccgctggtccaagcaagccatatgttcctcctccaatgcaacaacaacaatag

SEQ ID NO: 24159 - DNA, 342 bp, Glycine max
  Peptide Sequence Number=SeqID_115844
atgcatatctactgctacttcagagaaattttaaatgtgggtccaaagagaggatccccagaaaattcatcctctactctaaaatgctttgaatgcaatcaacctggacatctgagggttgattgtcccatcttcaagaaaaagatggaaaaatctgaaaagaaaaatcatagtgagaagaaactaaagaaagcatacatcacatgggatgaaaatgatttggaatcctctgatgattctgaaaatgaagagataaatctttgcgggcttatggcaaaaagctacgaaagtgatgaagaggcatttgctagtgttaaagatcaattaaacttgcaaaattag

SEQ ID NO: 24160 - DNA, 1044 bp, Glycine max
  Peptide Sequence Number=SeqID_115845
gttgcaggtggcgacagaaaatctggcctgaatgatattgccaggagaaaggggttgttcttcgggtctgccgtcaacgtcagcgagctgaccaatgacgcgcaagcaaaggcaatcattgacgactgtggaatcatcactgctcaacgcgcgcagaaatggccgatcatgtggcaataccaggatcatgagacgccagaggaagccgatctagttgctcaattttctttccagcacggcctgctacttagagggcacgcgctcatctatgatgccttcatgcccgactgggtaaaagcgcttgataaaacggcgatgcgaagggcttttgatcgaaggatcagttacgcagctagccgttggaagggtaaagttcattcttgggacgtcgtaaatgaagccattgagccgaacgaccatctagccaatggacttagaaactccctgttcatgaaggcactcggcccctcttacatttccgatgcattcttcagagcaaaggagtgcgatccaagtgcattgctttgctacaacgattacaatctagattcgaccgcaagttttgcggatagacgtcgacggacagtattgaaacttctggagtcattgaaaaagcgcggcgcgcccgtcgaggctctcggagttcagtcacatctcaaatctcagctcaagtacgatgatcgaatctggcgtgacttcctcaaggaagtagctgatctgggtctcaagatcatagtttcagagcttgacgttaatgatcgatactttagtgaggacattgccaggcgggatgctcaggttgcgagcatgacttctcgatacctcaacgtgactctggatgagcctaaggtcataggcatagtcagctggggccttaatgatggccaatcctggatggcagcccgtcagcgaaagggcgatccaggattcattcgtgctgacggagcagtcccgcgcccccacccgctgagctcttcattggaaaaaaagccgatgtggtatgcaatcgctgacgcgctcagggcggcacccgaccggtcttaa

SEQ ID NO: 24161 - DNA, 185 bp, Glycine max
  Peptide Sequence Number=SeqID_115846
atggcgcctactaggtaccctctggacccagataagtccaacagggccctggggtttccggcgccgatcacgggcctctgccagtcctacagagttcctgtcacccccagtaaggcgcactgccaccacctcggcaggccgatccagttgggccactgggagtggagcgctatctacaacattgg

SEQ ID NO: 24162 - DNA, 171 bp, Glycine max
  Peptide Sequence Number=SeqID_115847
atgtgccggcttgccccgagatctgaattcgatgtacggcagatccccgtgtggggcaagttgaaacatggatgccaaggtggccaatgcatcagccatttggttctcttcccgagggccatgatgtcttcatccgggaacttgttagacaagtggcctcagatatcttaa

SEQ ID NO: 24163 - DNA, 331 bp, Glycine max
  Peptide Sequence Number=SeqID_115848
atggctccgaaaaagctttccgcaaagagatctaggagggacactgcggctgaagggaccagtgctgccactgagtttgatagccaccatttcaggagcgccgagcacccgcaatgcttcgaggccatcaaaggatggtcgttccaccgagagagacgcgtccaactcagggacgatgagtacaccgattttcaggaagagatagctcaccgacattggatgtcgctggtcactcccatggctaagtttgacccagatatagtcctggagttttatgctaatgcttggcccacagaggagggagtgcgggacatgcggtcatgggtgaggg

SEQ ID NO: 24164 - DNA, 606 bp, Glycine max
  Peptide Sequence Number=SeqID_115849
gtcgactctagaggatcccactgccagaagtcaaaaggaagcattgttgcgcaatccgtgaagttccgtaacatttcggaagccaaagaagggatgattatgatcttccaacaaaaggcggtgccttctggtggaagcaacctaactcgcttgggcgagttgaggtcgcctgggcgagctgggcttccgtcccttgtgacggatgcgtggggtgctaataccttccccgtgcgtaaatacaactcccggacctttcacttaaagttcgtagaccacgtctttttcggactacacgtcctcgccgtcagagggctacatgtcctcacctttagaggactgcacatccaaaccttcaaagggctacaagcccttgccttcatagggctacacgccccaaccttcagaggactacacgccctcacattcagtggactacacgtcctcgcgttcagaaggctacatgtcctcaccattgaaggactacacatcctccccttcagagggcaacaagccctcgcctttaaagggctacacgccctcacctttagaggactacacgtcctcgcctttagagggctacacgccctcgccttcagaggactacac

SEQ ID NO: 24165 - DNA, 606 bp, Glycine max
  Peptide Sequence Number=SeqID_115850
atgggtgatcaagaggagacacaggaacagatgaaagccgacatgtcggctctgaaagaacagatggcttccatgatggaggccatgttaggaataaggcagctcatggagaaaaacgtggccaccgctgccgctgtcagttcagctgccgaagcagacccaactctcttggcaactgcgcaccatcctccctcaaacatagtaggacggggaagggacacactggggcacgatggcaaccctcatctgggatacaaccgagcggcttacccttatggattgccgcccaactactcaccacccgtcctgcaagacgatgcgggccatattgcttctcccgtccttgaaagagagcctcctcaacagcccgacgaggtccacaaagaccctcaagactatgctcgaagggatgtcgagttctatcccccgatccccgaagggccggcacccagcacgttgcctcagcccaacatcacgacacaaccaatagttttgtccacggaaggaccgtccccagcaactgaagaaaggaggaagctcgatctcctcgaggagagattgagagccgtggaaaggatttgggggactatccgttcgcagacatga

SEQ ID NO: 24166 - DNA, 225 bp, Glycine max
  Peptide Sequence Number=SeqID_115851
atggtagccgtaaccctagccaaggttcatcaacctccatttatccgagaatacgactcgaacgcaacgtgtgcttgtcacggagaagccccggggcgttccattgagcatggtagggctctgaagcgtaaggattttcaagtgcaagccattggtcagtttgctcaagcgacctgtgctcctgagtttggacttccaacaccgttcaatcgtgggatcctctag

SEQ ID NO: 24167 - DNA, 123 bp, Glycine max
  Peptide Sequence Number=SeqID_115852
atgtcggccaggaaagatgaccgatccaggctaaaggcccaagtggagaaggacaaaggcctaagtggagaaggacaaagcccccgagtggagaaggatgaaggcccaagtggagaaggatga

SEQ ID NO: 24168 - DNA, 432 bp, Glycine max
  Peptide Sequence Number=SeqID_115853
atggcagcgcagttgatccatgatcgtgtcgtgatggagtgcctagagggtgtttgggagacccttgaaggcaatgagaggtgccgattccgtggcacagttcgactcactgctacttcgctagtacatccagagcaacccgcacgcccacttcagcagcctgtggagtggataatacctatgcctactccatatccactagttgagcttgttcaattgatagaggtgtcatcctctgaagaggaccttgaagaggacccaaaggagttacctcctgaacctgctatggatgcccctgacttaccagaggatgatgaggaaccgctccctgatgttgattcttcagaggatattatgccagcatctgaggcagactctacagaggagagtggccttggagggacaacgagtagtgacgactcttcatcatag

SEQ ID NO: 24169 - DNA, 477 bp, Glycine max
  Peptide Sequence Number=SeqID_115854
gctgacccttttcttcttcactcctccccctatttatagcaaaataggggaggagcttgccacccagctcgcccaggcgagcaaggttgcttcctccagaagcaacagccttctggaggaaggatctggatggcccaagcacggttatgagcccagaatgggtctgggcaaggacagccacgggaatgccgatgtggttaacattaggggtaacccgtacaaatataggttggggtatgaacccgggaaacctggaagaaggaatgcaccatcaagactcctggcagatagggcatggcccggtcatgttagccagtgtttcacctgtgccgggataatgttcgaggaagaggtggcggcaataggagaggaggctccacaagatccgccaagtttcgtgcgaccgtgccatcccaattaccaagtggggaactggcgcgtgatgagccagtcggaagtttataccactgattcaat

SEQ ID NO: 24170 - DNA, 357 bp, Glycine max
  Peptide Sequence Number=SeqID_115855
atggcaccttcgtcgtcatcttcatctagtatacacattaagtctagtccaatagatggagacgttttacggatgcaagctaaacatgtttcagaacatgtttggaatggggaaccagacagaaaattacacatcagacgagttgtccccatctatcaaggactagaagaaataccagaggaaattattcctctgcttcgacgacaatttggattttattggataatgaagatggggtacctaaaattaaatttgtcattaattacagccttgattgaaagatggaggcccgaaacatacacgtttcacttgagatgcggagaggctacgattactcttcaagatgtgtcagtttga

SEQ ID NO: 24171 - DNA, 195 bp, Glycine max
  Peptide Sequence Number=SeqID_115856
atgaccaaagtgaacaaagagccattttctaggcttgggagggttgatggggacccagtgttgagagaaacgaggatatgggctacgtgggagtacgtgagctcagttggaggtgggcaacaggggatggtgggtttatgcgcgatttgtgaatgtggaaaacttgttgtgcaccatcgctcgaccgccacctag

SEQ ID NO: 24172 - DNA, 256 bp, Glycine max
  Peptide Sequence Number=SeqID_115857
atgaacaatggaagctctcgagaaattcaaatggtcataactcttaacactgaggtccgatccaagattataattgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctgcgaactttttagtgaaaggttcgggagttgtatttacgcacgggaag

SEQ ID NO: 24173 - DNA, 237 bp, Glycine max
  Peptide Sequence Number=SeqID_115858
atggatggtcgtttcaccgatgaatgccagaggtctgatgctctcgtagtggcattgttccttcaaacaatggttcagtcgccgaagacaattgttgaacgtcattgcgcagcttttctctatgcgaaactttacattaccaaacttgttgcatcgcatgacttcttctctgtctttggtttcaagttagatttttgtcaccgtagtgttgcctcatcaacagagggtcgcccttga

SEQ ID NO: 24174 - DNA, 318 bp, Glycine max
  Peptide Sequence Number=SeqID_115859
cgcacggtggagtggatactacccacgcctacaccatatcgtctagtggagcccgtccaagtgatcgaggtaacgtcatccgaggaagaccctgaggaggatcttgcggagctacctcctgagcctgctgtggatgctcttgactttctagagggtgatgaggatccacttcttgaggtggattctcccgaggaagtcatgtcggcatctgaggcagactctacggaggatagcggcccgggggagatggcggaatttgatgattgtatacatgtggctgaagccaccactatggacacctttgctctggatgacact

SEQ ID NO: 24175 - DNA, 402 bp, Glycine max
  Peptide Sequence Number=SeqID_115860
atgggtctcttggaggtaagaagtagacgggaaagggttggagtaagtaatgggtcttatggaggtagagaattgacggagttcaaccagtttatcgaagatattgaactcttagacatttctcttattggtagaagctttacttgctatagagctaatggaagagcaaaaagcctaaccatttcggggtctcaattgttggttccaagacaagagattctgcaaggtggtggaggaggcatagagggatttgaatatggcgggaatgctccaaccatatgggatcagcacaggcttaaaggagcactcaaactgggtgtatttacccccaaggcttacactccgaagagtccgtcagggcctctccttactaattcaggtccaatccagaaaacattttag

SEQ ID NO: 24176 - DNA, 267 bp, Glycine max
  Peptide Sequence Number=SeqID_115861
atgacaattgaggaatcaatacatgttacttttgatgaaactaatattacctccccgagaaaggagattgttgatgatattgcagatactttggaagatactcaaaatgaagaaagaaatctgaaaagaaagagagatgatgaagacaaggatgatcaagatgacacaacacaagaaaatgataatcttcccaaagaatggaaaacttcaagaaatcatcctcttgacgacatcatcggtgatatcttaaataggggtaacaactag

SEQ ID NO: 24177 - DNA, 598 bp, Glycine max
  Peptide Sequence Number=SeqID_115862
atggagagaagtatgatagatgctaccagtggtggagcccttggagacatgacccctgctgaagccagaaatttaattgagaagatggcttccaactcccagcaaattagtgccagaaatgatgctattgtcattagaggagtgcatgaagtagccacgaattcatcttcattagccgagactaagaagcttgaagactctgtggtttatgctcctctgccgaccaccacacagacctttgcccttctgtgcaacaatctgaagcaattgaacagcctgaagcttatgctgcaaacatatataatagacctcctcaacctcagtagcaaaatcagccacaacagaacaattagaaaagtagagaagcttaaaggaagtgaaagaattagtatgggcagaaatgtctccgcattgattggtaaatctgttccccaaatccctgaaaaatgtaaagatccagctaatagaagtgttgcctatcctgctggtttcttaaaggatgtcttagttagagttggtgaactgattttccctgttgatttttatattttgaatatggaggaaagattttctcaaggatcagttcccattattctag

SEQ ID NO: 24178 - DNA, 243 bp, Glycine max
  Peptide Sequence Number=SeqID_115863
atgtctactaaaatgaatatctctacacatgagaaggtggccattgcatatggagaagatacggggaaaattctaaagtgtatcctgaaaagctttgaattggtctctggtcttaagataaactacaataagagcaaatttgggtgtttgggcaaatcggaggactggtgtagggaggcagcatcttctctcaattgtagtcaaatggatattccattctcttaccttggaattcctgtaggg

SEQ ID NO: 24179 - DNA, 306 bp, Glycine max
  Peptide Sequence Number=SeqID_115864
atgacgagctcttggatcatggtaacaaaaagcggtgcagtcgacaaaagcgaggctcttgctcctacgtatcctccaatgaggaactcagacctacgtagttctggaaaacttgtgagacttgaaaaagtctcggtgtttttctccactaaaatgcaaacatgctttagcaaagagacaaatattccaactgatttagagcagcatatgctttttttgagtgaaaaaacaatgcgtcctcccggggaaggagagtctgctgataaaatctcccataaccataaaatgagatttttggatgtttag

SEQ ID NO: 24180 - DNA, 138 bp, Glycine max
  Peptide Sequence Number=SeqID_115865
atggctaccatttcattattgagtagatatgagaatgtgcagcaagcgggttctgtggctgatttaggggtggcctttgtggatgattgggtgttcctagctaataggatgatgggtagtgagaagggctggtattga

SEQ ID NO: 24181 - DNA, 222 bp, Glycine max
  Peptide Sequence Number=SeqID_115866
atgacggcgacagcaacgaagtctatttcgttgaagcctttgggaagagacggcaccgtaaggcgccatttggtggaggagattccgattgtggtgcctaggtacgtcatcaagcctctggcgacggtagctgaaggcgccgtcggcaacgggcatgtcgacgacaaactcagtgtagcagaaggcggagaggagggtgcagaagccggcagtggcaattaa

SEQ ID NO: 24182 - DNA, 321 bp, Glycine max
  Peptide Sequence Number=SeqID_115867
atgcgaaaaaggcaaattgatataaatgacagcgtgtgtcctttctgcagtattaaggaggaaactgcatctcatcttttgcacaacaatgggatgaaaggtgggaagaaatacaataggtggaagtgttggtgggtagctctaaattggtctatttggcagcatagaaataagattattttcacgaatgctccattcaatggcagtaacttgctggaagatgcactgtttttggcatggaaatggttcagaacaatggagaaaaattttacaatgcatttcaactattggtctagcaatctaccagctggttttttgtaa

SEQ ID NO: 24183 - DNA, 108 bp, Glycine max
  Peptide Sequence Number=SeqID_115868
atgccaggagctgatcacaagcaacccaatcacaagggtggtgagacttcaagttcaaccgagagcaaaaatttggaaatattgggagtcaaaatactttgtcaatga

SEQ ID NO: 24184 - DNA, 106 bp, Glycine max
  Peptide Sequence Number=SeqID_115869
atgggtcgatcccggagatgcggatgctcaaacttggagagggccaagcatgggtcagattcggtttctctgcagtgtggcgattgggctcgacggtgctgtttcg

SEQ ID NO: 24185 - DNA, 778 bp, Glycine max
  Peptide Sequence Number=SeqID_115870
atgagtattcgcatcatcccgcaggagcagctggagaagagcgaaaagaacacggcggagcaagttccgccgttacttttcccccggctgaaaaatctctacagccgccgtgcggcgcggttgcgtgatctggcggcgaaaaatccgctgggcgactacctgcgttttgccgcggtgatcgcgcaggcccaggaaatcgtgctgtatgaccatccgctgcagatcgatctgcatcagcggctggcagagagcgcgcagcagggcaaaccgccgctggatatccacacttatccgcgcgatgtgcactggcagcggctgctgcattcgctgatcgccgagctgaagccagagatgagcggccaggcgctggcggtgctggagaatctggagaaggcctcgtccaccgagctggaaacccttgccagcgcgctgctggaaggcgaattcgcccaggtcagcagtgataaagccccgttcatctgggcggcgctgtcaatttactgggcgcagatggcagcgatgatccccggcaaagcgcgggccgaatatggcgagcaccgtcagttctgcccggtgtgcgccagcgtgccggtcgccagcgtggtgcacatggacgttggccagcagggtctgcgctatctgcactgtaacctgtgcgaaagcgagtggtacgtggtgcgcagcaagtgctcgaactgcgagcaaacgcgcgatctgcattactggtcgctggatagcgagcaggccgccgtgaaagccgaaagctgcggcgactgcg

SEQ ID NO: 24186 - DNA, 576 bp, Glycine max
  Peptide Sequence Number=SeqID_115871
atgttctttctgcgttatcccctgattctgtggataaccgtattaccgcctttgagtgagctgataccgctcgccgcagccgaacgaccgagcgcagcgagtcactggcacgacaggtttcccgactggaaagcgggcagtgagcgcaacgcaattaatagacgcactcttgtagaacaagaacttgaaaaggcacaggaggagatcccagagtacaaaaaacaagcagagactgctgaacaggaaaaaggtcaagtactaaaggagttggacagcacaaagagaggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 24187 - DNA, 255 bp, Glycine max
  Peptide Sequence Number=SeqID_115872
atgacaattgaggaatcaatacacgtttcttttgatgaaactaatatgacctctccgacaaaagagtttcttgatgatattgcagattctttggaagatatgcacaatcaagaaaggaatctaaaacaaaagagaaatgaagaaaacaaggatgttcaagatgacatagcccatgaaaatgatgatcttcccaaagaatggaaaacctcaagacatcatcctcttgacaatgtcatcgaagatatctcaaaaggg

SEQ ID NO: 24188 - DNA, 720 bp, Glycine max
  Peptide Sequence Number=SeqID_115873
atgaccatgattacgaattcgagctcggtacccgatgccgtggtaattggcgccggtgcggcgggtatgttttgtgcggcgatggccggacaggcgggtcgtcgtgtgctgttactggacaacggaaaaaagcctggccgcaagatcctgatgtcgggcggcgggcgttgtaacttcaccaatctttatgtcgaacccgcggcgtatttgagccaaaaccgtcatttttgcaaatctgcactggcgcgttacacccagtgggactttatcgacctggtgggcaagcacggcatcgcgtggcatgaaaagacgctgggacagctgttctgcgacgactccgcgcagcagattgtcgatatgctggtcgccgagtgcgagaagggcggcgtggtgatgcgtctgcgcacggaagtgctggaggtcgcccgcgaggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 24189 - DNA, 792 bp, Glycine max
  Peptide Sequence Number=SeqID_115874
gtcgactctagaggatcccagatctggaaggccggcccggcgatcctcaacaccctgctaacggcgatcaacgaacggcgctttcgcaacggcaacagcgaagaaccgatcccgctgcgcctgctggtcaccgcctccaacgaactgcccgaagcggacaacagcctcgaagccttatatgaccgcatgctgatccgcctgtggctggataaggtgcaggataagcagaatttccgctcgctgctggtcaaccgccagagcgaaagccaaaacccggtgccggcgacgctgagcgtcagcgacgaagagtttctgcagtggcagccgcagatcgataaggtggcgctgccggaagcctgctttgagctgattttccagttgcgccagcggctggacgcgctggaacaggcgccgtacgtctctgaccgacgctggaaaaaggccctgcgcctgctgcaggcctgcgccttcttcagcgggcgcgacgccatcgccccgctcgacctgatgctgctgaaagactgcctgtggcacgatctcacctcgctgaagctgctgcaacagcagatcgatcagctgctgaccgaatcggcctaccagcaacactcgatgctgatccaactgcaacaaatccacacccgctggctgcaggatcagcagcaacaaagcgaccggcaggccatcagcctggtgaaaaagggcggcatgttcagccgtaaaccgcaatacgcgccggccacgccgttcgccggcggcaccctcaccctgttggggtaccgagctcgatcgtaa

SEQ ID NO: 24190 - DNA, 762 bp, Glycine max
  Peptide Sequence Number=SeqID_115875
atgacggtgaagcggcgcgtttccgcgacttacaaggacctgccgggcggacaattgctggggccgaccttcgattatacccaccgcctgctcgacccctctcttctcgaagaccaaacggtcgaagcagcgacccagcgggatagcgagccggaacatgtcatgcgcgtttccgatattcttgcccaggaagggctgatcgaaagcgatggcgagttgccggacgatcatattgccggtgacctgacacgggaaccgatggaattcccgatgtcgcgcgatctgcgcctgcaatcactggcacgcggcgatgagggttttcttctggcgctcgcttactccacgcagcgcggctacggtcggacacatccttttgtcggcgagattcgcatcggtgacgttgaaatccagctagacgtaccggaacttggcttcgcggtctcactgggcgatatccaggttaccgagtgccagatggtgaaccagttcaagggttcgtccaaggcccctccgcaattcacgcgcggttatggcttggtgttcggtcagagcgagcgcaaggcgatggccatgtcgctggtcgaccgtgcactacgcgccggcgaattcggcgaagatgtcgtagcgccagcgcaggacgaagaatttgtcatctcacacgccgacaacgtgcaggcaacgggcttcgtcgaacatctgaaactgccgcattacgtggatttccaggctgaactcggacctcgtccgaaaaatgcgtgctga

SEQ ID NO: 24191 - DNA, 249 bp, Glycine max
  Peptide Sequence Number=SeqID_115876
atggctgtgaatgagaacttctttgttcagtttatcctaaactcattaccatctgagtatgactcattccaaatgagctataataccctgaaacataaatggaatatgcatgaattgcataatggtttgatgcaatcctaccctgcaggggcattggatagaagactccaagtagattgggtcagagatgcaagagaaggccctagggttctcatgagccttaggatagatttcgggctcatggactaa

SEQ ID NO: 24192 - DNA, 604 bp, Glycine max
  Peptide Sequence Number=SeqID_115877
gattcgtttgaggagcagggccacacagggatcgtccgtcccctatggacgtcaggatgttctcgccgctgctattggacgtccagagcaccctggacgtgtccgtgctgctggagccggtgtcaccatcaaacaatactttggatcggctccacggatgtcccgcagtgcttcctccctgcctcctgacgaattacagcagctgacccaacagatcagggaccagctagaggagtccatcacagagaaagtgacgaggcaggtcatgacatccttcagccagcttcagtcgcagatgcaatctcagggacttgcagtgcctcctgagcctctggttggtccctccggtcctcgagtgagcacgaaggggagttgtgctgatcccttaggaaacaatcctaagacgggtgactttgacaggtgcggcttgtacatagaagcagatcctgcccgcctggttgccatggggagagtttatgagggatccactgttgttcataacactcctttgttgcctagccaagtaaaggtgagtgtggaggaggttaaagatgcagatgttccagttcctgtacccactgatgaggtttccttagtggggtag

SEQ ID NO: 24193 - DNA, 288 bp, Glycine max
  Peptide Sequence Number=SeqID_115878
atgattatgaggggccaagacatttatagtagccaagatgaagctactacttttccttcctctagtgaaagtgaagaagcaaaagaggaagaatctagtgaagagatctacccacaagaagaaggacaacctttaatggttaaggaggagtgtaaggaggcaagtgtctcctccaagagtgatcaaggggttcccatgaatcctaagagaataaaggtcattcctgagtgtcccactccaccaagtgttgaggaaaaaacccagagtttcaaaaacctcgggatttga

SEQ ID NO: 24194 - DNA, 1035 bp, Glycine max
  Peptide Sequence Number=SeqID_115879
gtcgactctagaggatcccccctcgcatatcaccatagcaaggaaagtctagtggtggctatcttggcagatttgtttgacacctttgaccggaggtgtgagaaaaacagtgcacggattgtctgttgtttacccgctctttgtgtgtggttgatttcatacctattccaacaagacacaagacacccgtgtccgcttcaaagttatcgctcatgcgccgaaaaaggaagagtcgattgggaccaacatttggcggggatagggggcagcgcaatcaattggtttcctcgttggaaggaaggcaaggaaggagttcttttctcgtgtggggactaccctaatgttccattgatagggactagggggtgtattaattataatcccgcactcgccataagacagctaggaatccacaaggcgtggaggagtccgttgaggaaagacaaggagcttaggggcatccgtaatggcgtcatcggaggttatcatggatggctaagaattcacacgcgagggttagattggctctccaagttgaaagttatcaatgaggagaacttcgaagctccggaggaagatgaagaaggccgagctctaaaattggagctatggaaggcaaggctcgccaaggagaagttcaaatcagctgctacacacatccagaaagagtgcaccgagttacaagaggaaaacgcggccactgcaagagcccttgaacaagtaaccaaaagggcccgcaaggaggaatatggccgagagaaattccgaggagcattgtggggtagcaacaatgagctcaagctccgaagagaggagagagatcggtcacgggtgcatggcatgatcttaaaagaagagttagttgcttgcgcgaggtccaaaaggagtttggctcaacacttggaagccgcggagcaaagcatgctagctatcatagggcaatacaaggaagagttgaaccagtctgtggcccatgaacaaaagctagtggaggattttgcacaagtgtacgccgaaaaagaagcaagagggagg

SEQ ID NO: 24195 - DNA, 660 bp, Glycine max
  Peptide Sequence Number=SeqID_115880
atgttggccatcattaaccaatacaaggagaagctaagtctagctgcaacccatgaacaaaggctagaggacgagtatgcaaaggtgtcggtcctgcaagcagaaagagaagcgagagaaggagtaatcgattcattacacagggaagcaatgatatggatggataggtttgctttcaccttgaataggagtcaagagcttccaagactgctagccaaagctaaggcaatggcagacgtgtactcggcccccgaggaagcagtaaacaccataactaaacatgctttaaggcacccttatcgaacccgttccaaaactagagtcatgggtgacatagaagaggtgcaggaacaaatgaaggccgatatggtggccttgattgatcaaatggcttccatgatggaagccatgttaaccatgaagagaatgatgaaaagcaacacagccacaattgtcgctgccagcgccgccactgaggtgttgggcagcatcagtggtccatacatcgggtataataggaatgcttatccctatggcttaccccccaattatacgccacctaccatgcacatgccccacgcgaaagctaatcatgccattcttgttgagggtcagaaacaacagcctatgggaggcacccgtgaagaaccacgagagtaa

SEQ ID NO: 24196 - DNA, 755 bp, Glycine max
  Peptide Sequence Number=SeqID_115881
atggatcaactccaaagtcaagctttccacaagacctatgggaagatttgggatctagctatgatagaagtctctattgaagccattgcagccctcactcagtattaccatcagccaccaagatgcttcacagatcttgggatgaccgctaggattgaaatggcgagaatagccaaggtagtcaaaatctcagtgcaagaattggatcgagtaaagcaaaatagagatggggtggtcagaataccaaggaagcacttggagaaggcgaaggctttggcggatcgaggtggatgggcttcgttcattgatgtcttggctagtggacctagcagcgatggatgccttccttccttgcttatcaccatagaaaggaaagtccgatcgttgctgttttggccgatgcctatgacacatttgattgaagatgcgaaaagagcggcacaaggatcgtttgttgcacacctgctctttatgtatggctggtctcgcacctcttttgccatgaaagtagacttatttgtcccctgcaaggaaggaagagccggagttttgtcttcatgcgaagggttcttaaacatccccttgatagggatgaggggttgtatcaattataatcacgtccttgctgtcgcaacgtgcctttcgcgggcgagcgaaggcgaggctcacgggtgcgctttccaaaggaggaaagatgcgcggagtcgccaccaacgtttatttgtggaaaacatcgggaaaatcaaaggaaaccg

SEQ ID NO: 24197 - DNA, 234 bp, Glycine max
  Peptide Sequence Number=SeqID_115882
atgcttgtttttccttccagaatattgtgggactttacggattatgcaacaatgctctttttgactttcggaatgttgcggaactttatggattgcacaacaatgcttgttttgatttctgggatgtcgcggaacttcacggattacctaacgatgggtgttaagtacctcgaggcggtcaagcgaaggttgcatgccaccaaacaatggtccctagacgaaattaaggtatga

SEQ ID NO: 24198 - DNA, 210 bp, Glycine max
  Peptide Sequence Number=SeqID_115883
atggcttgcctcccaactatatgtcactcaaatgttgcacacactccagatgagaatgtcgacaactctgcacccatgcccattgagagccaacaacttcaatctgatcatgcacatatctctcaacccataggggagacacatgaagcaccccaagaccacaatctagtcgacttcgagcctcacctcagatatgccactgaggggtag

SEQ ID NO: 24199 - DNA, 492 bp, Glycine max
  Peptide Sequence Number=SeqID_115884
atggaggccatgaaagagcaaatggccacaatgatggaggccataataagcatgaaaaagataagggaagtcgatatggttgcagttgccgctaccaacgctgttgctaaggtgaacccgatgcctccatctggcctcaaccaaatgaatcatccaacctcaaatatggtaggcaaagatttaggaagtacggatgaccccatgatgtgcaaattcaaaacaagcacgccttcccgccatatggcttgcctcccaaactatacaccactcaatgtggcgtacattcccaatgaggatgtcaataactccactcccatactcattaagagccaacaacctcaatctgatcatgcacatgtctctcgacccatggaggagacacatgaaattccccaccacaatctagccgacttcgagccttgcctcggatatgccgctgaagggcaagcagttggtggtatacccctgcaaaacattttggagggcccttag

SEQ ID NO: 24200 - DNA, 150 bp, Glycine max
  Peptide Sequence Number=SeqID_115885
atgccaaaagatagggggaggattgtcatcatcaaaaagggggagattgtagacaaaggatcaagccgatgttttgatgatgccaaaagatcacatgcgactcaaagctttattcaagacaaagcaattaaagatattcaagatggatga

SEQ ID NO: 24201 - DNA, 507 bp, Glycine max
  Peptide Sequence Number=SeqID_115886
atggataatgaagagggcgtgcatgaacagatgaaggccgatctatcggctttaaaagatcaaatggcttccatctcggaggtcatgttaaaactccagaaaactatagaggataaaccacgacaatcgcctccagtacagttagggaagcagagccggtatagtccgcaagcttatccttatggcttgcctccggacttcaccccccgtgccaccccggaagatttaagccaagcccctactttcgaggggcaactcccaccttatgacgactatcccgggcaagacgatgaggaaggagatacccatcttggccccctgctccacctcaaagatccgtccccccatgaactaccccaaccaaacatagtccgccatatcccggcttcacccacacccgtaaaagaatttgttcccttcgcggaagataaggggaagatggaggcacttgaagagaggttaagagcagtcgagggccttggcaattacccattggggatcctctag

SEQ ID NO: 24202 - DNA, 1008 bp, Glycine max
  Peptide Sequence Number=SeqID_115887
atggccacaatgatggaggccatgatgagcatgaagaagataatggaagccaatgtggttatagttgccgctactagcgctgtcgctaaggtgaacccgatgctcccatctggcctcaagcaaatgaatcatccaacctcaaataaggtaggcaaagatttgggaagtacggatgacaccatgatgtgcaaaatcaaaacaagcacgccttcccgccatatggcttgcctcccaaactatacaccacccaatgtggcgtacatttccaatgaggatgtcaataactccactcccatactcattaagagccaacaacctcaatctgatcatgcatatgtctctcgacccatggaggagacacatgaaattccccaccacgatctagccaacttcgagccttgcctcggatatgccgctgaagggcaagcagttggtggtatacccctgcaaaacactttggagggccctcagtatcatccacaaccacaaccctcacgttccacagcggttaaaaccctcatgactatggcaggaatgggaaagttggatcatctagaggaaaggctcagggccattgaaggaggtgaagattatgcctttgctaacctaaaagagttgttcctagaacccaatatcatcacccctcccaagttcaaagtgttgactttgacaaaagatgggggatacgcaaaagatgaggaattgctgatacattccttccaagaaagtcttactggggtagttgttacctggtaccctaacttggaatcttccagagtcccattcttggaaggacctaatggttgcctttgtttaggcagtatcagcacaattttgatatggttccggataggatgcaactacagaacatttgcaaaaagggggatggatctttcaaagaacacgccccaaaaggtggagggatctggcggcccaggtggtacccccaatgatggaaagggagacgatgatcgtgatggtagacacattatcgatactctactatga

SEQ ID NO: 24203 - DNA, 279 bp, Glycine max
  Peptide Sequence Number=SeqID_115888
atggcggcgcagctaatccgtgatcgaatgaacctgcacggacgcttcagcgcactgtggagtggatactacccacgcctacacatatcgtctagtggagcccgttcaagtgatcagagggtgatgaggatccacttcttgaggtggattctcccgaggaagtcatgtcggcatctgaggcagactctacggaggatagtggcccgagggggatggcgatcagcggaggctcttcatcctagtggacagctttttggattagttttgtatactttctga

SEQ ID NO: 24204 - DNA, 423 bp, Glycine max
  Peptide Sequence Number=SeqID_115889
atgaccaaacttggtctctgctgtcatcgggcccgccgcctctggatgacaaaagggtgcagaatgaccaaacttggtctctgcttgtcatcgggcccgccgcctctggatgacaaaaaggtgcggataaccgtaagaatgaccaaacttggtctctgcttgtcatcgggcccgccgcctctggatgacaaaaagggtgcggataaccgtaaggtatctccacgggctaccagctcttgtgtcatggcaacaaaaggcggtgtggtcgacaaaagcgaggctcttgctcctacgtatcctccaatgaggaactcagacctacgtagttctggacaacttgtgagactggaaaaaggctcggtgttttctccactaaaatgcaaacatgctttagcaaagagacaaatattccaactgatttag

SEQ ID NO: 24205 - DNA, 369 bp, Glycine max
  Peptide Sequence Number=SeqID_115890
atgggtgccaagcacctcacaaggaccaaagaatggtcgcatgtcatcaagcaaaggtccccggacgaaaatcagtgtatgacactaatttcgctcctctcggttgacgagagtcgcgggtccccggacgaaaatcagtgtatgacactaatgtcgctcctctcggttgacgagagtcgcggggtgcgatacataggttctcgcgttcatgggtgcagaatgaccaaacttggtctctgcttgtcatcgggcccgccgcctctggatgacaaaaaggtgcggataaccgtaagaatgaccaaacttggtctctgcttgtcatcgggcccgccgcctctggatgacaaaaagggtgcggataaccgtaag

SEQ ID NO: 24206 - DNA, 341 bp, Glycine max
  misc_feature (108)..(108): n is a, c, g, or t
  Peptide Sequence Number=SeqID_115891
cagagaccaagtttggtcattctgcaccgttgtatcatccagaggcggcgggcccgatgatacgcggagataccttacggttattcgcacccttttgtcatccagagncggcgggcccgatgacaagcagagaccaagtttggtcattctgcacccttgtatcatccagaggcggcgggcccgatgaggctgacatagtcttctacaccttttgttcctccgggaacaacaagtcatttacatgcggaaatttcatggtcacccgcgactctcgtcagccgagaggagcggaattagtgtcatacactgattttcggggacctttgcttgatgacatgtga

SEQ ID NO: 24207 - DNA, 230 bp, Glycine max
  Peptide Sequence Number=SeqID_115892
tattgaaagtgattgtggaggagttctacagtctgaaaggagtgtgctgttcctcaattactaaagtttgtagcgtcgtcacaaaagatgtttcacttctgtcaagatggatggcgattgacctctacattcgggaagtggatggcctaagatttgagctatccatgaaccagtgcagtgataagttgtcagaactggcacatgaaattctaaaaggtttgtctgtttag

SEQ ID NO: 24208 - DNA, 358 bp, Glycine max
  Peptide Sequence Number=SeqID_115893
aggtgcttttgaagatggtgaggaggaaaacactctatccatagtgggtcaaggtcatttaatgatttccagtgagcccattgtggaagcaatgtcttccaagaattctttgtcccaatacattggagggtacatcctatgtggtacaagtagagggtacatctacttgggggttgctatactgagaacaagagagggtacatctcttgtggaccagttcaagtggagagtacatccacttggtttattcaaagagaacaagggagggtacatcccttgtggatctttggcttgtaaaggattttacaaggttgaaagaaatctcaagaaccacaggttgcttggggactggatgtag

SEQ ID NO: 24209 - DNA, 330 bp, Glycine max
  Peptide Sequence Number=SeqID_115894
atgaagagattgatcatctttcgagccgcacatggacaaggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 24210 - DNA, 267 bp, Glycine max
  Peptide Sequence Number=SeqID_115895
atgtcatgtctaccttggagcctacctgaatgggtaagtcagactgaacaactgaatttaaataatgtaaatactataataacccatattggtctccactgcagcacacactggcaaatggtcatcattttgcctaaggaaaatcttgttgtcaggttttgttccttgcataacaggctagacaactaccttaagggaataattaacagtgctttgaaaggacttgatgatactccacaacctaaatccaaggttggtattaggtga

SEQ ID NO: 24211 - DNA, 249 bp, Glycine max
  Peptide Sequence Number=SeqID_115896
atggaggagttgattaacaaaacacagctctctccccaaaataatcccaatgtcatcacgccggcttggcgactcctcaacagaatctcatccctgcaccctactgctgtcattttgctctcacgaacaagatgcaatgtggtacgtaccaacaaccaaatcccaggaaatagcctaagcgtgtccacacgacactctcacttaggaaaccatgctgagctcatcgagaccacccggttgtgcacgtaa

SEQ ID NO: 24212 - DNA, 354 bp, Glycine max
  Peptide Sequence Number=SeqID_115897
atgtatgtccaaggaaacccgcgcgtcaatgtagaagcaaagcttcatggtgaatcaaaggtgattcaaaggtgtttgatgataacaatgatgataacaaaagaggatgacaaaggtgatgacaaaaagctcaaagatcaatcaaagaacaactcaagtgaatcaaagattaatcaaagaacaactcaaaatcaagaagaattcaagactcaagaagaaagtttagagtcaagaatcaagattcaaggctcaagatctcaagaatcaagatcaagattcaagactcaagattcaagaatcaagagaaggcttaatcaagataattatgaaaagtttttctcaaaaattgagtag

SEQ ID NO: 24213 - DNA, 375 bp, Glycine max
  Peptide Sequence Number=SeqID_115898
atggtgggttacacaccttcaagttttacagatttggtcttcgccagtgaaaagatcgaagtgggtctgaaaagaggcaaatttaatcatcctgctttgatgaatgagaaaactagggcaaatgaagagggtgagaatgaaggagaaacccatgttgcaactgccattcctacatggccaaacttcccaccaatcccacaatgtcattactcagccaataacaacccttctccttacccaccacccagttatccacaaaggccatcccaaaatcaacaacaaaacccacctaccacacaaccaatgctaaacaccacctttagcacaaaccaaaacaccaaccaagaaatgaattttgcagtgaaaagcctgtag

SEQ ID NO: 24214 - DNA, 240 bp, Glycine max
  Peptide Sequence Number=SeqID_115899
atggctactccagttgcctcgcctcctcctcctcctcctcctgcagacgcagcaacgtctccgtctaccttgaagcggacaaagaattctcaggcggttagtcctttgaatctttgtaaggggaaacaaaatatatctcaggcgggagaagagagacacaaaagaattcaggcggttagtccttcgttctgttggcaaagggagaagagaatgaaaaagatgaatagcataagtttttga

SEQ ID NO: 24215 - DNA, 290 bp, Glycine max
  Peptide Sequence Number=SeqID_115900
tgacttcctttgggtatcgtaaggatcagaatggtcaatggctaaaaaaagacgcactccttcctcaagatgagcgtactccttcacctcctcctcagcgtgaagattcagctctcctgaatgaagtccttaccaaattacgaggtcttcgttcttatgttggtgaacgtttcgactcattggatacacgcttttccggcatggatattcgcctcacactagttaaagaagatgtctccttcatccgtacttgctttgatccaccaccaccgcctccatcatcctcttag

SEQ ID NO: 24216 - DNA, 254 bp, Glycine max
  Peptide Sequence Number=SeqID_115901
atgttggataaacaaggagctgtgggacctgtgaaacctgcagataggtcgaatcatgatatcgatgatcccctatatctgatgacattgaccatcccacaattttttctgaagtcgttccaggttgtgtgggatgctatcgtgtttggggtgtataatgacaacttccccttgtacataaagcatgaatatctacctgaaattgcatacagtggtcaatgtttcagcatctctgttatacaattgtggattct

SEQ ID NO: 24217 - DNA, 318 bp, Glycine max
  Peptide Sequence Number=SeqID_115902
atgcagccctctgaagttaaggacgtgtcgacctttgaaggcgagggcttgcagccttctgaaggcaaggacgtgcagtcctctgaaggcgagggcgtgcaaccctctgatggcgagggcgtgcagccctctgaaggtgagaacgtgcagtcaactgaaggggaggacgtgcagtcctctgaaggtgagggcgtgcagccctttgaatacgaggacgtgcagttctctaaaggcgagagtatgcaaccctctgaaggtgaggacgtgcagtcctctgaaggtgaggacgtgcagtcccctgaatgtgaggatgtgtag

SEQ ID NO: 24218 - DNA, 186 bp, Glycine max
  Peptide Sequence Number=SeqID_115903
atgtcagtgaaaaaccttgtcgagcgcctaggagtacatgacaagaaaaaccacacactcgcaagtcaagtcactctcactagcttaaaggagcactcaaaccgggtgacccccaaggcctacactctgaagagtccatcagggcctctccctcctgattcaggtccaactcaaaaaacattttag

SEQ ID NO: 24219 - DNA, 129 bp, Glycine max
  Peptide Sequence Number=SeqID_115904
atggataagagcttgaaggtaggagaagatgagtggagggagagggagagaaggggcacgaaattttgtgcctctaatgagcccactaatccaagatcaagttcaagattctccaccgagtgtgcttag

SEQ ID NO: 24220 - DNA, 174 bp, Glycine max
  Peptide Sequence Number=SeqID_115905
atggaagttggaagtggaagttactggaagttggaagttggaaatgaaagttattggaagttgaaagttgaaaatggaagttggaaggggaagttactaaaagtggttgtcatcatcaaaaagggggagaatgtaaatcatgaagattttgatgatatcaagaagaattgctga

SEQ ID NO: 24221 - DNA, 523 bp, Glycine max
  Peptide Sequence Number=SeqID_115906
atggcatccttcagccacatgcagtcccagcttcagtcgcagatgcaatctcagggaattgtagtgcctcctgaccctctggttggtccctccggtcctcgagtgagcacaaaggggagttgtgttgatccctcaggaaacgatcctgagacgggtgactctgataggtgcggcttgtacatagaagcagatcctgcccgcctggttgccatggaaagagtttatgagggatccactgttgttcataacactcctttgttaccatggggaggcacttcacaccttccttgcttggccgacacatttggtcaagtctttatcacaacagctgtgtctccgacaaaaccacctccaaagcccgatccggaggtcgatgatccactttatctgatgacattgaccatcccagagcttttattgaggccttatcaagttagatgggatgccaccgtgttcggggtctttaatccagatttccccctctacataaagcacgcagacctctccgaaattgcacacggtg

SEQ ID NO: 24222 - DNA, 585 bp, Glycine max
  Peptide Sequence Number=SeqID_115907
atgaaacgagataaagtacacgaaacaaatggggaccacacgggtacatataatgaattgaaaaactcggtttggggtacttaccggttgaagaccgaaggaaaacgaagaacgaacaatgaatgtcgaagaacggttgaaaatcttcacgtaattacccacggaaacgttacggaagcgcctcggcttggattttcttcacggaaacaatttttctcagcaatttcaagagaatacgaacaaaataggggaggagcttgccacccagctcgcccaggcgagccaggttgcttcctccaaaagcaaccgccttctggaggaagaatctggaaggcccaagtgggccgtccattcgggatcatgtatttactcttcttagcttttgaaaaagttagcaactcacggtttgtcaggtacaacaatttccttaatggagtcttgccaagtactctcgaagcggtcaaatcaaagatgcctatcaagatagtcttcccgaatgaaattagggtaagacagtcctctttattacctcttatcggagataagaggaaagcctcaaaggataaaagtgagatagcagaatga

SEQ ID NO: 24223 - DNA, 114 bp, Glycine max
  Peptide Sequence Number=SeqID_115908
atgccggggcgttcctccactcgccaatttcccagctggaaatcaggagggcatggtcgtaccaaatccaatggcgggcttccttcaccttcttgtctcaaccacgagctttga

SEQ ID NO: 24224 - DNA, 340 bp, Glycine max
  Peptide Sequence Number=SeqID_115909
cgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtaccctcactggtaatcgattaccaaagtgtaatcactctggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 24225 - DNA, 189 bp, Glycine max
  Peptide Sequence Number=SeqID_115910
gatatgcctcacaatggatatgttaggtcactctcattaagtgaaatcatagggagaccagtcagggtcacgctgttttgcgagaatgctccaatcatgtgggatcgacacatgcttaaaggaacacttaaaccgaatgactcccaaggcctacactccgaagagtccgtcagggcctctccctcctga

SEQ ID NO: 24226 - DNA, 1200 bp, Glycine max
  Peptide Sequence Number=SeqID_115911
atggggacaaatcaaaacggaaaaaggttttatcaagtcaaggttaaaggtctagatgtcactagcctcaaggaattgggacgattgatgggacccctccaaaggcaagccttccgcaaagtttacgggaagattctagatttgaccgtagcggaggtatttacggaagccgtcgtatccctcgcccaatactacgaccagccgttgaggtgtttcatgtttggggacttccaaatggtgccaactattgaggagtttgaagagatattaggatgccctctcggggggagaaaaccgtatcttttctctggctttcttccttccttgagcaaggttgcggctgtgattggagattcagcaaaagagttggatcgcataaagcaaattcggaacggcatagtgggcctgcctcggaaatacttggaagacaaggcaagggatatggcaagccaagagaagtggggggcctttgcggatgttttagctttgctgatttttggggttgtcctatttccgaatgttgacggcttggtagacttagccgccattgatgctttcctcgcatatcaccataccaaggaaagtccagtggtggctatcttggctgatttgttcgacacctttgaccggaggtgcgagaaaaacagtgcacggattgtctgttgtttacccgctctctgtctagggtatcccataaggggagcgccaaccgaagaaattctctcgcctttccttgtgagggatctaggcgcgcaaggtctcaaggttatacaaagaatccacaaggcgcggaggagtccgttgaggaaagacaaggagcttaggggcgtccgaaacggtgtcattggaggttatcatgggtggctaagaattcacacgcggggcttaggttggctctccaaattgaaagttgtcgatgaggagaaattagaagctccagaggaagatgaagaagtccgagctctaaagtcagagctagggaaggcgagactcgccaaggagaagttcaaatcagctgctacacacatccggaaggagtgcaccgagttacaagaggaaaacgcggccactgcaagagctcttgaacaagaaaccaaaaggtcccgcaaggaggaacatggccgagaaaaattccgaggagcattgtggggtagcaacaatgagctcaagctccgaagagatgagagagatcggtcacgg

SEQ ID NO: 24227 - DNA, 492 bp, Glycine max
  Peptide Sequence Number=SeqID_115912
atgcttcacttcgcggacttggtattcgccagggaaaaaattgaagtagggttgaaaagagggaagttcgattacgtttcctccacaagtacccatgctaaaagagtcgcagcaactggggcaaaaaggaaggagggagatactcatgccgtcactttggtgcccacatgggtcaagcccccgcagacctctcatggtatacatcaatatgcgcaacatcatctgagcttttcagctcgcgccgggaactcctccaattcagcacccgtgcagcctaaggcacctatccagagggaggccccccaagctccagctccaaccacgactcgcccggccgtcaattccaacgcaatgaggaactttcccccgaagccaattccagaattcaccccactcccaatgacgtacgaagacctcttgccgtcccttatcgccaaccaaatgaccgtaataactcccgggaagatataccaaccccctttcccaaagtga

SEQ ID NO: 24228 - DNA, 155 bp, Glycine max
  Peptide Sequence Number=SeqID_115913
atggatggtgaggagctgccctcgcccgtgaacttcgatgtagttgaggaaccacaatattacgctttgggaatgtccaatgggcatgctatggcagaaaaatccttagggccggatattactggctcactatggaaagcgattgctccgctcat

SEQ ID NO: 24229 - DNA, 745 bp, Glycine max
  Peptide Sequence Number=SeqID_115914
aatctatgttgaatcaccatttgacagggctcctggggttgggatctcttcttgggcaggacatcaaatacatgtatctttaccaattaaccaatttctaaatgctgcagtagatcccaaagagattccacttcctcatgaatttatcttgaatcgggatcttttggctcaactttatccgagttttgccgagggagcaactccctttttcaccttgaattggtcaaaatacgcagaatttcttacttttcgtggaggattagatccagtaactggaggtctatggctgaccgatattatacaccatcatttagctattgcaattcttttcttgatagcgggtcacatgtataggactaactggggtattggtcacagtataaaagacattttagaggcacataaaggtccatttacgggccagggtcataaaggtctatatgagatcctaacaacgtcatggcatgctcaattatctattaacctagctatgttaggttctttgaccattgttgtagctcaccatatgtattctatgcccccttatccatacctagctactgactatggtacacaactgtcattgtttacacatcatatgtggattggtggatttctcatagtcggtgctgctgcgcatgcagctatttttatggtaagagattatgatccgactattcgatacaacgatctattagatcgtgtccttagacatcgcgatgcaatcatatcacatcttaactgg

SEQ ID NO: 24230 - DNA, 241 bp, Glycine max
  Peptide Sequence Number=SeqID_115915
ctgctatccaccatattttccaccttctattggtatccttcgagcctaccaaggaagaatgctggaggaaattatccataggcctacaatggaggactttatcttccttaacccaggaattaaattcccaccacagaggcataactttatggcacgtgaaaaacagatgagaggcagattcaactttgctttggcagaagggacaaaggtcattttcaatgtcgacttgcctcctagataa

SEQ ID NO: 24231 - DNA, 216 bp, Glycine max
  Peptide Sequence Number=SeqID_115916
atgtcagtgaaaaaccttgttgggcgcctaggagtacatgacaagataaatcacacactagcaagtcaagtcactctcactagaatgctccaaccatatgggatcaacataggcttaaaggagcactcaaacctggtgacccctaaggcctacactccgaagagtccatcagggtctctccctcctgatttaggtccaacccagaaaacattttag

SEQ ID NO: 24232 - DNA, 282 bp, Glycine max
  Peptide Sequence Number=SeqID_115917
atggccaacagggtcttggagttgccagctctaaatacgggtctctgtcatcaggtcccccctaccaatcgagctttcatcaagaagttctgcgtctccaggcaggcgcagggcgaaacaccacagcagcctggcgatggccggcaacgggcaacagacgcaccgccatcacctctagagttcacctctgctcatccacaaaaaggtttgagtattgcctacaccacatggccgaccaataggcgaccaagtccaaagccaaaggtagtgaaaataccttag

SEQ ID NO: 24233 - DNA, 234 bp, Glycine max
  Peptide Sequence Number=SeqID_115918
atggggttgaaccaagctcgtgcttttacgaaaagagctagagtaatgggtaaagcggaggaggtacaagagaagatgaaggccgacatggaggccatgaaagagcaagtggccacgatgatggaggccatgatgagcatgaggaagataatggaagccaatgcagttacagttgtcgctaccagcactgtcgctaaggtgaacccgatgcccccacctgatctcaacaaatga

SEQ ID NO: 24234 - DNA, 189 bp, Glycine max
  Peptide Sequence Number=SeqID_115919
atgttcctcatattcaacactagtgctttgaaaggacttgatgatactccacaaccgaaatccaaggctgctgctaggtggattgttgttaagtattttaatgaagttagaccattggaagcagagagattcaaggcacttcgcatacagtgggcacagtattatctaaaagttagaaatcaaacatag

SEQ ID NO: 24235 - DNA, 213 bp, Glycine max
  Peptide Sequence Number=SeqID_115920
atggtgggttacatgctcttcaagctttgtcgatttagttttcgtcggcgaaaggatcaaagtgggaagcctagggcaaatggagagaataagaaagaggaagaaacccatgtcgtggttgccgttcctacatggccaaatttcccattagcccaacaatatcaatacttggccaatatcattcattctcattacccactgttcgaactctag

SEQ ID NO: 24236 - DNA, 309 bp, Glycine max
  Peptide Sequence Number=SeqID_115921
gtcgactctagaggatccccgcaatactttggatcggctccatggacgtcccgcagcgcttcctccttgcctcctaacgaattacagcagctgacccagcagatcagggaccagctagaggagtccatcacaaagaaagtgacgaggcaggtcatggcatccttcagccagcttcagtcgcagatgcaatctcagggacttgcagtgcctcctgagcctctggttggtccctccggtcctcgagtgagcacaaaggggagttgtgttgatccctcaggaaacgatcttgagacgggagttgtgttctaa

SEQ ID NO: 24237 - DNA, 198 bp, Glycine max
  Peptide Sequence Number=SeqID_115922
atggaggttctgcgtacctcgtttgccgccaccgaccaccgcaacgctcgacgccggtaccttcaccttcacgccggtaccctcaacgctgctacccacgaacaagacgcaatgccgcacgaagaagagaaaacgagagaaagcacaacgaacaaaaatggaggtatgaagaggcattgcaaggagattggtggatga

SEQ ID NO: 24238 - DNA, 250 bp, Glycine max
  Peptide Sequence Number=SeqID_115923
atgccgacttcagggatcagggatgttgcttttaggactccgctggcaccttatgagaaatcaaagtctttgggttccggggggagtatggtcgcaaggctgaaacttaaaggaattgacggaagggcaccaccaggagatggtggtgacagactgagaattggctctttcgattctagggagcctgagaaacggctaccacatccaaggaaggcagcagcgcgcaaattacccaatcctgacacgggag

SEQ ID NO: 24239 - DNA, 261 bp, Glycine max
  Peptide Sequence Number=SeqID_115924
atgaggaggactgggtttggctccatcttaggaaggatagattccctactaagaggaaatccaagcttagccctagaggtgatggaccttttcaagtcttggagaggatcaataacaatgcctataggtgaagctaatactgaggaggaggaaccaacaaatttgaggtcagatcctcttcaagggggaagggctgatgcaatcttccctaggaagggaccagtcaccaaagccatgagcaaaaggctccaagaggattag

SEQ ID NO: 24240 - DNA, 272 bp, Glycine max
  Peptide Sequence Number=SeqID_115925
atggcagcacatttgatccatgatcgtgttgtgatggagttcctagagggtgaacccgcacgcacacttcagcaggctatggagtggatattacctacacctactccatatcgactagtggagccaattcaagtgatagaggtgtcatcctctgaagaggatcttgaagaagacctagaggagttacctcctgaacctgatatggacgcccttgacttacctaaggatgatgaagacccactccctgatgttgattccccagaggatattat

SEQ ID NO: 24241 - DNA, 456 bp, Glycine max
  Peptide Sequence Number=SeqID_115926
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccaatttgggagccaatccaatccttatgttcggactctcagccacttatgatagccactgatgatctcattacggcttcccctaagctctctgtcctttcttcacgccgcatcccatgccttgcgaactccttggagtaccctcgcgttgtggtcactgaaaccccgtgcgatgaaaggcgtgatgctttcttctga

SEQ ID NO: 24242 - DNA, 325 bp, Glycine max
  Peptide Sequence Number=SeqID_115927
atccgatgacgagtccctcgaaggtactaatacccgggacccagccatcgatttcaagcaagaagcgggtcagacggagagtgaagaggacaaggatgtgggacttcccccagagttggagaggatagtcgctcatgtggaccgagagatgaggcctcatcaagaagagacagaactagtagacttaggaactggcagtgggaaaatgaaagtaaagataggtacgggtatgaccgcacccatccgtgaagaatttggccctactaaaaaactgccaagacatctttgcctggtcataccaagatatgcccggtttgagttctga

SEQ ID NO: 24243 - DNA, 438 bp, Glycine max
  Peptide Sequence Number=SeqID_115928
atgcccccgactgtccctgttaatcattactccgatcccgaaggccaacacaataggatcagaatcctgtggtgttatcccatgctaatcaccggaggcacgacccggccagttaaggacaggagcgcatcgccggcagaagggacgagccgaccggtgcacaccggaggcggaccgatcgacccaacccaagctggaattaccgcggctgctggcaccagacttgccctccaatggatcctcgttaagggatttagattgtactcattccaattaccagactcaatgagcccggtattgttatttattgtcactacctccccgtgtcaggattgggtaatttgcgcgcctgctgccttccttggatgtggtagccgtttctcagctccctctccggaatcgaaccctaattctccgtcacccgtcacaccatggtag

SEQ ID NO: 24244 - DNA, 324 bp, Glycine max
  Peptide Sequence Number=SeqID_115929
atggaagtgctatcatatagcttgtatcgactaagttcacgagttggagataagcgggactcgaacccgctgacatccgccacagggattcttgtggttccggaggatccagctacaggagaaccgggaacggagagcttcccccgccccccttttttttccgcccgactctttgctcttaagaatactgggttctatggtcggtccgcgacccctggatgccgaaggcgtccttggggtgatctcgtagttcctacgggggagatagtgcatcaagctgttcgcaagggccagcttgatcctcttccccaggatcccaaatga

SEQ ID NO: 24245 - DNA, 273 bp, Glycine max
  Peptide Sequence Number=SeqID_115930
atgtgggccatcattgaccaatatagagagaaactaaatctagcttcaacccatgaacaaaggctaaaggatgagtatacaaaggtattggtcctgcaagcagaaagggaagcaagggagaaggttcactttcaccttgaatggaagttaagagcttcccagactgctagccaaagccaagacaatggcggacgtgtactcggctcccgaggaagttcatgggctcctcaattattgtcagcacatgatcgatttgatgacccacataattag

SEQ ID NO: 24246 - DNA, 211 bp, Glycine max
  Peptide Sequence Number=SeqID_115931
aggatgtgtcaagatagaggaatcactggaagaattcaagactcaagagaaagttagagtcaagggtaatcaagattctgaagattcagattctcaagaatcaaggaggtacaagattcaaggctcaaggttcaaaggaatcaagggagaaggttacatcaacttgggatctttaagctatgtaaaaggattttctcaaaaggttgaatag

SEQ ID NO: 24247 - DNA, 486 bp, Glycine max
  Peptide Sequence Number=SeqID_115932
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatcccgaaagttgaaaatgcaagttggaagtggaagttattggaagttgaagttggaagttggaagttggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 24248 - DNA, 822 bp, Glycine max
  Peptide Sequence Number=SeqID_115933
gtggtggcggtgtgtctattgcccactaccggccatcccaatgctgatgtggtgtttcgccctgtgcctgccacctgcctgggggcgcagtacttcttgatgaaagctcgattggcactccctagaactgacagagacccgtatttagagctggcaactccaagaccctgtttggccttcttcgggtccactaggggaaacgggcgccctgtaggccgacagaggcccgtaaccagagctggaaacccccagggccctgttggacttctttcagggccactgggtgtctttgtgggggggagattggcattgcggtcgctgggcagaatgttgctaagtagcaatgtcatctatatctgtgtaagagtggttatgttggtgcgcatgatccacactcgtctctttgcaacggcacgggtgaaatcttgccccggtatgcatagtagctgcgtgatagcctccctctctggttgtgcttgcacagttggtcgccctccaatattaggggggcagaggaccttaaattatcttaaggtgtggatatggagcccactgaaagtgaggatgcgtagccctctaaaggcgagggcgtgtagccctctgaagttcaggacgtgtcgccttttgaaggcgagggagtgtagtcctatgatggcgaggacgtgcaatcctctaaaggtgagggcgtgtagccctacaaaggtgaaggtatatgaccctttgaaggcgaggacgtgtagtcctctaaaggtgagggcgtgcagccctctgttggcgtggacgtgtagtcctccaaaggtgagggcgtgtagccctatgaag

SEQ ID NO: 24249 - DNA, 276 bp, Glycine max
  Peptide Sequence Number=SeqID_115934
atggtctcttgttgtaaaagaattctaaacacaaaggaaggattgtcctgtgtgtttagaacttgtaaaaggaatttacaagatagtggaactctcaagcgggttgcttggggactggacgtaggcacaaggacaagcaaagctcttagtcccagtccaaactcccctttcgaaattcagatttcaggcttaaataggtgcccttgtttgtgctcgtgcgctaagcgcacttttggcccgttgatcgagaccgtacccgaatcaaataaccattaa

SEQ ID NO: 24250 - DNA, 1158 bp, Glycine max
  Peptide Sequence Number=SeqID_115935
atgcgacgtccgctttcgctctgtggacatacgctgagcacgacaatcagcgcgggcgtcagccgctaccctcaggatggcgaaacgctgcatgagctgaagctcaaggccgatgctgccttacaccatgttaaagaagagggccgcaatgactgggccatttacagaaccgagatgtcaacctcagtcccggcaaaacccggttttctgcaggaactgtctcaggcgctggagcgtgaccagtttgaactgtggtaccagcccacctggcatgcggaagataaaacgatacatggttttgaagcccttcttcgctggcgacatcctgagcagggcgtgttactgcctaatctgtttatccccacgctggaacaaaccggcttaatcattccggtgggtaactgggccattgaagcggcgtgtcggcagcttcatttctggacggaacaaggtttcagccagtggacgctgtcgctcaacttatcccccgtccagttcgaacagcaggacattttccctgtcgtgtcgtcgatgctggaaaaatacaacctgtcgccgtccaggttaattcttgaggtgacagaaagcaccgcgctcaaaaatctcgaccgcagcatcgagttactggaagcgtttaatcgtgcggggatcaccgtctcgatcgatgattttggtaccggctattccaacctgctgatgctgagcgtactcccggcaaaagaactgaagattgacagaagctttgtcacttcgatgctggaaaatgaaaaaagctacaagctggtcgaaaccattatgagtattgcccgtaccatggagatgaatgtggtggcagaagggatagaaacggaagcacagcaggcggagctcacccgtcttggctgcgactatctgcagggataccttttctctcgcccgttacctgccgaacaggcacagtgtgccgataagcaggaaacgcatatgtcacaacattgttttgatacgctgaatgttattaaaacccccgtgtggctcatttcacccgtgtcggaacagattatttttgccaatgtggccgctctgcaggtcatgagtgataaactctcgatgcgctgcgtaaaggcacatattccgcaacggcgcaaagcctcctgtcgatgtatgtctctgaactga

SEQ ID NO: 24251 - DNA, 240 bp, Glycine max
  Peptide Sequence Number=SeqID_115936
atgatttattttagagaggctaagacaataagagtaactttaaaaatttcctcactcgtaatcgattatgatgcaatcctccctaggaagggactagtcactagaaccatgagcaagaggctccaagaggatcgggctagaattgctgaagaatgtcctagggttctcatgaacctcaggatagatttcatagcccatgggccaaggtggggtccaattatctttgtacatatagactag

SEQ ID NO: 24252 - DNA, 264 bp, Glycine max
  Peptide Sequence Number=SeqID_115937
atgagcgttacacaccctaacggtcaatcgtaccatgatcctcgaggaagcattcaacctggaggtacccatccggctaccccagatgaaacctcccatgcgagggtcagacgcaatcagatactatcgatatcaccgcggtattggtcacaacaccgaacactgctgggccctgaaggacaagatcaaagaactcatataagctgggtacctagcccgatttgtcaagagactaggcaaccaccaagcaggagcaagacctag

SEQ ID NO: 24253 - DNA, 468 bp, Glycine max
  Peptide Sequence Number=SeqID_115938
atggctcgagctctggcttcttctggagtcttcatcttgatcttcccattgacggaggtatcgaggagctacttggaatggggtcgtaagccatcaatgaaaatgtttagctgtactagctcgctgaacccatgtgtaggagtctttcggagtaacccatggaagcgatcaagtgtttcacttagcgattcgtcagggtgttggtggaaggatgagatttttaccttaccctctgtggtcttgggctctgggaagtacttcttcaggaacttcttccccacctcttttcatgttcgcaggcaattccccttgaacgagggaagccatctttttgcttcactggccaaggagaaagagaataagttgaggcaaatggcgtcttctggcactcctcctatcttcaccgtgttacatatctcgatgtatgtggctagatgtgcatacagatcttcactcggcaggccatga

SEQ ID NO: 24254 - DNA, 795 bp, Glycine max
  Peptide Sequence Number=SeqID_115939
atgcggcaaaggcctaccacatcggcacgcaggcaatggggagctgtccctattgccgaggatgaccctgtggtagttgctgatgagcctatggtagctgcagacgtacatgacactggtgtagacactagtgtagatgctggtgcggatgatgctgagggatttccaggtggaccacgtgacccatttgtgcttatggagtatgctgaccatattgcatgtctgttcctttatacttcaattcaagatcgtcctgaattgaagttatcctcccatggaaggaacgtgcagaaattaggtaggccttctcctaaaattgagggcctagttgctagcacaggactaagtcatttgatcgcatgttcagtagacactggcaatcggggacttatatcctcgtttgtgaagaggtggcatacggagactagcagtttccatcttcccgtgggggagtttagcatcaccctggacgacgtggcatcttttcttcatcttcgcattgttggtgccttccataccttccagcctctgcacgtcaacgaggcgatgttgatgttggttgagttactagaggtctcaggagaggcagccagggccgagacaacatattgtcatggaccatacgtacgtttatcttggctaccagatatatatcagagcagatgtcaggccggacattggacagctgcagctcgtgtttatcttcttcatcttctaggttgcactctttttgctaacaagagtgcaacccatgttcatgttgtcttcttagacgctctggatgacctgagttag

SEQ ID NO: 24255 - DNA, 789 bp, Glycine max
  Peptide Sequence Number=SeqID_115940
atgtcgcttattggaaaacatctacagtttttaatagatagagaaagtgctgaaggaagatgtcttcgagatgctgttaattatcttaatggatatatggtacattatatctgtcatgacaagcaagtgctaaggatgtttcatgccaaggagttcataacaatggcacaagagttaggtgcaaagatagttgcacacaaatcatcaattgaaaatgctaagatgattattgcacaacctgctccacttgtagtgttaattgaatggattaaaaagcaaaaagaggacctaagatatgaaggaactgttaatgtagttggaacaagtggcaacagccaaagaaattttcaaatggcattagcagatgtcactaatactcagccaaacagtcaacacgtgccaaccagacaaaggaaaactatcaataacatatgtaggcttcatagtaatttgtacaatgactttgtggctgcatcttcaacttctactggactactaaataatgaaatccatgatcattcctttgtacctcaacatgcaaatgatccacttcatcatactaatgaagcctctttagataacaatactgaaaatgcagaaacatatgacagtgtactagatgatgagaatgagctatcagattatgttgatgattctactcatgacattagcacaggatatgttgatctaggcgacccttatgaagcatgtgcatattgccaacatgggaaggatacaactttcttttctcaagaatcttctaatgcctttgcaacaactactatgtga

SEQ ID NO: 24256 - DNA, 935 bp, Glycine max
  Peptide Sequence Number=SeqID_115941
acaacctcaacacctttctagagacacctgtggtactagctgagggtgaaaccttacccgcatattccagatattgcaggccaccctgggaagattctcaagtgtggagtgttctctcatactccaacctggctcctacttcccacaccccggacctgacagtagatcgagctaggctaatctttggcctagtttctcatatggacatgaatgtggaagctctcatctctggtcagattacatctatgacccagtctaactcttctagacttgggttccctgctcttatcaccgctttatgtaagtccagaggggttgcttctgacagcctagtctttgaacgcctgagcccggtcattaacttggcatatatcaggaaaaattgttggaaccctgatgatctgacagttactatcagaggggccaggagagtgaggacaaggccagctaaggccctttccacatctacagctcctcctccagcacgtaccctagcagttccttctgcctcagctcctatggtggcagctccagactctattccttccgtagagcaatttaatgagtgggtagcctggcccggaactcaatcttctcttcacagggtagatgaaggtcccacagcccaggtaccacagcagatggaggatgagtcatccgagactaccactccaaagcccttggtcagaaggaagaaggcagcacaagaagctgcagccacttctgagaaatctcatgaggccacttctgagccttcagaaccagtggcagatacagcttcaattcagcaggcagcagacccctccactcctgaggatcagactacaccagttctgtctccgaacacctctcctacaactacccatgtgcttcacttaacagacgaggaggatgttcagacacaggatactcaggaccgatcacaagatttttaa

SEQ ID NO: 24257 - DNA, 639 bp, Glycine max
  Peptide Sequence Number=SeqID_115942
atggttagaaccagaggattgcgttgggctttaagtagagttattggaaaagtcttagggacccaagttagtggtgatgtggatgaagcccctcagtgtcgaaggccgacaacatctgcacataaacaacaagcagttgcacctgttactaaaaatgttgagcatgtggttcatgtagttgacgagattcatgaccagcctcaagagagagttactgatgatgcacgtgctgatgcccagggttttccagacgggtcccatgatacatcagttttgacagaatatgttcatcatgtgacaaccacagcttgggtagaagaggaacatcctgagttgacattgtcctctcatggaaggaaggtacataaatttgaaaggcctagtccaaagattgaagaaatagtggccgccataggattaagtcatttgatttcatgtttcttagacaccggtgataaaggacgtatatttgcttttgtggaaagatggcacaaggaaactagtagtttccatctttcgattggagaggttgctatcaccctcgatgatgtggcatcgttgctacatctggccattacaggcgtcttccatacctttgatactcttcatgtagaccaagtcgcaaacttgttagtttag

SEQ ID NO: 24258 - DNA, 384 bp, Glycine max
  Peptide Sequence Number=SeqID_115943
atgaagaggtccttcaccaattatcatggggtcttgaagcctgacataatggcacctgaccctaatgttcttgctgattatgttcctactaaactggcagctataattggcaccaatgtcatgttattcagtgactacaagttgcttctgcctcaatcgagtgctactgttataaggtctacactagtaaccacagctagtcatcttaataatacacaaaatccaattaggggctatggttaccattgtcaatatgcttcccctcttgccattggagttggtcaaatggaccccaacaaagcacttgatccaagtttgatatatgatgccaccccacaagactatgttaatctcctttgtgctttgaactacacacaaaagtaa

SEQ ID NO: 24259 - DNA, 729 bp, Glycine max
  Peptide Sequence Number=SeqID_115944
atgggaacaccgccaaggtcccctccgcattcagatggtcattcagagctgacatcgaggaagagtagacaatcgacacggctaagaaggttgactttacgaaccttgcatcagcccagaccgattcctattgtacatgataattggaaacatgttcccgaatctctaaaggacctagtatgggatgacattttggtcaaatttgatatcccagaaaccccaaatgccaagaagaaggaaacactgactgagaatacaccattgattaaggaccctccatctcccattgaaagacatgtgaaatggaagttagtccgcactaagcgatatgggcagatgacatctcaggcggcacaagaaatatctgatagaattgattgtttacaagaagaaacaactcagggtacctttgttccccatggtcgtgatgacatactcagtactgtcattggttcctctacatccatcacccaacaacaactagctgatcaacaatcagttattattggaactcttaaggaagagtggaggaataagttggaacaagaaaacaaacgaagcatagagaaaatgaaggaagagttgaaggagcttgtaggcctaggatcttcttcatcaatggattcctttgcttcttggaagataaatggcagcgaaatggagaaggaagagaaagaggagacgccacttcatggagaagatgagtctagaagaagctcaccaccatag

SEQ ID NO: 24260 - DNA, 528 bp, Glycine max
  Peptide Sequence Number=SeqID_115945
atgatcattgtacacacctggtggcattgggaaaagtatatgaggggggttctaccatacacagcgtggcttatgcagatgatgtggaaagggcaggcccttcacacattcattgcatggccaacaaatcttgtcaaaattgtatcacatgaggattcaagtattactctaaagaaggtgaatgaacctgttcaaagatcaaatgaggaatctacaaatgatttgttgtgtcagctgattaggaccctgtatgacatttacaagaagcctgttgagttattgtgggatgggaagaaatttggtcttccaaatacaaatgcatccttcttcttaacatattctgatgtaaatgaaataatattaggtgacaaatgtctgaacatagctatactacaattatggatgatttcaagcttaggtcatgcttcagtgtatggattccttgagcctcagtccatacacaatgcaaaggataggcgtgctgaatgtcagcattacattgaaacatgggtgaaggaatcccaatga

SEQ ID NO: 24261 - DNA, 340 bp, Glycine max
  Peptide Sequence Number=SeqID_115946
agtgttggcagcaattttgaggttgcaaagtgacttgcttgctaaactagaaccgattcctcaagattgtattgatgacaaatggaaatggatgcttagtgatgcaatcctccctaggaagggaccagtcaccagagccatgagcaaaaggctccaagaggattggactaaagttgttgaagaaggccctaggattctcatgaacctcagggtagatttcttagtccatgggccaaggggtgtgagtagcccctctctagcttctcaaggaagctttcttcctctagcttccgaaggaagctaccttccttacttctcaaggaagcttcccatgtgctag

SEQ ID NO: 24262 - DNA, 219 bp, Glycine max
  Peptide Sequence Number=SeqID_115947
atggaggagtttagacgtgacctcttccaaatgcacattgacaaatctcctgaccctgatgccattgagaccattcagcacatgaaatgcaagacaaatggtaaatttggagaattttccttgaagattgatatcagcaaggtctttgaacaagcggaatggaactatttatttgttcttatgttgaaattggggtttgatgctaagtgggttggctag

SEQ ID NO: 24263 - DNA, 549 bp, Glycine max
  Peptide Sequence Number=SeqID_115948
atgcaattctacacaggattggtgctgcaaactgggtacccaccaatcatacttccactattgccacagcattcagaatcttttgctgtcaaattacccattgccttccctactgtgttgtgtggcattatgttgagtcagcatcccaatatgttaaactacactgactctgtgatgaaaagagaatctcctctatccctgcattacaaactgtttgaggggacacatgtcccagacattgtctcgacatcagggaaagctgctgcttcaggtgctgtgtccaaggatgctctgattgctgaactcaaggacacgtgcaaggtgctggaagcaaccatcaaagccaccacagaaaagaagatggagctagaacggctgatcacaaggctctcagaaagtggcattgatgatgaagaagcagctgaagaagaggaagaggcagctgaggaagacaaagaagcagccgaggaagaagaagaagctgctgaggaagaggaagatgcagcagaagagacagaatcagatgatgattctgaagccaccccatga

SEQ ID NO: 24264 - DNA, 1359 bp, Glycine max
  Peptide Sequence Number=SeqID_115949
atgaagaatttatgcagcgggaagaaattctctggtaccaaaagtctcgatgcaaatggtaagcttttggcagtactcattcaaggaatttccatggttgttttcctcctcgagaggaattcgcaaagtaaccactttgaagagagatcacaaatgaggagattcatagaatcaatggaagattggggattggggagctttaaagctacagggagagatggcctacaagtctgtaagactttcatcccgttagtcattgcaacgtttcttataaagttgttaccatactattggcaaaaaggagaagacacagatattggtggatcactttatagatctaatttggcattgtatccaacaatgaggatgctttggaatggagaagcgttgagtgctttcttctctttgcaaggtcctaggccatcttatttcatgattgttgatgatctcatcttatttgtggaagacagtcttgagcagaggctcagtcaaggacgagtctgccttcttgccattactatagagtgcaaggtgtctaccgtgtccggattgatagttgtgacactctcgacaagaagggttgagataggatcagggcacttcaacatccttcaccacccaatgttgagagaaaggttgctgactttatcactagttcagaaaaatggaattttcatatgctgtaacatctcccagggagcatttggcctacatgaggtagcaatagtcaacaacctcactgccactcatcatcttgatatggagatgatgctacaggtttacttcagcaaaattgcaacctctttcagggaagagtggcttgttctagccacatctgctggcttatccccactggagcttgatttgaatcatgagcctttgcacccaactcatgcttcaaatgataaatttgattctttactggaagaactaaaatctgtccatgaacatgtgcaggaccatattagtctccttgaagcagtaacttccagagccaggcagcgccagaggtggccaccagttcactctccgatccaaataagaaactctgctggagaaactgtggtggtggctaatgctcaagggcgcgagatgaaaggagtagctaaagcatcggaggaggtggaagcaaaagtgagaggctatggaaatatgtttgattgcaacatatgcttgaagatggcaagaaatcttgtgaggtcaatgaaattgacattgttccaatttatgactgatgccagtggcaattgtgatttggaatcaaatgtggctggtttgaaagttcctcctcgacctgttgcacccagaattaagagttttagggagaggcttgaggcggttgagacatacgttttgtga

SEQ ID NO: 24265 - DNA, 438 bp, Glycine max
  Peptide Sequence Number=SeqID_115950
atggagggagaaggagcacgaaatttggtgcctcaaaagagcccactaattcaagataaagtccaagattctccactaagtatgcttaggtggcatgaggcatcccatgggcccgaaatctgccctaagactcttgagaaccctagggccttctcttgcatctctggcccaatctacttggagtcttctatccaatgcccttgcggggtaggattgcatcatagatgtggagacaacttagcaattttaagagctaaattgaagagtcaagagaagcatgtaagaaatttgaagaaaaaatcactatggtctaagattttggaagaggttaaggaaaagctagtagacatcatccattttctatacttggagatacatcaagcatttggtagttctgttatgctttcaagaattgcaaggattattaattatgtttag

SEQ ID NO: 24266 - DNA, 57 bp, Glycine max
  Peptide Sequence Number=SeqID_115951
atggcgatgcttgcaaggattgttgttcttggtacttggtggcatagtaaagcatga

SEQ ID NO: 24267 - DNA, 600 bp, Glycine max
  Peptide Sequence Number=SeqID_115952
atgagtttccttagtggggcaagcacttcacaccttccttgcttggccgacacatctggtcaagtctttatcacagcagttgtgtctccgccaaaaccacctccgaagctcgatccggaggtcgatgatccgctttatctgatgacattgaccatcccagagcttttcttgaggccttgtcaggttagatgggatgtcaccgtgttcggggtcgttaatccagatttccccctgtacataaagcacgaagacctctccaaaatcgcacacggtggtcaatgtctcaacatatcagtgttacagttgttgattatacatcttactgaaacatgtatgcgagtggggaattatgttatccacggattccttgagtcacagcccattcagagtgctatcaagggtcttgatgatgctccacatcctaaatcaaaggcttctgctaggtggattgtcgtcaagatgtccaccatcattttaggaacttttagaaataattgggaagcgtattttaatgatcctagaccattggagccagagagattaaaagcattgcggatccagtgggcacaattttatctccgagttagagatcaggcctag

SEQ ID NO: 24268 - DNA, 1308 bp, Glycine max
  Peptide Sequence Number=SeqID_115953
atgttgagagtgaagggagggagcaggccgccgtgggtggggctcggtgccgccgtttgggtccagatcgcgtcggggaacacattcaccttcccactctactctcactctttgaaatcagttctcggcttcgaccagcgccacgtcacgctcctcggcgtcgccgtcgacatcggcgaaaacctcggcctcctccccggcctcgcctgcaacaagttccccccttggcttctcctcgccgtcggctccctcgccgccttcctcggctacggcctcctcttcctcgccatctccgaaactcttcactccctcccttacataacgctatggtttgctctagttgttgctgctaacagtagtgcgtggttaaccactgccgttctcgtgaccaacatgagaaacttccctgctagcagaggctctgttgctgggattctgaaaggttatggggggcttagtgctgcggtttttaccgagatttacagcattgtgcttcataattcttcttccaagttcctgttgtttattgctgttggtattcctgttgtttgcttcagcatgatgtttctcgttaggccttgtactccggccaccggtgacgaccctgtagagccttatcattttctgtttgtccaaggttccagcgtggtcttgggtgtgtaccttcttgcgactacggtagtgggcaatattattccatttagtggtgctgtttcgtatgttttggtggctgtgatgattctgctactcattgctccacttgctgtccctttgaagatgacattgtttcctaggaatggttctaaatcagactcgccagagcaacaagttgggtcttctgagggcaaagatgagaatgctgaaccactgctggcgtcttcgtcggcaggagcccttgggagttttgatgatcaggatgatttgtctgaggtggccgaacttcttgctttgggtgagggagcagtgaagcagaagaagagaaggccgaaacgtggggaagattttaagttcactgaggctatagtgaaggctgatttttggctgctattttttgtcttctttgttggtgttggcactggggttactgttcttaataatcttgctcaaataggtattgctcaaggggaggaagacaccactaccttgctgtcaattttcagtttttgcaactttgtggggcggcttggtggaggagttgtttctgaacattttgtcagaaacatagaagcattgttccttgatgaacgaaaaggggaaagtgacctctttatagatgatttcaaaaagacaatggaaagtgatttatga

SEQ ID NO: 24269 - DNA, 480 bp, Glycine max
  Peptide Sequence Number=SeqID_115954
atgaagcgtatcacaatcatcctaatgaggtatactgatgtcctattgagtcaagctaccctaaaggcaggagtggggatcattgtgaggcctacagaaggacatgggagtgtgatgttagtaggaggtggtgtagccactctctatgacaagttcactaggtcatatgagcttgatgtagctccatgtggagcttgtaggccttggatctttttcatcaatggaggtacatcctttgtggtactagtagagggtacatcctttgtggtactagtagagggtacatctacttgggttgttgtgactgagaacaagagagggtacatctcttgtggatcagttttagtggagggtacattcactaggtttttcaaagagaacaagggagggtacgtcccttgtggatctttgcttgtaaaggactttacaaggttgaaaagaaatctcaaggaccgcaggtcgcttggggactggatgtag

SEQ ID NO: 24270 - DNA, 2244 bp, Glycine max
  Peptide Sequence Number=SeqID_115955
atggcgagattgaagataggagggacatgggcaggggtgctggaagaggtggacctccaggcgtggaccctggctacgctccgcgacctcgtcgccgcccgatcgaactccccctcctccgactccatcaacctcatctgcgccggcaagattctcaaagacgacgccgttccgccccaaactcttgcccaactcggcgtcaagaacaatgcgaagatcctcgccacgcgcacctccactcctcagcaaggacactccttcctcgcccaggaagaacgctcctccagactcgcgcgtataaggttacatcacgcaccttcacacaattttaatttggaaattataagcgtcgccatcgtttttggtgttgggagagcaagtgtacttttgagagtaatcaaacatgtcacacaattgagttattatccaaaagtacgttcagcggcagtgcccagaagtactgtactttttgaacgggcggctgcgaatgcgatggcggacaggcatgcggatggggcattgccagttgaagacttcaatattgaagttgaggatcagagtggacagaaagtgagattaggctctgagactgatcagagggcagtgatgatgggactgatgcttcacgcgaaggggaagcgacttatcagacaggggaattacaaagatgcactggaagtgcttagcatgggagagctcattgacaatgttccaatactacaaatagacatggtatggtgctattttatgatacgagacatcagatggctctcagatgcaggaaagcgtcttgaaatggctcgggaaggtattgaacgtgctcatggaaaggattcttttcgcctcagactcttacaagtaggtcgatatccagaactcgcattgcatttgagactagagctacttgaaggggtagtggcatatcatattggccaattggagaaatccaaaaaaacattagcctcagcaaggacaaagtttatccaggtttgggttaagagttggggtgcggtggttcaaagcattgttgtcttgccatcctcctctgatgtctgctactcgctcttggtctctgatgcggcgctggagttgtgtgggttcgccctttccgtgtcggtttttggtgatgaagccgtgagtgaccatgacagaagcgacggagggaacaaaacaccgtcggaacaatgcaacgccaccactgggaatgtcactggtggcatatggttgtctgtgactgatctaacggctgtaaagtcatttcccacggtgggagaccttttaaggtttcacagacttagcggtaccgccacatcatctgccatattgatatggcgcataaaggtgttcaccgccatctgctgtaaaacgctattgataacttgtcaggcactcacattatcagaaccttgtttcgcatcccagctgcaagtgccagatgaagccttatcacttgttatgagcatgggctttgttgaacgcgatgcaaagcgagcattgcgaatgaacaatcaagatgttgggggtgccattgatttccttgctgaggagaaggcaaagaaattgcaaaagagggaggaagatattcggaggagaaatgaaattaaggaacaaaagcagtatgggatgacacccttaaagaaagctgtggatctagagagattgaaggaattggtctctattggatttgacaaggagcttgctgctgaagcccttagaagaaatgaaaatgacactcagaaagcattggatgatttgacgaatccagaaactaattctgctttgcaggtcaatatcgagtcaaggaaaaggaagagacagaaacaagcacgagattctgaaattagaaacgttgtgcaaatgggtttcgaaagatcaagagtggttgctgcttttgaggccggaggtagtttagaagaagtattgcaaagactaacagcacaacctgggactgaccccacacaacctcaagaaaattcagcttctgcttcccatggtggtgcaagttcatctgctcctttgccagacaatgttgattctgatatagcgatgaacgaggttgaagatcccagtataacagaacaacgcgatgtagagatggaagatgagctctctgcagatatagcgaaagcagatgccttggctgattatgacatcgaagttaacgtcgaaggggaagccataaccgagtacctttccctggttgagtcggcaggcagttgtgggaaaactgctccctcccagtaa

SEQ ID NO: 24271 - DNA, 258 bp, Glycine max
  Peptide Sequence Number=SeqID_115956
atgggagttgctacgtgcacccagcaaaattgctgtggcacccagcaaacagtgaatgggcaattatgcccctctgagaagactattttcggaagactgtgtttccggaaaacttccggaacaacgttcttccaaaagaagaaggaagacttccggaagaactccagaaaaacttccagaagaagtgtcttccggaagatttccggaaaagcagtcttccggaatacttcattcttcttccggaagaaggtgaagtaa

SEQ ID NO: 24272 - DNA, 448 bp, Glycine max
  Peptide Sequence Number=SeqID_115957
caatgacttccaagattattttgatgatgccaaagaatcaagagttaagcaagttccaaagaatcaggagtcaaaaagcttcaagaatcaagtctcaaagaatcaagattcaagaacaattaagtttcaagtttcaagattcaagaacaatcaagatcaagattcaagactcaagattcaagagaagttgatttcaagattaaagagaagaaatcaagaagcaacagtcaagactgcacaagagaaagggtacatctacttgggttgttgtactgagaacaagagagggtacatctcttgtggatcagttcaagtggagggtacttccacttggttgttcaaagagaacaagggagggtacatcccttgtggatctttggcttgtaaaggattttacaaggctgaaagaaatctcaagaatcggtggatgctttgggactggatgtag

SEQ ID NO: 24273 - DNA, 1059 bp, Glycine max
  Peptide Sequence Number=SeqID_115958
atgtctctcgaggaaaacatgatctttgaattgcataccaagaaagggacttggaagatagcagtacgaatcactaatatgtggcatgttaacaagcacaatggtagacaaggtgcaaagattggtgccactcttcggcaagaattgtttcgcgaatttgaggcaatgttgcattgtggttctgcatatgtgattcaggacattaaggttgttgaaaatcattctgaatacaaagtgagtacgattccatttttggtttacttggtgaaaactattgtgaaggaggacgagcatcctgagattcctactaatgtctatgttattacttcatttgctgatattattgatggggtagcaccgcgtgacactttagttgatgttgttggtgttgtggccgaagtcattgagcgtaaaacagttaatcctacatatagagttacagtcaagttgagggataacattgatagggatatgatcttgaccgcctgggaggaatatgctcttcagcttgatgatgctatagagaaaaatcattttgataggaagtcaatggtggttatgttaacacttgctaagatcaaagattctaaagttggcagactatcagatcaaggaagtgtttctcaatcacaatatagccaatattcccaaggaagctctgtggacaagttcttgcataatgctcaaatggtgacattaggtgaaataagcaggttgagacaggactattattgtttgaccgttggtatggtggacgaagcaatgattgatacaccctggagttatgatagttgtccctactatactaccacatttgatccattgaaatttggtttcacttaccgttcgtgccagaacgaagttgctaacacggttccaagaatggggagaagaccaacttccatttctaggatggaacatagtagtgatgacatcaaggttttcccttcctgtgttgataaattattgggaaagacttgggctgtcaggttcaaataccgtgtacaaatgcatcaatcatctgtgttggatgttactcacgatgaagatcttatttag

SEQ ID NO: 24274 - DNA, 1516 bp, Glycine max
  Peptide Sequence Number=SeqID_115959
ggacagcattgtaataaagaaggccgggggcagtctgaaagagaagaaggctaacaaatctaaaaagaaggccaaggaaagaattgatgagaagaaggatgatgttaaggaggttattgaggaaaaaagtaatggtagaagtgaagatatacctaagaaaacagcaaaacttatttttggtgaggatataagatgggctgaattgccacttaattgcagcctccttcagctgagagaagttatttgtgaccggttccctagactaggagcagttcttgtcaaatatagggaccaagagggtgatctggttactatcacttctgatgaagaattaaggtgggctgaaactggatcacagggttctatccggctgtacatagtggaagctaatcctgatcacgatccattatttgagaaatttaatgtaaagaatggagaaaaggttaacacttatagttctcctgtgaatggttctgtggtgaaagcgaaggacattattagctcatcatgcattgaggactggataattctgtttgcacaactgttcaagaacaatgttggatttgaatctgacagatatttagattttcatgaatttgggatgaagctctattcagaggctgttgaggagacaattacaagtgacgaagcacaaggcatatttgacattgctggtggtaagttccaagagatggcagctctagcattgttcaactggggaaatgtgcatatgtccagggcaaggaagaaagtgtattttactgaagattcttcaaaagagcatatgcatgaacaaatcaaaagttcgtatgaatgggcgcagaaagaatatgcaaaagctggggaaaaatatgaaacagccattgatattaagccagatttttatgaaggcttcctggctctaggacagcagcagtttgagcaagcaaaactttcttgggattatgcactctgtagtaatgtagatttagcaacatggccctccactgaggttcttcagctttacaacagtgccgaggaaaatatggagaaaggaatgctgatatgggaagaatcaggagggcaacaattgagtgaaatctttgatcccaaggatattggattacatctgcagaacatgggattggatgggctattcaaaaatatgtcatcagatgaaattgctgcacaggtggaaaatatgaagtctcaaataaatcttctgtggggtaccatgctatatgaactctcgatagtggagttcaaattagggctaccggtatggcatgaaagtttggaagatgcagctgagaagtttgaacttgctggagcttctgcaacagatatagctgtaatgttgaagaaccactgttctaataacactgatggtcttggattcaaaattgatgaaatagtacaagcatggaatgagatgtatgaagctaaaaagtggcagaaaggtgtttcatcatttcgtttggagcccttgtttagaagaagaatatctaaagtttaccatgcctttgagctagtatga

SEQ ID NO: 24275 - DNA, 1236 bp, Glycine max
  Peptide Sequence Number=SeqID_115960
atggttgcttctgaatgtgctgcagcattttcaccgttgaaacttagattaggtggaagtttgcaagacaagctaatatatggcactgaagataatcaccaaccttgtactccttttgttaagaacccttctgagatgtttagtttcacgcaagggtgcctcccaatggatagatgggatgaacttaactacttttttgaaaaagcaggggctaagattatctttggattaaatgctcttgctggaaagtcaatacacggtggttctgcaaaaggaccttggaactacaccaatgccgagtcctttattcgatacactgttagaaatggctacaccatttatggatgggaacttggaaatgaattgagtgggaatggagttggaacaagcattacagcagagcaatatgctttggatgttgctgctttacacgatgtagtttacaatgcatacaaaaagattgagcctaagccactagtcattgcaccaggaggtttctatgatgcaaactggttcaacaaatttataagcaaatcaggaaaatctattgatgtggtcactcaccacatttataaccttggaccaggagttgatgaacaccttgtggaaagaattctggacccttcctatcttgataaagaggttagcacattcagtggcctaaaaaatatacttgcagctgcttatgacactaaaacatattgcagacagactttgataggaggaaactatggtttactcaatactaccaattttcttccaaatccagactactatagtgctctactttggcaccgactcatgggaagacatgtactctcaactaccttttctgggacaaacaagataagagcttatgcacactgtgcaaagcaatccaaaggaatcacagtactattgatcaacctggacagcaacacaactgttgaagcagaagtgaccttcaacaacgccgccaagagtttgaggcacagaaagatgtctactcattcaaaagtgatggaactacctcttgcaagtgaaacagcaagagaagagtaccatctaactccacaggatggggatatacatagccaaatcatggtactaaatggaaaccctctgagtgtaagctcagatggtgatattcctcctttggagcctataaatgtgaattcatcagagccaataagggttgctcctttctctattgtatttgctcatttacctgatgctgttgtttcagcttgcggctaa

SEQ ID NO: 24276 - DNA, 645 bp, Glycine max
  Peptide Sequence Number=SeqID_115961
atggttacgctaattaatggagagtttcatccatctaaggttgcggcaaaggctgtcactttgtccattaggcaacaatttggtcagccttggcctacatggggagcgattccaaaagatcaccacaaacttttttttcagtgttttaagtcaaaggagcttggtcgatctgtatatgtagatgcggtctttcagcaaactcatttacgaaagattactggtcagtttgtagatgatagatctagacggacaaatgaagaatttgagtctggactatctcaagctaggtttgatggtgcatcaagtgttggtgaatcccaactcactccctcagaccctgctgaagaacaaagacttaggagtcagtgttgggttgcagctgtcggaccaaagcataagggacacctttatggtactgaagaccttactcatacttacaaatgcggaaatgacagcttcatgcagcatacacaaggatcttttagtcgcgttgaagatgttgtagagattaaccgcctgagggaggagctacgtcaatcaaaagaagagatgcatgtttttcattcagtagtccttcagttcctacctctagaggcgcgaaacattattcatcaacaacatcaacctcaccagcaagaccaatag

SEQ ID NO: 24277 - DNA, 330 bp, Glycine max
  Peptide Sequence Number=SeqID_115962
atggcggaaccatcgaacaagcgcaagggttcttcaagtagaagccaacgacactccgaggctcaggatactccaattccttcctccatttcctcatcctcattgttctcatcgaaagaacaacgtacacggtacacaaacctcttctcctctcattctatcattgaccctaagttcatagatatggatttcttttctgataagagtttcaaatgcattcatgcatttcataactcaaatcttattccctttatgtccttaaaactgtctatgtattatgaattggtaaaatcttttattctaaccttgaattcaagagggatcctctag

SEQ ID NO: 24278 - DNA, 309 bp, Glycine max
  Peptide Sequence Number=SeqID_115963
atggctttccttcgatctaccttggcaacctcaatggttcttttagcaatgctatccgttgcctccgcaactgactattatggatatggtccaacaccaaagcttgagaaccccaaacccaaaacagattacaaatttgacgacaaaccacatcctacaaaaccagattattatgcaatgcccaaatcaaaaggaaacgatgaactacatctgcttcccacaatcattggtgtccaaggagttgttttacgtaaaacatattctgtaagaaatggaatacatactgacacatccaagccagagatttag

SEQ ID NO: 24279 - DNA, 252 bp, Glycine max
  Peptide Sequence Number=SeqID_115964
atgaagagagttgttgaagaaaaacccgtcatcgagaagaaggtgccgttgaagatggcttgcaaaaccatcaacgaggaagaagaaccacgtcgacacggaacagaatcactttgcagctttgttttcagttgtcacgtagtgtggagaagaaaagaaaatgggtttgagcttcccgtatccgagccatattggagtcgtattgaagccatgtctagccttaggaagccgtatctaagccgtctcccagcc

SEQ ID NO: 24280 - DNA, 636 bp, Glycine max
  Peptide Sequence Number=SeqID_115965
atgaactctccaaatgtaaagtggaaggcgaatctcagaccaactctaaccaggaatgcaattttaacatggaaattgaaaatgatgaagcaagtccttgatgacctagaatttcttgaaagccaaaagggccatctaggtttgaaagagtgtgttggatcaggatcaggtagtaaagggtcacaaaaattaccatcaacgtctttggtggttgaaactgacatttatggcagagatgatgacaaagaaattgtctctaattggttggcatctgacactgacactcgtaaccagctatcaatactttctattgtgggcatgggtggagagtgtaagaccacacttgcccaacatgcatacaacgacccaaggatagagggtaaatttgatatcaaagtttgggtttgtgtttctgatgattttgatgctttcaacgtaacaagaacaattcttgaggcaatcactaaatcaaaagataagagtggaaatctagaaatggtccatgaaagattgaaagaaatattgacaggaaaaaaaattcttctcatcttggatgacctttggaatgaagatagaaagaaatgggaagtagtacatactcctcttaattatgggatagaaagaaatggaaagtag

SEQ ID NO: 24281 - DNA, 384 bp, Glycine max
  Peptide Sequence Number=SeqID_115966
atgaatctctcaaattgctccaaacttgtcgcctcgctgaaaaagactttggggtccaacacctttttagatatcttgcgtgttggaaaactggatgtgaagtcttttcctgatgaaggaattgattcttcacgactcattattaaaaaaagggccttctacatcggttctaatggcctttctacatcggttatgacgcgtggtggtaacccagtgtcgttgaataacgacatcggttggaggaccatctttgaaaggcgatctttctacatcgattgtgtagctacaaccgatgtagaatgtgaattttctacatcggttctaagaatgaaaccgatgttgaatgggaaggcttctacatcggttatcagtcaaccgatgtag

SEQ ID NO: 24282 - DNA, 240 bp, Glycine max
  Peptide Sequence Number=SeqID_115967
atggatgagggatggaatcaaatccagtttaacctggttgatttcaccaagagagcttatggtactaattatgtggagacactgcgagtacaggtccatgcaaactgtcgcctgagaaggatatacttctctgatcgcctgtactctgaggaggaactcccaccggagtttaaattgtaccttccgatgcaggcgtttccttctcctaggaagaacaatgtacagaaatgtggatattag

SEQ ID NO: 24283 - DNA, 672 bp, Glycine max
  Peptide Sequence Number=SeqID_115968
atgcctattacgggttgcctttcgaccaagcaggatgtgcctccagcttcaccagttgtcgaggctcctactgctatttttattgatgttgttgttactcttgttatccctgctcattcaccttctcttgttgctgatattgtgaaggaggcagcttctgctactgctaaagttgttgtgccagccactcaggctggttttgttatggttttgctatccaccgtcgcgactcctttattaagtgtcggtgtggagaccacgggtgcttccactatgcctcctcctttgtcaacttcagtggctctttctgctattgtcttggagtttggccattctggaggagaatggactacgactccaagaggcggtgcaaaaagtgcatccttagaggcggtggtcaccaagtggacggctactgctcggactctatggcgagtggaccgccctaaggtggcaaccgacaaagagcttgaagaggagttgctcttgtacaagaaggaggttgtggagcatcacaagaaggactttcaaaaggctatcggacatgctggtttatttgcgaaggacctcaacttgggtctcttcgatcccttcaaggatgtgaaggatggcgtcctgcttgataaggaggagattgctactgaggaggaagaggctgttgatgaagggtag

SEQ ID NO: 24284 - DNA, 279 bp, Glycine max
  Peptide Sequence Number=SeqID_115969
atgattatcaaaacccctatcccgccagctcgaaaggcggcttcactgcccctatcctgcagaacccagtggcgggatcctctctgcccctgtcccgcagccgccactggcggtaccaccctacaacaccctctctctcctgtcccgccagctccaagggcgggaccaccccctctctctctcctatcccgccagctccaagggcgggacacctctctctctcctatcccctcccatcccgccagcagcaatggcggcacccctccccctctctcctag

SEQ ID NO: 24285 - DNA, 744 bp, Glycine max
  Peptide Sequence Number=SeqID_115970
atgcctattacaggtcatatcgttgatcacacagacacgagctacaccaagaaagagatcacaggatcactctcaccaccatgggtagctaatcctcttgctatttggattggatatgaattgatcactcatttcatgattcaaggtttggattctaactgggaagtattatccaaatgtggatctaaatcaagtcaccaaatggttataattgctaggaatagagttagaattgttggttggcataggtgttcgagcatcatccaagcattccttgttgagaaaagagaacttggaccttttgaggaccaggcatactcctttggccacataagagttgggacaaacatgtggttatatctaccaaagagggttttgaggaaatttgggtatgtacagaggattcccttggagccactcgagtttcctgctgcatatgagaagtgtagtgaggcatgggatgagtgggagaaacatatggatcggttcccgataatgcaaacaacaacaactactaacatagacttatcatctaaattagagcctgttgttgccattgatccacgcatcagaacaatgatctctttggcaaatgttgtttttcttggtttaaatagaagggcaaggatttctttaggagagcacccaaccattgcatacaactcaattgatcctttagaactaaactccaaaaagaagaaacacatcttccccatttcattgtcatctttaagctccatatag

SEQ ID NO: 24286 - DNA, 474 bp, Glycine max
  Peptide Sequence Number=SeqID_115971
atgtatagaaccaacttcgggattggtcacagtataaaagatcttttagaagcacatactcctccggggggtagattggggcgtggacataagggtctttatgacacaatcaataattcaattcattttcaattaggtcttgctctagcctctttaggggttattacttccttggtagctcaacacatgtactctttacccgcttatgcatttatagcgcaagactttactactcaagttgcattatatactcatcatcaatatatagcgggcttcattatgacagggccctttgctcatggagctatattttttattagagattataatccagaacaaaatgaagataatgtcttagcaagaatgttagaccataaagaagctatcatatcccacttaagttgggctagcctctttctggggttccataaacgaccgaagcaacatcaaatccctagggccttctccaaatag

SEQ ID NO: 24287 - DNA, 1152 bp, Glycine max
  Peptide Sequence Number=SeqID_115972
atgggagagcggtggagacaattcaagtctaatttgacgtcgaaatgggcacatgtagccgacaaggaaagtgtcaactacattgtatgcgaaaagtacggcattagcaaggagaagatgtgcgaaaaaaggtacaggccatctagaagcaaaacattgtccctcacgtgttgtctcatggggaaaaaattggaagaagctgctctatccgaaagcactgacaccgtgaattatcctccatctctcatcagacgacacatgaaatggaagatggtccacaccaagaaaactgggcaaatgacgtctgaggcagcaaaggaaattattaacaagattgactcacagggttcctttatcgcccatggacatcaggatgtactgattgctgccattaggcgaccagaacaccctggtcgtgtgcgtgctgttggagccggtgtcacgatcaagcaatactttggaccggctccaaggacctcccacacgtcttcctccatggctcctaaagacctggaggagttgacacaacaaattagggaccagctggaggagtcgatcacaaaaaaaggactcgcactgcctcctgaacctgaagttggtctttcaactatttgtgtcagcacaaagaagagttgtgttgatccctcggggaatgatccagacacgagtgacttagacaaatgcgggttgtacatcgaagaaaatcctccgcgcctggttgccctaggaagagtttatgtgggatccacaaacattcacaacattcctttgttgcatgatcaagtcaaggttggtgttgaggaggttagagatgcatatgctcccattcctgtatctactaaagaggttaagttagtggggcaaacacttaacacccttttcgcttggccaacacatcttatcaaacgtttatcagaacatgttatgtggaatgctaccgtgttcggggtgtttaataaagagttttccttgtacatagagcgtgaagatctgtctgaaatagcacacggtggtcaatgtctcggtatctcttttatacagttgtggattctgcatatgactgagacaagtatgcgagcggggaatatcgatgtgtatggattccttgagccacagtcgatccagagatttggacaatcacaatttgaataa

SEQ ID NO: 24288 - DNA, 915 bp, Glycine max
  Peptide Sequence Number=SeqID_115973
atgagtgaagaggaaaacagtggagagagaaacagtgggtgggagagagttaggaatagaagggagaggagagagagaaccaaagcgagacagagagagggtacatgtctgagtatcgccggaaataggaaaggatatcaacaaagctacatgcgagagaattggagagaccataaggatgtaacgtctttctacttcacttggttccctgatgatgcaactgaagaagatttatggggtggaggacaaacgccaattagagaggaagttggactcgtcttcggtgggctaaagatgtatgctaaccttccaaaatttggaagagttagggatcgaaaatcacatcaagatgtagaggggcgatcatatattaagcaaggggagaaggaaaatagagatgcatacctgcaaatgaagcaaggagtatcattggatatgaagcgaggctcgtacgctgatgttattctaggaataaactacgagcagaacaggggaattcagcaaacaaggaaggcaacaggtcacaatcatcgcgtagaagacgacatcctctgggatttcgatgataacaaatcaccgaaatacatcgaagatgacatgatcttgctcctgggcctcactgacgacaaagcaaggcaactgatggatgatgaaaatgaagatgggactacgatgttccacaccttggaaaaatggaatccagggatgcgaccagcaaatgaagaagatggtgctggtatcggggacttggtggaagtcgacgatgacatggaggaaccacgaaagctagatatcggggacatgaagcaaatgaagaagatggtggcttgtatcggggacttggtggaagtcgacgatgacgtggaggaactacaaaagctagatatggcaaggatcttattaaagacatcgtga

SEQ ID NO: 24289 - DNA, 561 bp, Glycine max
  Peptide Sequence Number=SeqID_115974
atgcaccctaactgcccactgggatttttgagggaaggaggtagcagaaatatagaaagcttgtatagcacaaaagtcctccatggaatgccccttattggcatgactaagattttcggccaagacaaaagtacaagcataaaccatggtaaagcccattttaatatggttgtcatcagagagcatcttgccattaaggatgcgctagtgtcgcaacctacccttcggcgggagggcgacgcgagactcgcgggatgcgtgttccacgaaaggaatacgcgcggagtcgccaccaacgtttatttgaggaaaacgtcggaaaaaccggaaaagacgcgatctacgaactttttagtgaaaggttcgggagttgtatttacgcacggggaagtctcggattcgaaaacttacccgttgaagaacgaagaacggatgaagaacgatgaagaacggacgaaaaccttcacggatttgcttacggaaacatctcggaagcgttacggaagcacctcggcttggattttcttcacggaaacaatttttttcacccaaaacagctga

SEQ ID NO: 24290 - DNA, 309 bp, Glycine max
  Peptide Sequence Number=SeqID_115975
atggaatggtcagaaatagccagaatcaccagcaaagagtcgcattcaagccaaaaagaatgtcaattcttactcttggccattttgatagcaagaatagcttctagcaattatgtcccaaatgcatcagcacctccattgaaggaggccaagaaaccagtggcgacaccggcccctatcatctcaaaaaataacacccgcaattgcagggccaaggtttctgatagggctgagagtatgggtcagcttgtggaaaggcccaagaggaagaccacaacgcctaggcacctaaaggattatgttcactag

SEQ ID NO: 24291 - DNA, 309 bp, Glycine max
  Peptide Sequence Number=SeqID_115976
atgtggaccacacgggggaggagcttgccacccagctcgcctaggcgagcaaggttgcttcctccagaagcaacaaccttctggaggaagaatctagaaggcctaactttcgaagaagttacgaaaactcacggattgcgtaaaacacctcctttcgatttccgtcacattacggaattttcacggatcgcgagtatcttcactacctcgatgaggaggattaatagcaactacaatggagcaaacattatgggaaagaatattctactacatatgctagttccaaccctcttgagaggcattggctga

SEQ ID NO: 24292 - DNA, 129 bp, Glycine max
  Peptide Sequence Number=SeqID_115977
atggttctttttgtaggtgaaaagatgaagaataaaaaggttgcagaagctggtgtctcgctaagcgaggcatatgcacttagcgagcaacatccgctaagcgaggcattagctcgcttagcgagttag

SEQ ID NO: 24293 - DNA, 441 bp, Glycine max
  Peptide Sequence Number=SeqID_115978
atgcacctcttacactctgtgataaagcaagaccagacagactcttcaagcatgaagtggctgcactgcataagaagagggagcttacaagtagagattagcaagctttgcaaagatatggccatggaatttatgatggtcctccttcatccgaggagtgtgtcaattttattgagaaaacattgctcagaaccagggagacacttgctgaagctcttcatgatagggctcatgctgaaagagaagctaaaagatggaaaatctttggggaattcttattttagaattttgctgaaactccaatggacatttagtttgataacgaatttagagatgatttctttctcatacttaaagaggaagaagcaactgccaaacaaaagggggagaagaagcaaaagaaacaaaagagggagaagaaacacattagtagaatcatag

SEQ ID NO: 24294 - DNA, 789 bp, Glycine max
  Peptide Sequence Number=SeqID_115979
atggcccaagaaggttatcaggtgttacttagtgcacccagtatttttgttgggacacctagcatttgtgcgcgattccttccttctacgctgcttcttcgtctttctcttcctcttcatctatcttcgtcttcctcttccgcttcctctgttggtggttgttggttgttcctcctgttggtgcttgttggttgttcctcttccactgttggtgcttgttcctctttgtctgtcaccgttggtgcttgttcctcttcatcttccactatgcacctctttgtcttccacgaattgatcgacgaccagccagaagcacctgttgaagaaggtgttactgatgttgagggttttccaggtggaccccatgacacgtcaattctcacagattttgaaaatcacatcgctttgagagtgtggaatggagaggaatgtcctgagttgaagctatcttcccatggaaggaaaatgactaagtttgaaaggcctgctccagagattgaaggccttgtggcgactagtggattgagtcctttgatcgcttgttccctagatacaggcaatcggggactaatgtttgcatttgtggaatgctggcataaggaaactagcagtttccatttgctcgtcggagaggtgactatcaccttggatgacattgcatcgttgctacatttgcctgttataggggcgttccacaacttcgagctacttcatgtcaacgacgttgtcgagatgttggtggaattactcgaggtcagcgctgcagaggcaagacttgagacaatttag

SEQ ID NO: 24295 - DNA, 489 bp, Glycine max
  Peptide Sequence Number=SeqID_115980
atgggttttatgccacagactactggacaaggcattagtaacttccttggtgaatttttgggatatgacgagaagaatggcaacaacttcttgcgaattaggatactaatagatgtacacaagaaacaatggagcactatgaggctctcgttggttgcgagaccttccttcccttctccaatggcggaaagcagtgttgtgcagggaagacataattgcaacaaacttgacacaattaatgcaattaatgtcaaaatggccaaaaacactaaatttctagtggaacttttcaagaatccaaaatcgattctctcaaaagcttatgcacaatcatcagtcattagtgacgataatgataaaatgattagtaacaatgatggcaatgatttggtgttcaaagaaaaaaagcaacgcattaaaggtagtcacacacaatccctcaacaaggagtcaatagcatccattgaccctataccaacagtgtcataa

SEQ ID NO: 24296 - DNA, 465 bp, Glycine max
  Peptide Sequence Number=SeqID_115981
atgagagatgataagaaaagaaaagtgcaagatgatcaaaaagctaaaaacattttaacttctggtttgtcttctgatgaattctttcgtactgcaaggtgcaaaagttcaaaggaaatttggaatatgcttgaagtcactcatgagggcacaatggataacttaggaaccaaagattacaacaatcaaggaatccaagaatctagctacaatgacgatggaagctctctttggaagtctaaagacagaaaattctacaaatccttcaagaagattgagaacaagaacaacaacttcacatgcttcaaatgtggtaagcaaggtcatatcaaatctgagtgtcccatctaccttagaaaatatgttggtgaaaagaaaggaaagaaagcctacatagcttgggaagatattgctcaacaacctccgactcttccggtgatgaagaaattgcaaacatatgcttaa

SEQ ID NO: 24297 - DNA, 1137 bp, Glycine max
  Peptide Sequence Number=SeqID_115982
atggcgatgaacgcgttaagtgtgccttgttgcgctaaccttctcgctaagtcatttatgtccagtagtgttgtcacgctaagcgcgtctgcccgtgctaagcgcaatttggtttctgttgtggaattgctcgctaagccaattctgcagaaaattttgatttgtgtcaactcgctaagcacatggcttctaggaaaaggaaaaccacaccttccaggccccagcctcactatgatactcatagattcacctgtgaggacgcctggaactgctacgctgacaatgttcttcgccggaacatcctttcggaaaggaacgacgctgaccaacctcatggagggaagcatagatgtggctctcgtgaaggaattttatgctaatctttatgtcctgggggataagcctccaaagcaagttagggttaaagggcatttaattaagtttgatgcggattccctcaacacttttctagagactccggttgttctagacccaggggagactcttcttacttactccaggttctgcagactgagaccagaccctcaggagatggttgcccgactttgtatccctggtaggggatttgttctgaatgctgagggcttgccatggaagctgctgaggaagggcctcactactctggcgcagacttggagcgttctgtcttattttaaccttgcctctacatcacacacttctgatctgaacttggatagggtaaggttggtatatggattagagatgaagatggacatgaatgttggagccctcatctctggacagatcacacttatggctcaatccaactcctcaaggctcgaatttcctgccctcatcactaccttatgcatggctcgaggagtcatctcagattccttgacttttgagtccctcaacccaaccattaacttggcttacataaagaagaactgctggaacttggacgaccccacgatcagctttccagggacccgcactagaggatctgagggtccatcttctgctgctccacagacatctatagcaccagctcctattccttcagcacaagttcccgctacttccaatccctccgctcaaagcacagacctcatgatggtgatgctacagagcattcaccagggtcaatacctg

SEQ ID NO: 24298 - DNA, 488 bp, Glycine max
  Peptide Sequence Number=SeqID_115983
atggttagaacacgaggtttaggtcatgcgttaggagcaggtagaggtagaggcattagtgaggatacgcatgaggctgatgttcctctgcgccgcagacctactgcttcagcacgtaggcaacgggttcgtctgcgtgaggacatcacagagagacctgaggatgtgcctcagttgcatgaggatgttcctcatgtgtctgatgccaccccagagattacaggcaccaccgatgctgttcagacagagggagtggctactgatgggagcttggggtcacctgctgcagatgagggattccccggtggaccacgtgacccatcgattttgaccgattttgctgagcatgtcgcacacagcatctggagtggacaggaacgacccgatctgaagttggtctcccatgatagaaaagtagataacattgggagaccagcgcctgagatcgaagggttgattgctggcaccagattgagtccactgatcag

SEQ ID NO: 24299 - DNA, 603 bp, Glycine max
  Peptide Sequence Number=SeqID_115984
atggaggacgccaatacctgtggaggagaagaagggaaccaaatttcaaagcgcggaagaagaagcttgctatctgatacacagaagatgaaggaagaagacgaacctttttggaaggagaagaacgaaagcacgaaagaagaagcttgcggggaggttgctgggtgcacgggagaagaaggaaagcgcggaagaaaacggtatttttggaagttcattcaattgctgggtgcacctagcaacacccctaaatacccccaccaatccattcatttcttattggtttgggttacattaactgagaggacgcgtgcgacgactttgtttggttctagaaggcacagcttgcgaagaagcatgatttcacaccagcgttggtttccaacgttgtcgttacggacaatgtggaaaatcaatcgtgttcgcgaggcacgtgaagggctcgatggaagggaaagagtaatgacgacggttgcgtgcaatctccctctgcaattttgttacagaataggttgcggaagcgtaagacggctccagtggcatactttctctggctatgtttggagtgaacggtggtggaaaatgcgagactcggcgaaatga

SEQ ID NO: 24300 - DNA, 600 bp, Glycine max
  Peptide Sequence Number=SeqID_115985
gatcaagggagccttgtatcggagacgtttggatgccctgattgtgacttatgtgtgctggatgccctatgtgagtaccggggagtcagggcctttgacttgatattgtcatacaccggccaacttagatggggtcagactgtggtgtacgttcgacctgagcgggttcttcgacagtttggctaccttcagacggtccctccaccgccgatttgtgattctttgacgggtgatgatatagatgaccggtggctgcatttttcagaccatttggtgccttcaggggagctctgtgtagttcctggacaggtggtgctagactacatggagtggttttttcggatatcgcacccattcgtcacgcagaccgaggatactgctgcgtcgagacatccgcctccccctcatcatgaggagccacccatccccgaggtttcagtcgcgaccgatctccctacccattcagtggttcactgcgaaggatgtcaggggatggctcaggatttaggagcgattgttgaggatttggagcgggtcaacaacctcaggatggtgacgccgcaaatggaagtcttaggccgcgccagagacgccgcatag

SEQ ID NO: 24301 - DNA, 831 bp, Glycine max
  Peptide Sequence Number=SeqID_115986
atgggttgtagcagcccgcacgtatctgctccacttggtgggttgtactcttttcgccaacaagagttcaacccatgtacatgtcgtgcacttggaggctttcagggacctagcccaggtagggggattcgcctagggagcggcgacattagtccacatgtacgagcatctgaacgacgcgtcgcaggcctctacacgacagttgggcgtgctggatatacgagcactttcctacagtgcatacatccgtcgttcatgatgcttatgatgaggggagcccacgggcctgcaggtggcttacgataccggggagtcagggcctttgacttgatattgtcatacaccggccaacttagatggggtcagactgtggtgtacgttcgacctgagcgggttcttcgacagtttggctaccttcagacggtccctccaccgccgatttgtgattctttgacgggtgatgatatagatgaccggtggctgcatttttcagaccatttggtgccttcaggggagctctgtgtagttcctggacaggtggtgctagactacatggagtggttttttcggatatcgcacccattcgtcacgcagaccgaggatactgctgcgtcgagacatccgcctccccctcatcatgaggagccacccatccccgaggtttcagtcgcgaccgatctccctacccattcagtggttcactgcgaaggatgtcaggggatggctcaggatttaggagcgattgttgaggatttggagcgggtcaacaacctcaggatggtcattgagggcattgacttacatgacatcatgactcgttgtctgagctag

SEQ ID NO: 24302 - DNA, 168 bp, Glycine max
  Peptide Sequence Number=SeqID_115987
atgatgacatctactaatcaagaggtggaggcagcagacaaggaagtgggagcaagtggtaccataaggtctaaaggagacatattcttaaatggtgctcaagaagggttaatgactaaggatgttgggagcaacatgtttcaccccacagaacactatccatcttag

SEQ ID NO: 24303 - DNA, 267 bp, Glycine max
  Peptide Sequence Number=SeqID_115988
atgaagataagtcatgttcaaacaggaaattacgagtgtggatactatgttatgcattggatatggtgcatcgtaactggtggattgaaggatgactggatccactggttttctgatcgatcagcgggtggtggtgacaaggactacaaggaggtacccccacctcctttgtttgaacctgcagggggacacatcaaccaagctgtgaccttcaacagatcttattacaaggtaatcagttcaatggagaaatggctgagtcactag

SEQ ID NO: 24304 - DNA, 2610 bp, Glycine max
  Peptide Sequence Number=SeqID_115989
atgaggcagaagggtgatgcaatgaggcagtcttttgatccttcatctttgggtccttccaagattccatctataaaaatacctggaaaagcagggaatggtgcatgggaggctttgtctggatctgattcctaccatgcttcgtcggatgctagcctcttttctagctcattacctgttcttccgcatgaaaaattgaacttgaatgaaactgcaaatgcttatcaatctattgacgacatctcatccggctttaagaagctccatcaagatgctgagggcaatggttcacttgaagacggtgatactcatgcaattggacctgcccttcctgatgatgaggaggagcttttagctggcataatggatgattttgacttaagtggtttgcctggttctcttgaggacttagaagagtatgatctttttggttgtggtggaggtatggaactagaaactgatccacaggaaagtctcactgtgggtatatctaagctaagctttgcagatagtaccgttggcagtgttttgcccccttattcttttcccaatggtgtgggagctgttgcgggagaacatccatatggagagcatccttctcgaacattatttgttcggaatattaacagtaatgtggaggattcagagctgagagccctttttgagcaatatggtgatattagaaccctatacactgcatgcaaacatcggggatttgtaatgatatcctattatgatatccgtgctgctcgaacagctatgcgttcattacagaacaaacctctacggcgcaggaaactagacattcatttctcaataccaaaggacaatccatcagacaaggatatcaaccagggaacattggtagttttcaatttggatccatctgtttcaaatgaagacctgcgtcaaatatttggggcttatggagaggtcaaagagataagggaaactcctcacaagaggcatcacaagtttattgaattctatgatgtcagagcagccgaagcagcacttaaatcattaaacaggagtgacatagctggtaaacgcataaagcttgaacctagtcgacctggaggagctcgtagaaatttgatgctccaattaaatcaagagcttgaccaagaagaatctcggagtttccgataccaagtgagttcacctgtagctaactctcccccaggtaactggttacagttcaacagccctgttgagcagaattcaatgcaaactatcaatcattctcctggttctaggatcataagcccaacaacaggcaatcatttacctggattagcttcaattttgcaaccacaagtatctaacgctgtaaaggctgctgctattggcaatgacttgggaaggagcagtcaaggagagcacatattttccggtatgaattcatcacacggagctacttttcagtcgcattcacttccagagcctaaattcagccaatatcgtggagcattgtcctcaattggtccatcaacatcaaatggatcctcagtggaaactttgtctgggccacagtttctatggggaagcccaactctctactcagagcataccaaaccttcagtttggccaagatcatctgtggggcatccgtttgctgcatccaatggaaagagccatgccttcccatattcaactcagaatagttcttttgttggttcatcccagcatcatcaccaccatcatgtcggctctgccccatcaggtttgccttttgagaggcactttggtttccatcctgagtcatctgaaacttcattcatgaataatgttggctatggaggcattggtcttgggcataatgatggaaattacatggttaatgcgggtggatctgttaatcctaacactactatcccaagaaatatatctgataatggttcatcaaacttaagaatgagatcttctccaaggcttagccctgtctttttgggaaatggtccttatccaggactgccacctaccactttggagagtttggctgaccgtgctcggagtagatggatagagaacaatgggagccaagttgatagcaagaagcaatttcagctcgatttggataagattagaagtggtgaagatacaaggactacattaatgataaagaatatcccaaacaaatacacctcaaaaatgttattagctgccattgatgaaaatcataggggtgcttatgattttctctatctgccaattgactttaagaaaaaatgcaatgtgggctatgcatttatcaacatgctgtcaccctttcttattattccattctatgagacattcaatgggaagaaatgggagaaatttaatagtgaaaaagttgcatctttggcatatgctcgaattcaaggaaaatctgcccttgtgagccacttccaaaattcaagtttgatgaatgaagataaacgatgtcgccctattctcttccactcagagggttctgaagttggtgatctgattgtacaagagcacctttcttccaactccaacaatctaaacattcaggcacctaggccaagtgaattctattcaagtgattttgctgggagtcctccaaaggcgggcccttctgcaagcttggatacaaattaa

SEQ ID NO: 24305 - DNA, 345 bp, Glycine max
  Peptide Sequence Number=SeqID_115990
atgagtgatggattttgcagtactcatttgcatatcatggttaggactagaggattaggtcgtgtcttaggtcaagtcactggcagaggtgtgggcagaggagatcgtgatgattctgatgatgctccgcagggtcgacggcctactgcatccacacggaggcagctagtcgctgtgactgcggatcacgtcgatgagccagtcatccctgcgccagatgttcaggatgacccgatggaggcaccagctgctgtagaggacattcctgcggacacaggcgcagaggctgctgaggatgagcatgagggatttccgggtggtccgagcgaccctatccgtgtttga

SEQ ID NO: 24306 - DNA, 159 bp, Glycine max
  Peptide Sequence Number=SeqID_115991
atggttctgacggctgggatgggatctgtgccttcaaccgctaggaaagtgccacgtgacagttgttcgagtttgaggtcaactaatcagcttcgtccaagtgcattcagcatgtttatgacatactactatatctatgttaatgtgtgtacgacttga

SEQ ID NO: 24307 - DNA, 494 bp, Glycine max
  Peptide Sequence Number=SeqID_115992
atggattgtcataatccaagacaaggtttgatgcctactagttttaaggttaggacagttcctttggacagtgatgattctgcaacaaaagaggttttggatcctaactttggagaagcatccattgggcgtgttgctccagttgattcaatttgggagagagttgatgtgcaaataggaattaagatgatgttgaagttatgtcttgctgatggctttgacatgttcccaaccttattagtaactaatggttcttgcatgatagatcaaaggatgggaattcatgggcatcctttggagattcaggaagggggaaaggggtggttcgctgctgagggaaaggaggaagggggtgagttatggcggaggggaagggggaaggaggtcgtgacagaggaagaagaagaaggttgcagcggtggggaaggaggccacgacgaaggaagaagaaagaagaaagaagcagcgtttgaggagagagggaagagaaaaat

SEQ ID NO: 24308 - DNA, 450 bp, Glycine max
  Peptide Sequence Number=SeqID_115993
atgaggggcaccgtgcatgagcctcaagcgaacctaggggcaggggtggacccttgggtactagaacctatttcctttagaggactacacgtccttgccttcagaggactacacgtccttgccttcaaagggctacatgccttcacctttagaggactacacgtcctcgccttcagagggctacacgccctcaccttcagaggactacacatccttgccttcagagggctgcacaccctcgccttcaaagggttgcacgccctcgccttcagaggactacaagtccttgccttcagaggactacacgtcctcaccttcagaaggctacatgccctcaccttcagaggactacacgtcctcgccttcagagggctgcacgcccttgcctttagagggctacatgccctcgcctttagagggttgcacgccctcgccataagaggactgtag

SEQ ID NO: 24309 - DNA, 1255 bp, Glycine max
  Peptide Sequence Number=SeqID_115994
gtcgactctagaggatccccactacctgtggctaagtgaggctgaatcgctaagcccagctaagcgagattcgctcgctaagctcccaacacttaatggaatctttgaagtgttggtgccgctaagcgtaacctttaaggagcttggccagctaagcggaccatgtctcactaagtggccaatgtcttccagaaaaagaaagagcattagtgcaaggcccacagctcaatatgacacaagaaggttccactgcttcgaggcttggaccagatatacagataatgtgctaggaagacatatactagttgagaggaaggtaggaatataccatatggagttggatgagttcaaggctgaattggagaggcgtaacttccataagtgcctcaccaatttagctgacaacaacatcgatctagccttggtgaaggagttctatgccaacctctacagccccgaggggccttcaccaaaacaagtcagaatccgaggccacttgataagaattgatgcagacagcctcaacaccttcttggagacacctgtgtttgttttaaatgctgaaggctatcctgggaagatccttaggaacgatttaacaactcttgctcagctagacatgaatgtaggagctttcatctctggccagatcacatctatggcccagtctaactcctctagactgttccctgctcttatcatagctctatgtaggtccagaggggttgcttctgacagcctggtcttcgaacgcttgagcccgatcattaacttggcctatatcaggaagaactattggaaccttgatgatttgacagctattattagaggggccaggagagcgagggcaaggccagctaaggctccttccacatctgcacctcctcttccagcacgtacctcaacagctccttctaccccaccttctgtagactttcaacgtcttaaagccatgcttcgaagcatacatcaggggcatattgtagcctggcccgggattcagcctcccattcacagggaagacgaagaagctgcagccacttctgagaaatctcttgaggccactcctgagcctccagcaccagtggcagatacaacctcaccgcagtacgcaacagacccgtccactcctgaggatcagactacaccagtcatgtctctgaacgcctctcctatagctactcctgtggttcattttacggacgaggaggatgttcagacacaggacactcaggaccaatcacaggacttttaa

SEQ ID NO: 24310 - DNA, 507 bp, Glycine max
  Peptide Sequence Number=SeqID_115995
atggcgcgctttcgccggtgtggatgcgcagctcgagcagcatttcctgacgccgggccagcggcgtcgccgccgggcgtcggcaatgtcatgttgctgatggtttgcctgacgctggggctggcgggcgtgatgggcctggccacggacgtggcggccgcctggagcggcaagacttccgctgccgttctcatgggcagcggcgcgatcgtggcggtgtggatgacgttgatcctgttccaactggtgcagggtaaaaacagcggggtggtattgctgcaatattaccttggcatgctcggcctgttttgccttggcgccgcggcggcgtgggcggcggggatgaccggcatcgccaccgtcgccatgctgctggggggcggggttggcggtgcgctattcagcaaccgggcggcgttctatctctatgtcgcttattttcgcacgcgtcggcgcgtatttatcaaacgccgttggcagagagaagatctgcgcaacacccgataa

SEQ ID NO: 24311 - DNA, 252 bp, Glycine max
  Peptide Sequence Number=SeqID_115996
gaatctggagtcaatgagcaacctaaagcttatgctgcaaacatttataatagaccccctcaacatcaaaaccaacaacagcagaataattatgatctttcaagcaacagatacaatccaggttggaggaatcatccaaatttgagatggacaagtcctccacaacaacaacagcctgtccctcccttccagaatgttgtgaagatcctcataagcatcttaaggagttccatattgtttgttccaccatag

SEQ ID NO: 24312 - DNA, 678 bp, Glycine max
  Peptide Sequence Number=SeqID_115997
tcagaggactacacgtccttgcctttagagactacacgtctcgcttcagaggctgcacatcctcgccttcgagccgcctatgctagaggactacacgtgctcgccttcagagggttacacgccttcaccttcagaggactgcaagtcgtagccttcataggggtacatgctccattcagaggaatacacgccctacgtaagagctacacatcctcatctagaggactagcatgtcctcccttcaagagggatacaagccctcgccttcagagaatacacccttctttcagaaggctacacgccctctccttcagagcactacacgtcctcaccttcagagggctacacgcccaaccttcacaaccatcagaaagtacacgtcctcgccttcagaggcattcacgtcctcaccttcacgggctacacgccctcaccttcgccataacaggctacacgtcctcaccttcagaggactatagcactcttcctttagagggtacatgtcctcaccttcagaggatgcacgtcctagccttggaggatcacacgtccttccatcttagaggactacacggctcctccccttcagagggtacacgcctcaccatcagaggactgcacaagtcgtcgccttcacagggctacacgctctcgccctcagaggactacacatcctaa

SEQ ID NO: 24313 - DNA, 729 bp, Glycine max
  Peptide Sequence Number=SeqID_115998
gattgcatgaacatgcagtgccagcttcagtcgcagatgcaatctcagggacttgtagtgcctcctgaccctctggttggtcccttctgtcctcgagtgagcacaaaggggagttgtgttgatccctcaggaaatgatcctgagacgagtgactctgacagatgcgacttgtacatagaagcagatcctgcccgcctggttgccatggggagagtttatgagggatccaatgttgttcataacactcctttgttgcttagccaagtaaaggtgagtgtggaggaggttatagaagcagatactccagttcctgtacccactgatgaggtagctgtgtctccggcaaaaccacctccaaagcccgatctggaggtcgataatccgctttatctgatgacattgaccatcccagagcttttcttgaggccttatcaggttagatgggatgccaccgtgttcggggtctttaatccagatttccccctctacataaagcacgaagacctctccgaaatcgcacacggtggtcaatgtctcagcatatcagtgttacagttgtggattatacatctcactgaaacatgtatgcgagtggggaattctgatatctatggattcctcgagccacaatccattcagaggtctgggcaatcgcagtttgagtctgaaagttacataaagagttggatgcagagttcacaagcgatgtctatcttggagcctacctaa

SEQ ID NO: 24314 - DNA, 478 bp, Glycine max
  Peptide Sequence Number=SeqID_115999
gaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccttgtcaagactgaagcatcaaataatagcttatatgtgatggacggatatcaatggaggaaatatggtcagaaggtcactagggataacccttctcctagggcttacttcaggtgctcctctgccccaagttgccccgtgaaaaagaagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 24315 - DNA, 332 bp, Glycine max
  Peptide Sequence Number=SeqID_116000
atgggtgatcaagaggagacacaggaacagatgaaagccgacatgttggctctgaaagaacaaatggcctccatgatggaggccatgttaggaatgaggcagctcatggagaaaaacgcggccaccgctgccgctgtcacggcttacccttatggattgccgcccaactacccaccacccgtcttgcaagacgatgcgggccatattgcttctcccgtccttgaaagagagcctcctcaacagcccgacgaggtccacaaagaccctcaagactatgctcaaagggatgtcgagttctatcccccgatccccgaagggccggcacccagcac

SEQ ID NO: 24316 - DNA, 516 bp, Glycine max
  Peptide Sequence Number=SeqID_116001
atgacattcttgggagaaacaagtagtcagatcattgctaacttgagattagccttcatttttccaaatggatcaatcactcacaaccaaactggtgtttattttcaaagttccactataaaaccaatgcgagttcctaatgacttttcttttgaaacactcaagagtaaaatgcacaacacccttcagctaaccaacgatcaattagtggttgaaatctactaccgactgtcattcatagatgcagaattattatgtaccatcaatagaacaccggatgatatactcaacttgcttcaatccactatcactcctactcatgatgtaattctgtattacaacgggaagtggaacataccacgccaaggtgggtttttgggttactccttcactaaaacaaatccaataagatttgacattcctttgggatgtagcatggataaactcaaggatttaatcaagcaagttgcacctatggggtttccccttatggaattcacaaatcacagatggtaa

SEQ ID NO: 24317 - DNA, 557 bp, Glycine max
  Peptide Sequence Number=SeqID_116002
atgtcgggtctgcgtgaaaaggggtatctggtgtcggaaaaggggcacggcggcggctgggagctgcgcgcggacctgcgcgatatcacgctactggatgtgtaccaggctatcggctcaccggcgctgttcagcattggcccggcggccgatccttcgccctgcctggtggaacatgcggtggacgcccggcttgaccaggcgctggcgcggctgttaatcctgcttctgcaatttgatctgcgcgtcatgcttcatcacatgcgtggtgacggcggcctgaaacactttaaacatcataccgctgacaaacgtggtcagcgtcagcgtaatgaaggctgtcatgatccagtcgaccagcggccaaccgctgttcagcagcgtcgggtggcgcgcaaaccggcaaacagttcggtctgcgtcatggtcatcgcgatgctggctgaggccagcgcaatcgccaggcacacacccgtgtcagagagtaaaaaggcatgcatagattttctcctttgtgacgattggcgcagcggaaagaacggcggcttatccatcat

SEQ ID NO: 24318 - DNA, 528 bp, Glycine max
  misc_feature (515)..(515): n is a, c, g, or t
  Peptide Sequence Number=SeqID_116003
atgggtgccaagtccctcgaagtggtcaaacgtgggtcgcatcccaacaacggatggttcccggacgaaattagggcagaaatgaccggtagattgctggccagatcattaacctttgattgtcgcatcatgcactatattatcgttagaattttgcttccccgtttttctaatttggctcaagcctctgaggaggacttgattttgatgtgggctttccttactggtcgtcagatcgactgggctcacttggttaggtaccgaatgcataaggcattacgagccaatgcacctcttccatatcctcaattggtcactctctttctccgacattttcaaattcctcttgatgatgaaccttttgttcaagtcaagcgttcttttgctataggtgctggtacaatcacttcatttggttaccataaggatcgtgatggtcaatggctgaagaaggatgcactccatccacaagacgagcgtactccttctcctcctcctcagcgagatgattcagnccttatgactaaa

SEQ ID NO: 24319 - DNA, 1013 bp, Glycine max
  Peptide Sequence Number=SeqID_116004
atggctacctcaccaaaagaaactgcagcttctggttcacccgcagtaccatcatctccgcaccaggaacaacctgaattcaacatccaacccatccaaataattcctggtcaagcttctgtccctgagaaactggttcccagaagacaacagggagtgaagattgctgaaaaccctagccttgcaacaagtcctagggaagtagacacggagatggacaagaaaatccgcagtattgtgagtagcattctgaaagatgcttctgtgcctgatgctgagaaagatgttccaacatcgtccaccccaaatgtttctgtgcctgatgtcaataaagatgttccaacatcctccgctccaaatgctgaagccctcccttcacccaaggagactcctgcaccacgggcaccagaaactgctccaggtgacctcattgacctggaagaagtagaatctgatgaagaacccattgccaacaggttggcacctggcattgcggaaagacttcaaaacagaaagggaaaaatcccccttaagaggtctggaagaatcaagactatggcacagaagaagagtactccaatcactcctgccacatccagaagaagcaaggttgctatcccctccaagaaaaggaaagaaatttcctcatccgattctgatgatgatgtcgaactagatgtctcgacatctaagagggccaagaaatctggaagaaaggtgcctgaaaatgttcctgatgcaccattggacaacatctctttccactccattggcaatgttgaaaagtggaaatatgtgtatcaacgcagacttgcagttgaaagagaactgggaagagatgccttggattgcaaggagaccatggacctcatcaaggctgctggactactgaagacagtcaccaagttgggagactgttatgaaggcctagtcagggaattcattgtcaacattccctctgacatatcaaacagaaaaagtgatgattatcaaagagtgtttgtcagaggaaa

SEQ ID NO: 24320 - DNA, 632 bp, Glycine max
  Peptide Sequence Number=SeqID_116005
atgggaacaaatcaaactggaaaaaggttttatcaagtcaagattaagggcctagatatcaccaacattaaggagttggggcggttgatgggacctctccaaatgcaagccttccgcaaggtgtacggaaagattttagatttgaccatagtagagatatccacagaagccgttgtatcactcacccaataccatgaccagcctttgagatgcttcacgtttggagactttcaattagtaccgactgccgaagaatttgaggagattctacgatgtcctcttgggggaaggaaaccgtatcttttctccaggtttcttccctccttgagcaagattgcagttatggtcagggattcggcgagaggattggatcgtgtaaagcaaactcaaaacggcgtagtgggcctaccacggaagtacttagaaggcaaggcaagggacatggcgaatcaagaggagtgggtcccgtttatggacgtattagcattgctaatctttggagttgtcctctttccaaacatggacggtttggtggacctagccgcaattgatgctttccttgcatatcaccatagcaaagaaagcccggtggtagctatcttggtagacttatttgacacatttgaccgaag

SEQ ID NO: 24321 - DNA, 111 bp, Glycine max
  Peptide Sequence Number=SeqID_116006
atggaggatagggtcacgaccgaccaatcgtcgtcccttcctggcgctgggccagcagagaacgtcgctgcaaggcagcccagttcaagtaggcaaaacgctaacccataa

SEQ ID NO: 24322 - DNA, 294 bp, Glycine max
  Peptide Sequence Number=SeqID_116007
atgatggtggcccgggtgatgttggggtacggctacgagcccggaatgggtttgggccagaacaacggcggcaaaaccagcctggtatgcaccagaggaaatcacgggaagtttgggttaggctataaacccacgcaagttgacataaggaaaaatctttcttcatctgttcctgcgcctctacccattctcattcatttgcatgtttatttctttacgcttaaaaatgctagatccgacgacgagtccctcaaaggtactaatacccaggacccagccgtcgatttcgagtaa

SEQ ID NO: 24323 - DNA, 243 bp, Glycine max
  Peptide Sequence Number=SeqID_116008
atgtccatatgcattgcattaggtgtgtggcttgtttacaagccaagtctaggtggagttgatattgaggaagaggaactaatagatttgtggtcaaatccttttcaaggggaaggggatgatgcaatcatccctaggaagggaccagtcactagagccatgagcaagaggctccaagaggattgggctagagctgctgaagaaggcactagggttctcatgaacctcaaggtagatttttga

SEQ ID NO: 24324 - DNA, 507 bp, Glycine max
  Peptide Sequence Number=SeqID_116009
atgaccaccctgactcagatctggatgactttgctgctcagcaacatccagcccagcgatcataattctgacctccccctgccgaagtgtcagctggtgtacgccatcctgacacggatgagcattcacgtggctcagttaatcgctgatgccatctatctatttgcaggtatggcgcctaccaggcatcctctggacccggataagtccaacagggccctgggatttcccgccttgatcacaggactcttccagtcgttcggagtccccgtcgcacctagcaagtatttgcggcatttggttcgccagcaggcggccaaccaccgggcgcatgtacagacccatgattgtctttaccagttgagcctcagcctgcagagccagggttttacttcttttccgtgccctgcagaggcaccagcagaggctcccgacgaggcagatgaggcccgcgaggacgaggagatgaccgatttacttgatttcttaggaggggggatcctctag

SEQ ID NO: 24325 - DNA, 381 bp, Glycine max
  Peptide Sequence Number=SeqID_116010
atgtcgcagaggggatcgttgatcccaacacatattcagccagatatacatgggttaggagcacgagtgagcacaaaagggagcaatgcgaagagtgttcgcaacccatgtctgcctaatgatgttgctcttgtcaaaccccctatggggttgtatgtgcaacgccaagattcaattgagttggtggccttaggaaaaacatatgatggaggctcgaccatacacaatgtggcttatgctgacaatgtcgtaagggttagtgttgagcaagttattgatggtgacgctgaggtcccattcccaacatcagagtttaacatgagggcagtagtccaactaaagacactgaagttgttgaagcggtcaacgatgttgttatag

SEQ ID NO: 24326 - DNA, 105 bp, Glycine max
  Peptide Sequence Number=SeqID_116011
atgtctccagctgttagagaagattcattccagctgttaactggagcattggcagaggagatcaaggcaagatatgataaagcagctgtcaaagtttctctcctg

SEQ ID NO: 24327 - DNA, 330 bp, Glycine max
  Peptide Sequence Number=SeqID_116012
atggtttctagaagtatcatccccttcgaaaaacatattgcgaaagtagggactaccagcaacaatatgttatcaaagacaacaactctagatgagggttcactgttatcaagcaagtcggagacccagcatgaccacagattcaccttcactccttatgttcccatggacccggtccccagtggagtcgccaactgtcgcagcctacccttcggcgggagggcaacgcggggctcgcggatgcgtcttccaagggaggagaacgcgcggagtcgccaccaacgtttattcgaggaaaacatcggaaaaggtgtggtctatgaactttaa

SEQ ID NO: 24328 - DNA, 498 bp, Glycine max
  Peptide Sequence Number=SeqID_116013
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatccccatgcggagctgtttactttgacgtatggcgcaattgtgcgtcaattgctcacggatctggaagaggttga

SEQ ID NO: 24329 - DNA, 108 bp, Glycine max
  Peptide Sequence Number=SeqID_116014
atggtgcgtggtgctcgtgtgataaatggcagcggaatggagaaggaagagagagaggagacgccacttcaaggagaagatgagtctagaagaagctcaccaccatag

SEQ ID NO: 24330 - DNA, 1119 bp, Glycine max
  Peptide Sequence Number=SeqID_116015
atgtctccttcctccatttttgcgacccacctctcctttaggcggagtgggctcacagggttgcactgcagttctacatcttctgttccactcatggtttcactggctggtaacaaagaccatgactttgggccgttaggtaactttgggccgagattggatcaagttctaaagcttgtagtggaaggggagaccttcgatatgatgagtacttatacacctcaggatttagaagctttagtccacagggaataccattacgagaataagattttcttaggaggggatctaaatggtcatgtagggagaacatctagaggatatgagggttcatatggggtttatgatctaggagaaggaaatgtagaagataaatctatcctagatttcttattagctcatgacttcacaatagccaacactttattttttggtgttgttttgtctgcttactgtactaaggaaattaattgtgttattgctggtgctggctattacaatacagaactgcatgtcatagatgggattccacaacttatctttgttcgctcaagctatactattgagactgttgaagcagaacgaatatcagttgatcatgttgctcatcttaagccatctgatggtggttcagctgctacacaatcctttggagtaggggaagtgtttgatttctgttctgattgtcagcttgtcatgagtttgaataataggggagggttgtcttgggcagttaatagcaaacatgaaattttgttgaatttgactaaagccagtgaaggtttcatggctgctcaccttactggaatacacagtgccatcaaaatgcttcatagcagaataaaggtgctacatcactatcttcttgcaatgcaaaaaggtgatgttccttgcgagaattcactattaagacaagtgtcaagtctcctgagaagattgcctgctattgaatctggcaaatttcaagatgatttcttgatggagtacaatgacaccttattgattagttacctggcaatgctgaccaactgctcaagtgctatgaatgaactggtggacaaatttaatattgcgtatgataggcatagcagaaggggtggacgaactgcttttatgtga

SEQ ID NO: 24331 - DNA, 636 bp, Glycine max
  Peptide Sequence Number=SeqID_116016
atgacattaacctataaaaataggcgtatcacgaggccctttcgtctcgcgcgtttcggtgatgacgcggatgccgggagcagacaagcccgtcagggcgcgtcagcgggtgttggcgggtgtcggggctggcttaactatgcggcatcagagcagattgtactgagagtgcaccatatgcggtgtgaaataccgcacagatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgccaagcttgcatgcctgcaggtcgactctagaggatcccttcctccctatgctctaaccatggtgacaggggaaaatgttgtcgctacattaacactaacgttgcaatttctgttgctcgttttgctaatgcaacaggcaacgggtaccgagctcgaattcgtaatcatggtcatagctgtttcctgtgtgaaattgttatccgctcacaattccacacaacatacgagccggaagcataaagtgtaa

SEQ ID NO: 24332 - DNA, 246 bp, Glycine max
  Peptide Sequence Number=SeqID_116017
atggactcgggacagttccggaagttagtgtaccaggtcaacaggatatctcctccaaatttcaaggccctgagccttcctcattatgacttgccaccttatgccctttcgggtcatacaggctcaatggaatgccccagagcacctccacgatatgcacatgttgcgttcgagtcgtatcctcaaaaaaatggaggtttgagggaacctagcaggggttatggctaccattgcattatcaagtag

SEQ ID NO: 24333 - DNA, 378 bp, Glycine max
  Peptide Sequence Number=SeqID_116018
atgggaagaatcaaaagaattctcagactgtgtcgttttgaattcttgacaagggagaaaggagacacaaaagaattcaggcggttagtccttcgttcttttggaaaagagagaagagagacacaaaaagaattcaggcggttagtccttggcgaattctttttggcaaagggagaagagaatgaaaagatgaatagcacaagttttcaaggtttggaaaaccaaaaaacttcagaaagcttttggtacaaagaagaagaagaagttcaaagagatttcaaggcttgtaaaggattgattggaaaagcaaaagtattcaagattgttgttagaaagattgattttttgaaaatgcaaaacaaagccttgcttttatag

SEQ ID NO: 24334 - DNA, 168 bp, Glycine max
  Peptide Sequence Number=SeqID_116019
atgatgaagaccaagccaacttgtgtctctaaactcagaaacaacattgaagggtacatcctttgtggtacaagtagaggttcaagtggagggtacatccacttgggttgttcaagagaacaaggagggtacatcccttgtggatcattgcctggtaaggttttacag

SEQ ID NO: 24335 - DNA, 285 bp, Glycine max
  Peptide Sequence Number=SeqID_116020
atggcttctagagatatcatcctcttaggtaacaaagattatggcggtagggactaccaacgacaatgcctcaccaaaagaggaaaacctccactccctatgtctcacacagacccgggtataaggcctaatatctcaatgtgtgtgcaaaggtgtaggtgcaatgtgtgcatggagcaacaaatatttctaactacgaatgtaatagatagacaaacacacaccaaacacaataacatagcaaagggtgttgcccttgctcctatgtatccacaggtgcgatga

SEQ ID NO: 24336 - DNA, 315 bp, Glycine max
  Peptide Sequence Number=SeqID_116021
atgactgtcagtcacggacctagtactttgcttacctttggctttggacttggtcgctattggtcggccatgtgtcgtaggcaatactctaacctttttgtggatgagctgaggggctctggaggtggcggcggtgcatttgttgcctgttgccggccatcctcaggctgttatggtgtctcgccttgcgcctacctggggggcgcagtacttcttgctgaaagcccggttaatagggggcttgatgaccttgctaggggtgacggacactccatagaactgacagaggctcgtaatcagagctggaaaccctag

SEQ ID NO: 24337 - DNA, 515 bp, Glycine max
  Peptide Sequence Number=SeqID_116022
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggctccgcccccctgacgagcatcacaaaatcgacgctcaagtcagaggtggcgaaacccgacaggactataagatacaggcgtttccccctggaagctccctcgtgcgctctcctgttccgaccctgccgctaccggatact

SEQ ID NO: 24338 - DNA, 245 bp, Glycine max
  Peptide Sequence Number=SeqID_116023
gtgttgtgggtgcttcggatggtccgtggcggcgatgggcagcagcagcggcggtggaggatgatccctttctcttcttcgatggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 24339 - DNA, 591 bp, Glycine max
  Peptide Sequence Number=SeqID_116024
atggccgcgcagccttccccagataatgatagagttgtcccctgtgaaagaattagaagtttctcagaaaaacccattccatcttcatcaattgatcttcttttcaaggctgcatcagactatggcagcaacagcctatcttctctgctggaagctcaaaatgctgatgaacaaactgctctccacttagcttgtagatgtggcagtgcagaacttgttgaggcaattttggagtatgaagaggcaaatgttgacgtcttggacaaagatggagatcctcctcttgtttatgcattagctgctggatccccagaatgcgttcgcagtcttatcaaaagaggtgctaatgtgaggccacaattaagagatggctttggcccatctgttgctcatgtttgtgcacatcatggccaaccagaatgcatgcgagaattactattagctggagctgatcctaatgcagtggatgatgaaggtgaatctatcctgcatagagcagttgccaagaagtccgctgactgtgcccttgtgatactggaaaatgggggaaatggatcaattgccatcttgaatccaaagaatatgtcttaa

SEQ ID NO: 24340 - DNA, 421 bp, Glycine max
  Peptide Sequence Number=SeqID_116025
gtacagactcccactacttgactttgttggggtgacaccaacggggatgacattctttgctgggtttgcatatctggagggtgaatgcgttactaatattgtttcacatcgacaagaatgtcaaggtcaagtgcaaatatttaatcgggttgaatatgctcattgggctctaaaaagagtattaaaaaatagccttggagacctgtgtagtgtttgggatgccatgaacaacatgatcacgctgcagcacgttgaaattaaagcatccttcgaaaccacatcccagtggattcagtccatatgttctagaggagactttgcttttcagatcaaaggttatgtgagatcgaagtcaacatcaaggaggagattgagaccatatctaaaagatttgaggaacttgatgtgtgtggcaaagtaa

SEQ ID NO: 24341 - DNA, 153 bp, Glycine max
  Peptide Sequence Number=SeqID_116026
atgggggggggggtttggttgtttgggaaaactgccaggaaaccacattacaagcgaaacctcaaagagagttgggcttcgtcctcaaaaggaaacaacaccagaaaatctagccttccatggattcaaacagaaaacgcaaatgaaacatga

SEQ ID NO: 24342 - DNA, 126 bp, Glycine max
  Peptide Sequence Number=SeqID_116027
atggagcagaatcgtctcaggccacggtcagaagtcaagacaagtcaatggcagaaatcaaccaaggtacttagggatggaggcaaatggaggatagggtcacggccgaccgttgtcccttcctag

SEQ ID NO: 24343 - DNA, 391 bp, Glycine max
  Peptide Sequence Number=SeqID_116028
atgaaaaaccttgagatggatttgatggtgtcagccatgctttggttgttcagcttaccatgcagagagagtgtgtgtatcccaagtgagcgtgagacacttttgaagattaagaataatctcaatgatccttcaaataggctttggtcttggaatcataatcataccaactgttgccactggtatggagtcctctgccacaacgtcacttcccatgttcttcagcttcacctcaacactacgttttctgctgctttctatgatggctactatcacttcgatgaggaagcttatgagaaatcccagtttggtggagagataagtccttgtttggctgatttaaagcatttgaatcacttgaacttgagcggcaattatttccttggagcag

SEQ ID NO: 24344 - DNA, 348 bp, Glycine max
  Peptide Sequence Number=SeqID_116029
atgctacaatgcgaaggattttcctctaagctcagatatgattttgaaattcccaacggtgagattgttcggaattgggttgcgaacatgatactcaaatttcacgaagatccaacggtaaacgggttcgagatcatcatttttctaagacaggtttgggagaccaacaccttccaccttccagtaggagagttgacgatcacactggatgatgtgtcgtcactcctccatttgcctatcagtggcaccttccacagctttcatgctctttatgtggacgaggcggtatttttgttgatggagttgcttgaggtgtttggtgaggaggctagagtcgagacaacatga

SEQ ID NO: 24345 - DNA, 593 bp, Glycine max
  Peptide Sequence Number=SeqID_116030
cccagcttggagcgaacgactacaccgaactgagatactacagcgtgagctatgagaaagcgccacgcttcccgaagggagaaaggcggacagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacgctgataccgctcgccgcagccgaacgaccgagcgcagcgagtcagtgagcgaggaagcggaagagcgcccaatacgcaaaccgcctctccccgcgcgaaacagctatgaccatgattacgaattcgagctcggtaccccgaagacaaattatggtcatctgcacgctcttgctatctgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 24346 - DNA, 354 bp, Glycine max
  Peptide Sequence Number=SeqID_116031
atgaccggccctctcgatgagtcgatctcttgctttctcataagggtggacccttgggtacttgtacctatcaccttgagaggactacacgtcctcgccatcagagggctgcatgccctcaccttcagaggactacatcgtcctcgccttgagagtggctacacgccctcacattgggtgctagttcctcacttttcacacccaggcccacttgggccctctagaatattcctccagaaggatgttgcttctggaggaagcaacctggctcgcctgggcgagctgagctcgcctgggcgagctgagctcgcctgggcgagctgggcggcaaccacctcccctattttgctataa

SEQ ID NO: 24347 - DNA, 75 bp, Glycine max
  Peptide Sequence Number=SeqID_116032
atgcaccctttgtcatttggggacagttccgctggcagggaggttcactggccaaatggtgtttcgctcgaatga

SEQ ID NO: 24348 - DNA, 426 bp, Glycine max
  Peptide Sequence Number=SeqID_116033
cttctcaaactattagtttttctgatattcaatgtgatgttcccgaactcaaaggagataactataagatatggaaggagagaattcttctacaattggggcggatggacaaagactatgctataaggaaagatgaaccacctgcaatcactgatgaaagtagcccagctgacgtcattgatgaccagttcatcacttcagataagactttagcaagcaccttgatcatgaagttctcttctcttcggctcaccagtgtgaaaggtgtgcgtgagtacatcatgaaaatgcgagatatttcatctcaacttaagaaactagaggaagaagaaaggcttgtaatggagatgggtgagagtgcattgctgactactgcttatgggaagaacaaagcaattaagtctcaagctaatcagaagggtaatg

SEQ ID NO: 24349 - DNA, 325 bp, Glycine max
  Peptide Sequence Number=SeqID_116034
atggcccagacatgtctcgacacatcaggagaaagctgtgcttcaggtgctgtatccaaggaaagatgcctgatgattgctgaactcaaggcatgcaagactcacagacaattggcaatgatggtgaaagcagctgaggaagaagaagcagctgaggaagaagaagaccatcaaattgccaaggaaatcactgccaaacaagtccagcattggccaaagaaagggaagctttcagcagggaagctaagtgtgaagtatgcaattctacacaggattggtgctgcaaactgggtacccactaatcatacttccactgttgccacag

SEQ ID NO: 24350 - DNA, 1192 bp, Glycine max
  Peptide Sequence Number=SeqID_116035
atggtcatgattggtgaggtccctactgagccgcatgcactgccacaatttaggttcgagttacaactagacaagctctttgatggactcttcgtccactgtcatgacttgagtgcctttaaccgttgtggggtgagcatggtcgggttctggataggaggatatgggaatttcattgtcagatggggcatggagactatggctctaagctcgttgagtgtcttcttgccgattaaggcaaagtatgatgtgtttgcatcaactagtggtcatcaagttcacgtagcctctggtctcgactctctcgtccacaaaaccaagggtggaattgccctcgtcgatgaggaccctggacaccatgaagttagctataacgatggagacaaccacagggtcgtcttggttgacgaggttgatgcccttgaagtgtcgctttcgggattggctggactgtcctccataggaaaagatgctagtgatggttatcgctcatgccgttgttgtcttgtctactttggtcttccgctcgccttctgtccgcttcctagttcctattttgctcctctagatgtccttcgggtcttgctcctacttgatgggtccaacagtcttcgatgttgttgccaatactgcagtgatatcgacaatatttggttgcgcctgaccccacctgggatgtttcgtctagggccctttggagagaggttggcgcttgtctggcttgtgcctcttgtccgacttgtacgcgtcaggtttggtgtgtgctttgcacttgtcacgcttctatttggcttggtggacttcattttagaatccggacctggatgtagcccttggctcattcgcacagttcggactcatcgtgttcttgttgcagactggccaaggcggtcgaggtcatgcaatgagacgaaggcgtcaaagctgtctatggacctgggtgggagtccatcgtaccaggtcactgctgctctcttgagagatgttcccctatgtcaggaaggcacccagatgctcgtctggatttgttgtcccatcgtaccgctcgaggttgagtggcttccaccccaaaggtatgtctacctccataatgcggaaaggtgtgggtggattgctcgtcgccctagggacgtctggcatgagcctctagttggtcatggtcagcctttggctttgtcaactcttcctcgtg

SEQ ID NO: 24351 - DNA, 654 bp, Glycine max
  Peptide Sequence Number=SeqID_116036
atgaccactcttacatggatatggatgacgttgctacttagcaacattctgcccagcgaccacaatgccaatctccccctgcagatgtatcagttggtctgtgccgtcatgacattgggatcgcgcccacaagatgcccagtggacccgaagaagtccaagagggccctggggtttccaactctggggtagcgcccacaagacacccagtggatctgaaggagctcaacagggccctgggtttccagctctggttacgggcctctgtcagtcctacagggcgcccgtccccccaacaagttcatgccatcgtgacataggtaaacacctagtggacccgaagaaggccaacagggtcttgcagttgtcagctctaattacgggcctctgtcagttctacggagttcccgtcgcccccaacaagttcatcaggcaccctattaaccgagctttcatcaagaagtactgcacccctaggcaggcgcagggtgaaacaccacagcagcctggggagtgctggcagcgggcaaccgatgcaccgccaccacctctagagttcacctcagctcagcaacaaaaggttagagtgttgcctacgacacatggccgaccaataggcaaccaagtccaaagccaaaggaaagtaaagtactag

SEQ ID NO: 24352 - DNA, 174 bp, Glycine max
  Peptide Sequence Number=SeqID_116037
atggaagagagagaacggaagatcttcagaccagataaattttcggcaggattgccattcaagatcgttctcgactggcgatatccaaccccacctgaacaaagaggaaaagaccaaaacacccagcttcctctccaaaaacactaccctcgagaaaatcctattggcccgtga

SEQ ID NO: 24353 - DNA, 180 bp, Glycine max
  Peptide Sequence Number=SeqID_116038
atgcactactcggatcatatcattccagcaggtgaggtgtgcgttgtgccaggccacgcatcagatcctttgcctgatggtcataggctgtttcctacgagtcgtccctcaggccccgtagacggatatccctcacgtgccggagccaggagcatcatcgacatctgtggaggagcctag

SEQ ID NO: 24354 - DNA, 154 bp, Glycine max
  Peptide Sequence Number=SeqID_116039
accttggtttgctgatatggcctacttcaaagtagcaggaatcatccctaaggacttaacttggcagcaaaggaagaaattcaaacatgatgctcgattttacatacgggatgacccacacttgttcaagataggagctgataaccttctctga

SEQ ID NO: 24355 - DNA, 429 bp, Glycine max
  Peptide Sequence Number=SeqID_116040
atgtattgggaccaggggagttcggacgtgctggacgttcaggatgacaccgtcttcatcacaatcttgtatcatgttgacagtaggcccatggttcggcagagggacatagcagttttcaacgtcatgacctggggccccttggtggaaagcgcagggcggggagtaagtcagcatatttcatcgggattggatcaaaggttgttttctggcggttttgtgaatgatatggttgttggggggtctgcgggcgattttgttgtttttgagggtattgtggctgatggtattgctgtggagggtattgttgtggagggtatggttgtggagggtattgttgtggagggtattgttgtggagggtattgttgtggagggtacgggtaggggtaatgtggcctttgttggtgatatgatgggtttgggatag

SEQ ID NO: 24356 - DNA, 72 bp, Glycine max
  Peptide Sequence Number=SeqID_116041
gcattctctgaagaaatcgctaagcgcgcttaccgcgctaagctaagcgcgctaagcgagttcatcctttga

SEQ ID NO: 24357 - DNA, 91 bp, Glycine max
  Peptide Sequence Number=SeqID_116042
atgggtttgttgaaatggagaaaaggcaagaacgataaaggcgacggcgcacgtttacctactaggcgtattggttataagcgcattgcag

SEQ ID NO: 24358 - DNA, 312 bp, Glycine max
  Peptide Sequence Number=SeqID_116043
atggagatcgattttgacaagattcagtcagtaccaacaaggaaagaaggacagattagctctaaaaccttaacttgcttgaatcttcggagatctgagtatcggcaactccctcaacagcttcactcgcttaaaggactacagcataaagtccttgcattgctgaatatctcctactcgcagaaagggaagaaagacaagagatctgatctaacgaagaaacgagtactggctaggctaagaacaacgcctttaaggcaggctaactggactaccactgcctctactgatggccttagagaaagaacttaa

SEQ ID NO: 24359 - DNA, 631 bp, Glycine max
  Peptide Sequence Number=SeqID_116044
atggggacaaatcaaactggcaaaaggttttatcaagtcaagattaagggcctagatatcaccagcattaaggaattggggcagttgatgggacctctccaaatgcaagccttccgcaaggcgtacgaaaagatcttagatttgaccatagcagagatatccacagaagccattgcaacactcgcccaatactatgaccagcctttgagatgcttcacgtttggagacttccaattagtaccgaccgttgaagaatttgaggagattctaggatgtcctcttgggggaaggaaaccatatcttttcttcgggttccttccctccttgagaaaaattgcaattgtggttagggatttggcgagaggattggaccgtgtgaagcaaactcgaaacgacatagtgggcctatcacgtaagtacttagaaggcaaggcgagggatatggcgaatcaagacgagtgggtcccgttcatggatgtattagcattgttaatctttggggttgtcctattcccaaacgtggatggtttagtggacctagccgcaattgatgctttccttgcatatcaccatagcaaagaaagcccagtggtagctgtcttggcagacttatttgacacattgaccgaag

SEQ ID NO: 24360 - DNA, 66 bp, Glycine max
  Peptide Sequence Number=SeqID_116045
gaatccattgatgaagaagatcctaggcctacaagctccaatggagcttgcatcaataccccttaa

SEQ ID NO: 24361 - DNA, 458 bp, Glycine max
  Peptide Sequence Number=SeqID_116046
ctcctcctcctcctcctcctacttcggacgcatcggcttcgacgtcttccgtgaagcggacacacaaagcctcatgtctaggatcgttgtccactggaccacctggtgttgagagaccagtggtgcatgttgatcctgctaccgggaaggccaacagtccccacaggaagaaattaagaacatatttggggattatggcacgtgataaggcggaatttgatatcccagaggcttctggcagtaggacgaaaaggaagttactacagaccatgggggagagatggaggcagtttaaattagacctcacgaggaaatgggcccttgcaatcgatcaggacggtgtcgaggacactgtctgtgacaaatatggcatcagcaaggaaaagtgggcccagtttttccagactcgcagagacccttcttgggaggatgtgcgcatcaaggcacaggccatctaa

SEQ ID NO: 24362 - DNA, 378 bp, Glycine max
  Peptide Sequence Number=SeqID_116047
atggcggcgcagctaatccgtgatcgagtagagatggagtgcctagagggagcttgggagccctcgaaggcaacacgagatgaatcggcacgtacgcttcagcgcactgtagcgtggatactacccacgcctacaccatatcgtctagtggaacccgtccaagtgatcgaggtaacgtcatccgaggaagaccctgaggaggatcttgaggagctacctcctgagcctgctgtggatgctcttgactttctagagggtgatgaggatccacttcttgaggtggattctcacgaggaagtcatgtcggcatctgaggcagactctacggaggatagtggcccgagagagatggcgaccagtggaggctcttcatcatag

SEQ ID NO: 24363 - DNA, 540 bp, Glycine max
  Peptide Sequence Number=SeqID_116048
atggtcatgttggtgcgcatggtctgcactcttctctttgcagcggcatgggtgaaatcttgccccagtatgcatagtagctgtgtgatagcctccctctctggttgtgctcgcacagttggccctcctccaatatcagggggtggcccaggaaccgttaaaaggaaactactggcgagggcgtgtagccctctgaagttcaggacgtgtcgcctttcgaaggcgagggagtgtagtcctatgatggcaaggatgtgcaatcctctgaaggtgaggacgtgtagcgctctgatggtgaggacgtgtagtcctctcaaggcgaggacgtgtagtcctctcaacggtgagggtaacgagtacccaaggcgaggacgtgtagtcctctcaaggcgaggacgtgtagtcctctcaacggtgagggtgagggcgtgcagccctctgatggcgaggacatgtagccctctgaaggtgagggcgtgtagccctctcaaggcgaggacgtgtagtcctctgatggtgaggacgtgtagtcctctagag

SEQ ID NO: 24364 - DNA, 1086 bp, Glycine max
  Peptide Sequence Number=SeqID_116049
gtcaagagcctagggaccactagtctaaaggagttagggcagttaatgggtcagctccagcgacaagcttttcgcaaagcttacggtaaaatatgggacttagccatggtagaagtctctacagaggccattgcctccctttcccagtattatgatcagctattgaggtgcttcacctttggggacttccagctatcacccatggtggaagaatttgaagagatcctaggatgccctctaggggggaggaaaccatacctcttcacagggttctatccctcattagctagaatttcaaagatagtccaaatctcagcgcaggaattagaccacaggaagcaagtcaaaaatggggtggttggaataccgagaaaatatttggaggcaaaagcaagaatcttggcaggagtcctctttctgaatgtggatgggttggtggacctggcagcgattgacgcttttctcgcctatcataaccacaaggaaagcccgctctttatgtatggttggtttcacacctttttcgccaagaggttgaggcatgcttgcccgctagaaagccaccgttcatgcacagagaaaggacgggaaaattgggaccaactcttagcaaacaaagaaggagcatctgtcaactggttccctcggtggaaagaaggaagaaccggagttcttatttcgtgcggaggatttctgaatgttcccttgatggggacgaggggttgcatcagttacaatcccgttcttgctataaggcaacttggctaccctatgagaggggcgccactagagtatgagctcgtgcctgtctgcaaggcatgggaggtgttgcaaaagaaggacaaggaactcaggggcagtaacaatgggaccatcggtggctatcgtaagtggttaaaagcccacgtgcaaggtttggattggcttccaagtttgagaaccactaaaagagaggaagttgaggcaccggaggaagacaaagaagtgcaggcccttagggtggaagtcgagcaagcccaaacagttaaagaaaggttcaaatcagcagctctgaaaatccgaaaagagaatactgaactgagagat

SEQ ID NO: 24365 - DNA, 481 bp, Glycine max
  Peptide Sequence Number=SeqID_116050
agtagcattccttggtaaagctaactttccaaatgtttgccttcgtaggaaatggccccgaggaagcttgcctcaaagaggtccaggaaggataaggcagccgaaggaactagttccgctcctgagtatgacagtcaccgctttaggagcgctgtacaccagcaatgcttcgaggccatcaagggatggtcgtttctccgggagcgacgcggcgccggcggtggacatcactggttactcccatggccaatggatcccgttcgatgcagatgctatcagccagctcctgggatatccgttagtgctggaagagggccaggagtgcgagtatggccagaggaggaaccggtctgatgggttcgatgaggaggccatcgcccagctgctatgtataccgaggcaggattttgcccggactgctgcagggaggcgagtgcgaatcatgcgcaccaacatgaccaccctgactcaatatggatga

SEQ ID NO: 24366 - DNA, 312 bp, Glycine max
  Peptide Sequence Number=SeqID_116051
gcccgtctatccgctacaaggtcaccgctcgtgcgtcgaaaaaggaaaggcgaattgggaccaactcttggctaccatggaggggcgggttttattaattataatcccgtcctcgccataagacagcttggctaccccatgagaggagtgccatcagacgaaagcatcacgcctttcatcgcacgggtttcagtgaccacaacgcgagggtactccaaggagttcgcaaggcatgggatgcggcgtgaagaaaggacagagagcttaggggaagcagtaatgggatcatcggcggctatcataagtgactga

SEQ ID NO: 24367 - DNA, 491 bp, Glycine max
  Peptide Sequence Number=SeqID_116052
actctagaggatccccgatcacaggactctgccagtcgttcggagtccccgtcgcaccaagtaaggtgattcggccacccatcacctgggcttttattgagaagtatttcacacagagacaggcccagggtgatgcaccccaggccgcaggcgcgccaccaccacctcatcaggctgacccagctgggtcatttgacacagagcggtatttgcggcactcgatgcgccagcacgcggccaaccacaggggactggggcaggtccatgagtgtctctaccaggtaagcctcagcatgcagagccaaggcttcgctccttttctgtgccctactccagaccaattcaaggcagaggtcgcatggcccggggattggcccgaggcccaagcaagggaggcacccgcggaggctcccgacgatggagaggaggccggcatggatgaggagatgtcagatttgctcggcttcttgggagggagtggagccacatga

SEQ ID NO: 24368 - DNA, 183 bp, Glycine max
  Peptide Sequence Number=SeqID_116053
catgaggttcttcatagtcttccacctaaccatctgctcccacaaacacaaagttcgagatcatcacaggatccaaacacaaatagcacacggggaatgaatgatagcggaatggagaaggaaaagagagaggagatgccacttcaaggagaagatgagtctagaagaagctcaccaccatag

SEQ ID NO: 24369 - DNA, 447 bp, Glycine max
  Peptide Sequence Number=SeqID_116054
atgagcaacatcactatttatcacaacccagcctgcggcacgtcgcgtaatacgctggagatgatccgcaacagcggtactgaaccgaacgttattctttaccttgaaaatccaccttcacgcgatgaggtgctcaaactcattgcagatatggggataacggtacggtatccgatcctgattaaccgcccgattgtggtgacaccattgggaacacgtctgtgccgtccttccgaagtggtactggatattcttccggatgcgcaaaaaggcgcatttgctaaggaagacggcgagaaagtcgttgatgatgcagcaccatatcacgatggtaatgaatttatacctttcattatgcaacagcagataatgaaaccgatgtatcaagctgatcgaccatttcgcagatttgcgattgttcatagctcaggaccggtcgttgcttaa

SEQ ID NO: 24370 - DNA, 365 bp, Glycine max
  Peptide Sequence Number=SeqID_116055
atgaacttgcacggacgcttcagcgcactgtggagtggatactacccacgcctacaccatatcgtctagtggagcccgtccaagtgatcgaggtgacgtcatccgaggaagaccctgaggaggatcccaaggagctacctcctgagcctgccgcggatgctcttgactttctagagggtgatgaggatccacttcttgaggtggattctcccgaggaagtcatgtcggcatctaaggcagactctacggaggatagtggcctgggggagatggcgatcagcggaggctctttatcccagtggacagctctttggattagttttgtatacttttttagggtgggtgtatctaggactgactgttag

SEQ ID NO: 24371 - DNA, 312 bp, Glycine max
  Peptide Sequence Number=SeqID_116056
atgaggtcagacatcaatactggtgttcgaggaagggcctcatttctgttaatagcttgtgaaaggagtggtcgactgacaaaggatgagaagattgttgttgctgatatgacgaaatccatggtgaagccaagaaatattctcttgatgttgaaggagcacaatgccaacagttatacaacaatcaaacaaatttacaatgttagacatgcttatcgttcttcgataagagggagtaacaccgaaatgcagcaatgcatgatgctgtttgatcgagatcaatatattcactggcataggatgaagggatga

SEQ ID NO: 24372 - DNA, 687 bp, Glycine max
  Peptide Sequence Number=SeqID_116057
atgaccctcctacgatgcgtagatgccaaagaggcgaacttcatgattgaggaaatccacgagggttcatttgggacacatgccaatgggcaagctatggccaggaagatcctcagggcagttattactggctcactatggagagcgattgttgcgcccatgcaccctttagacccagataagtctaacagggccttgggttttccggcattgatcacgggtctctgccagtcgttcggggttcctgtcgcacccagtaaggtgatccgactgccgatcacccgcgctttcatagagaaatactgcacagctagacaggcacagggtggcgaccctcaggccccagacgcaccgccgccacctcctcaggctgacccagctgggtcatttgacacggagcggtatttacggcatttggttcgccagcaggcggccaaccacagggcgcacgtgcagacccatgactctctatatcagcatagcctcagcctgcagagccagggttttgcttcttttccatgccctactccggatcagttcagggcagaggtcgcatggcccggagattggcctgaggcccaggcaggggaggcacccgcggaggctcccggcgaggcaaatgaggcccgcgaggacaaggagatgaccgatttgcttgatttcttgggagggagcggagccacatga

SEQ ID NO: 24373 - DNA, 297 bp, Glycine max
  Peptide Sequence Number=SeqID_116058
atggggcaggtctccagctttgatgggagactatcgcacaactactatgcatactggggcaagatttcacccagccgctataaggtgacgagtgtggatcggatcgcgcctgcaagacacccaatggacacaaagaagttcaacagggtcctggggtttccagctctgattacgagcctctgtcagttctatggagtgtccgtcgctcccagcagggtcatcaggccccttactaatcgagctttcatcaagaagtactatgcccctaggcaggcgcagggcgaggcaccacaatga

SEQ ID NO: 24374 - DNA, 195 bp, Glycine max
  Peptide Sequence Number=SeqID_116059
atggctctggaatggtggtcccagaggaagcatcatgtacctgtcagggttcctggagctgctgaagtggatgttggagtaggagttgcagatgtggaaggaagatcagctggcctcgccctcgccctcgccctcctagcccctcggatagaaactgtcagatcatcaggattccaacagttcttcctgatgtag

SEQ ID NO: 24375 - DNA, 511 bp, Glycine max
  Peptide Sequence Number=SeqID_116060
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggaaccgtaaaaaggccgcgttgctggcgtttttccataggctccgcccccctgacgagcatcacaaaatcgacgctcaagtcagag

SEQ ID NO: 24376 - DNA, 190 bp, Glycine max
  Peptide Sequence Number=SeqID_116061
ctctccacgcaatcgagagaatgttgctgctgtcttgtggtcactatgcaccggagatccactgcaattaaaactagcgaaagaacatggtgcagaagcagcactggcattggaggaagacattagaggaagccaagactctatttggtggagggacctgctatcaagtcagcagcaacaacagaaccag

SEQ ID NO: 24377 - DNA, 344 bp, Glycine max
  Peptide Sequence Number=SeqID_116062
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgatccccccagcagcagaagcccggcgtgatgatggccgccatgcgtgcagacctgaaagagggtggcacggtgcagggcctgggccaagcgctcaagggcgggtaccgagctcgaattcgtaa

SEQ ID NO: 24378 - DNA, 576 bp, Glycine max
  Peptide Sequence Number=SeqID_116063
atgcgatcctgggtgaggggtcagtggatcccatttgatgcggatgccctcagccagttcctgggataccctttagtgctggaggagggccaggagtgcgagtatggccagaggaggaaccaggccgatgggtttgatgaggaggccatcgcccagttactgtgtataccggggcaggattttgcccgaactgttgctgggagacgagtgcggatcatgcgcaccaacatgaccaccatgacccatatctggatgaccttgctgctcagcaacatccagcccagcgatcataattctgacctccccctgccaaagtgtcagctggtgtacgccatcctgacacggatgagtattcacgtggctcagttgatcgctgatgccatctatctatttgcaggtatgatgcctaccaggcaccctctggacccggataagtccaacagggccctgggatttcccgctttgatcacaggactctgccaatcgttcggagtccccgttgcacctagcaaggtgattcggccgcccatcacccggacttttattgagaagtattgcatgcagagacaggccaag

SEQ ID NO: 24379 - DNA, 502 bp, Glycine max
  Peptide Sequence Number=SeqID_116064
gtcgactctagaggatccccgggaacttgagcgggtcgcggatgaagaacaccggggtgttgttgcccaccaggtcccagttgccttcgtcggtgtagaacttgatggcgaagccgcgcacgtcgcgctcggcgtcggccgcgccgcgctcgccggccacggtcgagaagcgcaggaacagcggcgtctgcttgccgaccttggagaagatgctggcgcgggtgtacttggtgatgtcgtgggtgacggtgaaggtgccataggcgcccgagcccttggcgtgcaccacgcgttcggggatgcgttcacggtcgaaatgggcaagcttttctatcagccagaagtcctgcaacaacgccgggccgcgcgggccggcggtcagggtgttgttgttgtcggccaccggggcgccagaggcggtggtcagatgcttcttgtcggtcatggcacacactccctacgtaattcctggaatgcgcggcgacggggccgcgcaacgtga

SEQ ID NO: 24380 - DNA, 846 bp, Glycine max
  Peptide Sequence Number=SeqID_116065
atgggaacaaatcaaaccggcaagaggttttaccaagtcaaggttaaaagcctagataccaccagcatcaaggaattagggcggttgatggaacctctccgaatgcaagccttccgcaagacttacggaaagatcttagagttgaccacaacagaggtatccatagaagctattgcatcactcacccaatactacgaccagcctttgagatgcttcacgttcggagacttccaattggtaccaaccattgaagaatttgaggaaattctaggatgtcctctcaggggaagaaaaccgtacctttactccgggtgtctcccctctttgagcagaattgcaactgtggtcaaggattcagcaagaggatatggcaagtcaaggggattgggtcccgtttatggatgtgttagcgttgctaatttttggggtcgtcctctttccaaacggatagatggtttggtggacctagcagcaatcgacgctttccttgcataccaccatagcaaggaaagtccggtagtagctgtcttggcagatttatttgacacatttgacccgaagcaagacacgaggcatccatgtccgctccagagccatcgctcgtgtactgaaaagagaagaatagattgggaccagcttttggctgggataggaggtagagcaatccattggttcccccgatggaaggaaggaaaggagggagtccttttctcatgtggagggtacccaaacattccgctgataggaacgaggggttgtattaactacaatcccgcgctcgctataagacaactagggtaccccatgaggggagcaccgacggaagaaaacatgtctcctttcctt

SEQ ID NO: 24381 - DNA, 451 bp, Glycine max
  Peptide Sequence Number=SeqID_116066
gccaccacttcaagaactctgtagcacgcctacatacctcgctctgctaatcctgttaccagtggctgctgccagtggcgataagtcgtgtcttaccggcgccacgcttcccgaagggagaaaggcggacaggtatccggtaagcggcagggtcggaacaggagagcgcacgagggagcttccagggggaaacgcctgcctatggaaaaacgccagcaacgcggcctttttacggttcctggccttttgctggccttttgctcacatgttctttcctgcgttatcccctgattctgtggataaccgtattaccgcctttgagaagcggaagagcgcccaatacgcaaaccgcctctccccgcgcgttggccgattcattaatgcagctggcacgacaggtttcccgactggaaagcgggcagtgagcgcaacgcaattggggatcctctag

SEQ ID NO: 24382 - DNA, 156 bp, Glycine max
  Peptide Sequence Number=SeqID_116067
atgtacagatcattaatgaaaaacctgtggctaagcaagtgctatctcgctaagcccagcagtggttgggctaagcgagccaagtcgctaagcccagataacttagtcaaatttttggaagtgttgctcgggctaagtgccatccccatgggctaa

SEQ ID NO: 24383 - DNA, 267 bp, Glycine max
  Peptide Sequence Number=SeqID_116068
atgtcgtcttctgcaccttttgtcatccaaggacagcgagttaggtggcaggcgaagataccttatggtcatccgcgcctttcttcaactgaggggaacgaattcaacggtatcaggatgatgtttttactctcgtcgtccggaaacattcaagcacaacgacgcgcgagattcttctctgctgggcagggacgatcgagtgcaatggcgaagggaagtgtcgtggttgtccaactttgtcgttttcaaaacactgaagtttattga

SEQ ID NO: 24384 - DNA, 300 bp, Glycine max
  Peptide Sequence Number=SeqID_116069
atgccaccacaaacagggacccttagtctgaactctgaatatatgaggtggtacaggcgtaaaacaaaagtttatgtcgacccaaaacatgcaagaagaggaatattgggtgaaatcgccgaaacactacattttatggtgtcgcctgttgggagaagggtttgtacttttgacgatttactgccatgtatcgagaagatcactcttttgtctgacaaagaggataggatacttgaggcacatgaagatgctcccccttctcaggcacagtttgaacatcaacagtttaatatactatag

SEQ ID NO: 24385 - DNA, 465 bp, Glycine max
  Peptide Sequence Number=SeqID_116070
atgcgaggtaactcttctacaagtaatttagctccattagatttggagatagaagctacttgcaggagaaacaatgctgaaagaaggagaaatattttacaggaaaggacagcacaaccaagtttggaggaagctgaatcatcttcagtattccctgagttaagggaatccaaagtaggtgcgtctgaagcacatatcatggctgaagatcaaccacggagggtgactcttgaaaattattctagctctaccgtgtcacaattcttcataagtatcgcgcggccgaaagttcaagctcacaatatcacctatcctcattccttgattcggctgattcaaggaaacttgtttcatggtgtgccggaggatgcagtaaggcttaacatgttttcattctccttggttggagaagccaagaggtggctgcattcattcaagggaaacagtttgaagtcctgggaggag

SEQ ID NO: 24386 - DNA, 777 bp, Glycine max
  Peptide Sequence Number=SeqID_116071
atggacagggcaaggttggtttacgaacttgtcacatggatggatatggatgtgggctcattcatttcaggtcagatctggcagatggcccagtccaactcctttaggctcggattttcggcgcttatcactgctttatgcatcgctcggggagttgttccagactcattgtcctttgagtcccagagccctgtcattaatttggcatatatccgaaagaactgctggaacccggatgatcccacgatcacctttccagggacccgcaaaactagggctcagggaccctcagacgcttctgctccttcttcttcagctccaccagctcccgcaccaacaccctctggcacctccatgcagacaccagatgtgatagtgttgatgctgcagagcctccaccatagcttatgccaggtgatgcagagtatacacgacttggctcagcatcaacccattatgagcatggaggcctttatggcccaggccgagccagagccagaggtgacaccagaggccgaggcagaggctgaggagacaccggagtgtagaagcaagcttcatgatgatgaatcaaagggtacatctacttgggttgttgtgactgggaacaagagagggtacatctcttgtggatcagttcaagtggagggtacatccacttggttgttcaaagagaacaagggagggtacatcccttgtggatctttgcttgtaaaggattttacaaggttgaaaagaaatctcaaggaccgcaggtcgcttggggattggatataa

SEQ ID NO: 24387 - DNA, 503 bp, Glycine max
  Peptide Sequence Number=SeqID_116072
ggtggacccttgggtactagtacctatcgccttaagagggttgcatgccctcaccttcagagggttgcacgtccttgccttaaggaatacacgtcctcaccttcagagggctacatgccctcaccttcagaggactacacgtcctcgcctcgaggactatacgtcctcaccttcagaggactacacatcctcaccttcagaggacaacacgtcctcacctttagagggctacatgccttcaccttcagagggctacacgccctcaccttcagtggactacacgtcctcgccttgaggactacacgtcctcaccttcagagggctacacgccctcaccttcagaggactacacggctacacgccctcgccttcagagggctgcacgtcctcgccttcggagggctacacgccctcaccttcagaggactacacgtcctcatcttcagagggctacatgccctctccttcagaggattacaatccttgccttcagaggactacac

SEQ ID NO: 24388 - DNA, 399 bp, Glycine max
  Peptide Sequence Number=SeqID_116073
atgaaccttcagtcacttttccagggacccaaaaatctagggctagaagatctgaggcctccatctacttttgcttttccgtcaccaccagcagctccagttcttccagagcctgcatcagggccaactcctgatcatgcagagtttgcaggatgtggtccagcaacgaccagttatgagcatggaggagtttctgtagaagcccaggagcctcagccagaccaggaggacgacattctggaggcctcagagcccactccacccgagtctttcatttttaagactgatccagtagcagctaccccacaggtgacaccagagccttccactgtagtgctggacatgtcttcttctcagcctgagtcatctgcaccagtgccagacctgacccttccttag

SEQ ID NO: 24389 - DNA, 369 bp, Glycine max
  Peptide Sequence Number=SeqID_116074
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggtggcttttatccctgtttttctactcacacttcacactcactatgcacattgttcaaccgctcccaagaacaactctgccactcccaatccctgtgtagttgttcccaagccctag

SEQ ID NO: 24390 - DNA, 247 bp, Glycine max
  Peptide Sequence Number=SeqID_116075
atgacccgcactcgtcttttttccgcagcacaagggaaatcttgccccggtatgcatagtagacgcgtgatagactccctctctggatgtgctcgcacagttggtcaccctccaatatcaggggcgcaagtctcggttaagcatctaagggcaaacgaccttctaaaggcgagggcgtgcagccctctgcaggcgaggatgtgcagtcctctgatggcgaggacatacagtcctctaaaggtgatag

SEQ ID NO: 24391 - DNA, 258 bp, Glycine max
  Peptide Sequence Number=SeqID_116076
atgacaattgaggaatcaatacatgttacttttgatgaaactaatattacctctccgagaaaggaatttcttgatgatattgcagattctttggaagatatgcacaatcaggaaatgaatctaaaaaggaagagaaatgaagaaaacaaggatgttcaagatgacatagcccaagaaaatgatgatcttcccaaagaatggaaaacctcaagaaatcatcctcttgacaatatcattggagatatctcaaaggggtaa

SEQ ID NO: 24392 - DNA, 319 bp, Glycine max
  Peptide Sequence Number=SeqID_116077
atgtcatgtcctgagcccctggcctttctccatagatggggagtagatgtcatcggggccattgaaaagcccaagcctcgaacgaatcgcttccggtggcaacctcttaacgactatcagcccatgtatcccgaattcccggatgaggacatcatggccttgtttgaggaaaaattggacaaagatcgggacaaatggaccgtatggttaggattcgactgcaccaacaacatggccgaatatgaagcatgtgtcctggccgtccaggcagcgattgactccatgtcaaactactcaggtgtacggcgactcagcgttg

SEQ ID NO: 24393 - DNA, 276 bp, Glycine max
  Peptide Sequence Number=SeqID_116078
atggcagaaatcaaggaaggatcatcaaccaaaacctcacagtcattgtttcactcaaactcaaacaaggaagcaggagataacactgtattggctcagggttcaatcaatcaacaattcattcagctcaaactgggtgcaagggataaatcattcaagcacgtggtcagctttttggctaagaggctatcacaatcaaacatggccttcatcatcctcaatttcatgcattcagtccatacttcagagattcatgcaaaaatcagtactaaatga

SEQ ID NO: 24394 - DNA, 269 bp, Glycine max
  Peptide Sequence Number=SeqID_116079
ctatttcagtcaatcatggccttcatgatgcaagctccattggagcttgtaggcctaggatcttcttcatcaatggattccttttcttcttggaagatgaatggaagaagaatggagaaaggaagagagagaggagacgccacttcaaggagaagatgagtctagaagaagctcaccaccataggaggccatggataagagcttggaggaagaaggagatgaatgaagggagagggagagaagagcacaaaattttgtgctctaaatga

SEQ ID NO: 24395 - DNA, 279 bp, Glycine max
  Peptide Sequence Number=SeqID_116080
atgtgggtgtcgacggagcggtttccggcagatttcaggtgggaggagaaagagaagaccgatttcaagaaggaggagaaagagaagagggagggcaaggttttcgagcgcgcggggcgacgcgtgactcgcgggatgcgtgttccacgaaaggaatacgcgcggagtcgccaccaacgtttatttgaggaaaacgtcggaaaaaccggaaaagacgcgatctacgaacttttaagtgaaaggttcgggagttgtatttacgcgcggggaaggtattag

SEQ ID NO: 24396 - DNA, 501 bp, Glycine max
  Peptide Sequence Number=SeqID_116081
tgttgtatttcaacggaagagtatatgaagacaatgacggtgtaatattcgaaggcagaaaatatgttgccttgcaaatttgtgatgacgaagatgttgaaactatgatcgaaagttttcaacaacaacaacaaatgtcagttctagaattgtacgtagaaaaggatgttgctggtagttctatatttcattctgcaaattctgttctatcatgtggacataatctatctcatcatgagtcgaaactgccaagaagtataagcaatttacatgataatgaagatgatgatcttgcgtctaactcatacattgaagagtctttgaatgaagatgatagtgttgatggaatatctgatacagacgatgaagtcaccaacatcattgaaccaatttcaattgttcacccaacagaaggtgtaccaggaattcaaaatccattttggaatgatgctttgcatcataacaatgtcaattggagtcatccggacgaggacatttgcg

SEQ ID NO: 24397 - DNA, 201 bp, Glycine max
  Peptide Sequence Number=SeqID_116082
atgcccaactattatgagaaaggaagagctcctgatcttgaaagtgtattggaagacttcatgacgtaccaagctagctctaaaggtgactgttattccatgcaacagcagggagctcagtttgaaagggactattcttctgtagattatcaatgggagtcaaaatggaaaccttattatcacaatgaagtagaaggatag

SEQ ID NO: 24398 - DNA, 114 bp, Glycine max
  Peptide Sequence Number=SeqID_116083
atgaaagtggatggtactgttgacaagtacaaagccagattggttatccaaggctttaggaaaaaggaggcctgtcttgttgaccgaattcctaggaaaaagaataaggtgtaa

SEQ ID NO: 24399 - DNA, 273 bp, Glycine max
  Peptide Sequence Number=SeqID_116084
atgggatcaagtcaaaagcctttgcttaaaaagaggttctatcaagtcaaaatcaagagcttagaggtcactagtttacgagagttggggcaattaatgggtcaacttcaacggcaagccttccgcaaagcctatgcacccaggcccacttgggccctccagaatattcctccagaaggctgttgcttctggaggaatcaacctggctcgcctgggcgagctgagctcgcctgggcgagctgggcggcaaccacctcccctagtttgctataa

SEQ ID NO: 24400 - DNA, 447 bp, Glycine max
  Peptide Sequence Number=SeqID_116085
atggcatatcaacttgctacttcaagaaaaattacagtatctttgagaaagaagtggtacatagatagcggatgctcaaaacatatgactggagatgcatcaaattttacacacatctctccaaagaaaagcgggtgtcataccctaatttcgtccggggacctttgctcgatgacgtgcgaccattctttggtcctcgtgaggttccgtaacattacggaaagaaaacaagtatcgttacgaattcgtaagtttccgtactttacgaaaaagatcaccaaaaaacagcaggggggtgtacttagtaaaatgggggtgcaaatagcacccaggcccacttgggccctccagaatattcctccagaaggctgttgcttctgggggaagcaacctggctcgcctgggcgagctgggcggcaaccacctcccctattttgctataaatag

SEQ ID NO: 24401 - DNA, 222 bp, Glycine max
  Peptide Sequence Number=SeqID_116086
atgaaagattgcaaaaatacaagtggtgaggatatctccttcacctctaggatctcacaatcactgacaaactcatctcaagctctcaaaccgggcttaaataggtggccttttcatgctcgtgcgcttagcgcacttatggaccgcttagcgcacattagtgaattttggctaagtgcgtgcctttctcgcttagcggatggactgaagcaatgcgcttag

SEQ ID NO: 24402 - DNA, 528 bp, Glycine max
  Peptide Sequence Number=SeqID_116087
atggtgtctcgtggcggagaaaagagcgaagaatgtctgtttcatcttggggaattacacgacatggaaacctgcccccgtgatggaagagctacttcaatgactcatggacagggggcagctcgaagtgtccgagagaggaatatgaccagccgcaggtccgagtaccccccgacagttcccaagccgatgccattttcctatcaaagcaataaggtcgtcccatggaaatatacccctcccgcttttggagaaggggttgcaaccgaggttgactccttgtcagccaaggtgaccaacattaccggccttagtggcatcacccacagtggccgggtgttcgctccccctcactcggaggaattgccctccaaggggaaagcacccatgacccaagagtccgcaggcgcggccaccccctcaaaagaagtggatcccccggtagtaaagggagctgaaaagaaggaaggtctccaaggaaagacggtgaccttggaagaggctcatgagttccttcgtctcatctaa

SEQ ID NO: 24403 - DNA, 380 bp, Glycine max
  Peptide Sequence Number=SeqID_116088
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttcttgcccaggcgagttggagctcacccaagtgagctgttgcttcaacctgaagtaaccttgctcgcccaggcggtttgcgtattgggcgctcttccgcttcctcgctcactgactcgctgcgctcggtcgttcggctgcggcgagcggtatcagctcactcaaggcggtaatacggttatccacagaatcaggggatacgcagaagacat

SEQ ID NO: 24404 - DNA, 306 bp, Glycine max
  Peptide Sequence Number=SeqID_116089
atgggaagcaaaaaaaccaacaatggaagctggggggctgctattcctgctgtttccatgggcaataggggggtgctcgcccaggctgtagaagcaaagcttcatggtgaatcaaagaacaattcaagagttcaagataagaatcaagaagaattcaagactcaagaagaaagtttagagtcaagaatcaagattcaaggttcaagatctcaagaatcaagatcaagattcaagactcaagattcaagaatcaagagaaggcttaatcaagataagtatgaaaagtttttctcaaaaattgagtag

SEQ ID NO: 24405 - DNA, 165 bp, Glycine max
  Peptide Sequence Number=SeqID_116090
atgttggtggcgactccgcgcgtattccttttgtggaacacgcatcccgcgagtcacgcgtcgccctcccgccgaaggaaaagttcattggccaaaaacttgtgctattcttcttcttctttccttcttcctcttgccaaaagattcaaaggacttaccgcctga

SEQ ID NO: 24406 - DNA, 264 bp, Glycine max
  Peptide Sequence Number=SeqID_116091
atgcaacctaatgcaatcctccctaggaaaggaccagttaccagagccatgagcaagaggctccaagaggattgggctagagttgataaagaaggccttagggttctcatgaaccttaggctaagctctagcttctcaaggaagcttctcaaggagcttctcaaggaagttttctcaaagaagcttctcaaggaagttttcttaagaaagcttctcaaggaagttttcttaagaaagcttctcaggaagctacctagtctataa

SEQ ID NO: 24407 - DNA, 261 bp, Glycine max
  Peptide Sequence Number=SeqID_116092
atgggacctctccaaaggcaagccttccgcaaagtgtacgggaagattctagatttgaccgcagtgaaggtatttatggaagctgtcgtatccctcgcccaatactatgaccagccgttgagatgtttcacatttggggacttccaaatggtaccaactattgaagagtttgaggaaaaccttgtcctctttccgaacgtggacggtttggtggacttagccgcattgacgccttcttcgcgtatcaccacagcaaggaaa

SEQ ID NO: 24408 - DNA, 792 bp, Glycine max
  Peptide Sequence Number=SeqID_116093
atggtgggacaaggaggagaggtgttgggcaacatcggtggaccacacatggggcataataggaatgcttacccctatgtcttaccccccaattatatgccgcccaccatgcacatgcccaacgagaacgctaatcatgtcgttcccgttacatttgagggtcagcaaccttgggagcatgctcaatgtgactttgacccatatcccacattcaccgccgagggattggcatttaatgctatgcctcaacccaataccacggaagctcctcaaccccaccctctgcaacaactgtgtttcttagtaggtgggccgcctccggcagtggaagggatagagaaacttgatctcatcgaggagagattaagggctgtcgaagggtttggtgattaccttttcgctaacatggcagaattgtgtttggtacctgatgttgtcatccccccaaagttcaagatgatcactatgatagtggacacgttaccagtgttctactgcaaaaagttggtgggatacatgcccagtagcttcgtagatttagtatttgcgggcaaaaggatcgaagtaggcatgaaaagagggaagttcgattatctcgcctctgccggcacgagcaataggagattcggggcaagtagggcaataaagaaggaaggagaagcccacgccgtggcttcagctcctacttggccgaagccccaacaaacccctcacaacacttaccaatatgcccaacatcaaccaagcttttcagcccgcgtcggaaacccctccagtctagtgcccgtttag

SEQ ID NO: 24409 - DNA, 581 bp, Glycine max
  misc_feature (14)..(14): n is a, c, g, or t
  Peptide Sequence Number=SeqID_116094
ttcctgggccatcncctgatattggaaggcgaccaactgtgcaagcacatccagagagggaggctatcacgcatctactatgcataccggggcaagatttcacccgtgccgctgcaaaaagacgagtgcggatcatgcgcaccaacatgaccactcttacatggatatggatgacgtcgctatttagcaacattctgcctagcgaccacaatgccaatctccccctacagatgtatcagttgggatcgcgcctacaagacgcccagtggacccgaagaagtccaacagggccctggggtttccagctctggtggcgggcctctgtcagtcctacagggtgcccgttcccccagcgaggaatcgcacccacaaagacactcagtggacccggagaagtccaacagggccctgggagtttccaagctctaattacgggtcctctgtcagttctacggagtgctttcacctccggcaaggcgcagggcgaaacaccacatcagcctggggatggccggcagcgggcaatagacgcaccgccatcacctctagagttcacctcagttcatccacaaaaaggttag

SEQ ID NO: 24410 - DNA, 453 bp, Glycine max
  Peptide Sequence Number=SeqID_116095
atggtctctggtaatcgattaccaagggagtgtaatcgattaccaggcttgaaaacgaggtttcatgtcctgaagctgtataattcgagtttggtctctggtaatcgattaccaaggctgtgtaatcgattatcagagatgaaaagcctaaagatacccctttacttgcatatagtgcgcactgtggagtggatactacccacgcctacaccataccatctcgtggagccagtccaagtgatcgaggtgacgtcatccgaggaagaccctgaggaggatcctgaggagctacctcctgagcctgctgtggatgctcttgactttctagagggtgatgaggacccactccctgaggtggattctcccgaggacgtcatgtcggcatctgaggtagactctacggaggatagtggccctggagagatggcgatcagtggaggctctttatcatag

SEQ ID NO: 24411 - DNA, 702 bp, Glycine max
  Peptide Sequence Number=SeqID_116096
atggctatgtttgacctggatgttgtcctagagttttacgccaatgcttggccaacggaggagggcgtgcgggacatgcggtcatgggtaagaggccagtggatcccttttgatgcagacgccctcagccaattcctcggagacgcgctagtgttagaggagggcaaggaatgcgagtatagtcagagaaggaaccaggccgatggatttgacgaggaggccattgcccagctgttatgcataccgggtcaggattttgcccggactgctgccgggagacgggtgcggatcatgtgcaccagcatgaccaccttgactcagatgtggatgacgttgctgctcagcaacgtcctgcccagcgatcataactctgacctccctctgccgaagtgtatgccacctaccaggcaccctctagacccagataagtcaaacagggccctggggtttccagcgttgatcacgggcctctgtcagtcattcggggttcccgtcacacctagtaaggtgattcgaccgctgatcacccgggccttcattgagaagtattgcacgcctagacaggcacagggtgatgcaccgcaggccgtagacgcaccgccacctcctcatcaggctgatccagctgggtcatttggcatggagcggtatttacaacacttgattctccagcaggcggccaaccacagggggcaggtgtga

SEQ ID NO: 24412 - DNA, 507 bp, Glycine max
  Peptide Sequence Number=SeqID_116097
atggacccgaagatgtccaacaaggccctggggtttccagttttggttacgggcctctgtcagtcctacagggtgcccgttcccccagcgaggtcatgccatcgtgacatagggatcgcgcccacaaagacacccagtggacccggagaagtccaacagggccctagggtttccagctctggttacgggcctctgttgtcctacagggtgcctgttccccccgacaagggatcgtgcccgcaagacacccagtggacccgaagaagtccaacagggtcttggagttgtcaagctctaattaggggtctatgtcagttctacggagtacctctcacctccagcaagggcatcaggccccctactaatcgagctttcatcaagaagtactgcatctccaggcaggcgcagggcgaaacaccacagcagcctggggatggccggcagcgggcaacagacgcaccgccatcacctctagagttcacctcagctcatccacaaaaaggttag

SEQ ID NO: 24413 - DNA, 123 bp, Glycine max
  Peptide Sequence Number=SeqID_116098
atgactttacagttggctgaccgctccattaccagaccatatggagtaattgaagatgttttggtaagggaggttgaacaggaggtcctgaaggtgagggccaaatttgatatcacccattga

SEQ ID NO: 24414 - DNA, 735 bp, Glycine max
  Peptide Sequence Number=SeqID_116099
atgaggggagcgcaacggaagggagtctctcatctttcttgtgaaagatttaggcgcgcaaggtctcaaggttatacaagaatccacaaagcgtggaggagtccgttgaggaaagacaaggagcttaggggcatccgtaatggcgtcatcggaggttatcatggatggctaataattcacacgcgagggttagattggctctccaagttgaaagttaatgataaggagaacttcgaagctccggaggaagatgaagaagtccgagctctaaaattggagctagggaaggcaagactcgccaaggagaagttcaaatcagatgctacacacatccggaaagagtgcaccgagttacaagaggaaaacgcagccactgcaagagcccttgaacaagaaaccaaaagggcccgcaaggagaaatatggccgagagaaattccgaggagcattgtggggtagcaacaatgagctcaagctccgaagagaggaaagagatcggtcacaggtgcatggcatgatcttgaaagaagagttagttgcttgcgcgaggtccaaaaggagtttggctcaacacttggaagccatggagcaaagcatgctagctatcatagggcaatacaaggaagagttaaaccagtctgtggcccatgaacaaaagctagtggaggattttgcacaagtgatcgaggccgtacccgaatcaaataaacatgaaaatgcagtaactaggaagtga

SEQ ID NO: 24415 - DNA, 447 bp, Glycine max
  Peptide Sequence Number=SeqID_116100
atgcagcactgtatgaaagtcagtaccatcccgttaaggactggttttgttgttcatatgtcaagggctggcggagtgtttcacgcgttagctgggcccctgatccacgtagaccaagggcgaacactcatcgtttacggcatggactaccaggtttttggcgactttcactttcaacccgattcaccgcctacgtgccctttacgcccagtcattccgaagaacacttgccccccccgtcttaccgcggctgctggcacggagttagccggggcttcttcctcgagtcctgtcatgatcgcgcactcgacgaaagagctttacaagcggcattgcccttcttcactcacgcgatattgctggatcgggctttcgcccattgtccaagattccccactgctgccccccgtgggagtccgggccgtgtctcagtcccagtgtggctga

SEQ ID NO: 24416 - DNA, 402 bp, Glycine max
  Peptide Sequence Number=SeqID_116101
atggcggcgcaactaatccatgatcgagtgaagatggaatgcctagagggagcttgggagaccctcgaaggcaacacgaggttccgatttcggggcacgattcgatttacgactacttcattggtgcatccagatgaacccgcgtgcacgcttcagcgtactgtggagtggatactacccacgcctacaccataccgtctagtggagccagaagaccctgaggaggatctcgaggagctacctcttgagcctgctgtggacgctcttgactttctagagggtgatgaggacccactccctgaggtggattcttccgaggaggtcatgtcggcatccgaggcagactctacggaggatagtggccctggggagatggcgatcagtggaggctcttcatcatag

SEQ ID NO: 24417 - DNA, 222 bp, Glycine max
  Peptide Sequence Number=SeqID_116102
atggcatgcaacctttgtttgaccgcttcgaggtacttggcgccctttgttgcacaatacgtgaagttccgagacatgccgaaaatcaaaaggaagtatgttacgcaatcaaaatccaaggcgaggtgcttccgtaacgtttccgtgggtgatttcgcgaagattgtcaaccgttcttcgtcgttcgtcgttcgttcttcgtcgttcttcggtcttcaactg

SEQ ID NO: 24418 - DNA, 603 bp, Glycine max
  Peptide Sequence Number=SeqID_116103
atggtgatgatgctgcagagggattccctggtggtccacgagacccgtcagtgctcacatcatttgtcgagcatgttgcacatgccgtgtggagtggacagtgtcacatgggaggaaggtgacactgattgggaggcagtgcctgagattgaaggcctggtggctgccacaggattaagtccactgatagattgttcagttattactggcgatcctggacttatatccgcatttgtggagaggtggcacagtgagactagcaccttccaccttcctgtaggagagctgacgatcacattggatgatgtgtcgtcaatcctacatttgcccatcactggcgccttgcacagtttccacgccctttctacggaggaggccagattcttgcttacggagttgctggaagtgtctgtggaggaggtcagagcggagacaacactcacacgtggagcatatgtacgattagggtgggttcgagacatatatgacgccagatgtcagcccggcggtggattgtcgctgctcgcgcttatctactgcaccttgttggttgcactctttttgctaataagagtgcacatacgtgcatgtggtccaccttga

SEQ ID NO: 24419 - DNA, 708 bp, Glycine max
  Peptide Sequence Number=SeqID_116104
atgacgacgacgaagaacaagtacgaagagcgatgtgcaatgccaccaattataaaactaaatcaatcggaggtatgtgcatcttactacaaatgtggacatgggaacgatgtccaaccttggctccaaagaggactccttcccaagtggctgcgacgtggaaaccaacatatcggcaatgatgatgtgagagtttttcgtcgcaagttagatattatgaaacgtcatgagtttgtgtgggagccgtacccatcaaccgtaatatcactgttgcctcccgtttgtttagtcggaagtctcgcgtggtacgcggtggtgccactaatttgtttccaagttattgagtggcaccaaccggacagagtattgagacaatttgggatgcaacaaccaattccagagtctccttcacaacccttaaacattcatggtataacattgaaagggaaacatgacgaaaatcgggggcaattgttcgccccaatgattgatcaatggaataatcgccatgcatttagggtcgatgcttatccccgacaagaaggcctattgagttttaactcggactacatggtctggtataggcgaaagacaaagatgtttgttgacccaacaaatgcaaagacggctacattgggtgaagttgcggaggcattacaatacatggtgtctcctcaagggaggaatacatgcacatttgatgatctc

SEQ ID NO: 24420 - DNA, 381 bp, Glycine max
  Peptide Sequence Number=SeqID_116105
atggtggtcatcctgccgaaggaacacctagttgtctggttttgttcattgcataacaggccagacaactaccttaaggggattattaatagcctaaatcaaaggcttctgctaggtggattgtcatcaaggcaaaaaggaagtactgagtgcggctactatgtgatgcactggatgtccaccatcattttaggaacttttaggaataattgggaagcgtattttaacgatcctagaccattggagccagagagattaaaggcattgcggatccagtgggcacagttttatctccgagttagagatcaggcctgggatttagggacagtggttttttccttagtttactttggtttaacattttttacattttctatgtaa

SEQ ID NO: 24421 - DNA, 255 bp, Glycine max
  Peptide Sequence Number=SeqID_116106
atgacagtcaggctcagggataacaggatgatcaatgataaagatggttctcagtcccaatctagccagagtaatgtggtggaaaaatttctgctgaatgctcaagtggtcagtataggtgaaatcaacaatctcagacaggattgttactgcttaactgttggaacagttgacgaaatcattattgatgctccatggagttatgacagtcgtcctaactgtacaacgacatttgatccatcaaaaggtggctga

SEQ ID NO: 24422 - DNA, 459 bp, Glycine max
  Peptide Sequence Number=SeqID_116107
atggcgggtgaattagtggaatttgaagagggtactataggcattgctttgaatttggaatccaaaaatgttggtgttgtattaatgggtgatggtttgatgatacaagagggaagttcagtaaaagcaacaggaagaattgctcagatacctgtaagtgaggcttatttgggtcgtgttataaatgccctggctaaaccaattgatggtcgaggagaaatttcagcttcggaatctcgattaatcgaatctcctgctcccggtattatttcgagacgttccgtatatgagcctctccaaacaggacttattgctattgattcgatgatccccataggacgtggccaacgagaattaattattggagacagacaaacggctattggtcaaaaagcatcttctgtggctcaagtggtgaataccttacaagaaagaggagcaatggatacactattgtag

SEQ ID NO: 24423 - DNA, 402 bp, Glycine max
  Peptide Sequence Number=SeqID_116108
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccaggttgacttacggtgttgaacgccagttacagtgcaaagcaaggaaccattcagtgtttcgatcaggaatgcgaaagataccaaaaaagaagggcaaaaaggtcttttcattaagtttcctagaccctagctcgcccaggctagcctctggctcgcctgggccaccaaaagacttcagggtgaaggaaccagcttgcttaggcaagccagttacttcaggactaagtctcagggtaccgagctcgaattcgtaa

SEQ ID NO: 24424 - DNA, 516 bp, Glycine max
  Peptide Sequence Number=SeqID_116109
atggatcggtttgctcttaccttgaacgggagtcaagaacttccccgattgttagccaaggccaaggcgatggcagacacctactccgcccccgaagagattcatgggcttctcggctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaagtatgaagcagctcatagagaagaacgcggccaccgccgccgctgccagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccgtcttgcaagaagggggatcctctaga

SEQ ID NO: 24425 - DNA, 330 bp, Glycine max
  Peptide Sequence Number=SeqID_116110
atggcaccaaacttgaaaatcatgccagtcttgaaagaactagacatgaagaaggcaaaggcgagaatcatgcaaagtaaatttgttcactacttcaaaggatgcaagagtcagagacattcatttgtcaaagaatactcaaaactgaaatttttgggtattgacaatcaaatgcaacaaagtggtgaagtgaacttaatttattgtaagtctaaagatcaactggctgacatgtttacaaagtcactacctatcaacaaatttgaactcaaagaattggagtttgcagttccaaaagcaaggaggagtgttgaagatatacttttgtaa

SEQ ID NO: 24426 - DNA, 270 bp, Glycine max
  Peptide Sequence Number=SeqID_116111
atgggcagaaatgtgtcagcattgataggtaaatatgttcctcacattcctaagatatgtaaggacctaggaagtacatatacttttgacttgctttatgaggtacaggctgaggaaccctcctcttcttctcctaccctggttcctcccactgttcagccactacccacaccagagttgaagcccttatcagtaaacctcaagtatgcttacttagaagacaaggaaaaattttcagtgatcatctctgcctcccttgctgttgagtaa

SEQ ID NO: 24427 - DNA, 550 bp, Glycine max
  Peptide Sequence Number=SeqID_116112
atgcagatgctccagtcctgtacccactgatgaggtagctgtgtctccggcaaaaccacttccaaagcctgatccggaggtcaatgatccgcttaatctgatgacattgaccatctcagagctattcttgaggccttatcaggttacatgggatgccaccgtgttcggggtctttaatccagatttcctgctctacataaagtacgaagacctctccgaaatcgcacacggtggtcagtgtctcggcatatcatcctttcagaggtctgggcaatcgcagtttgagtgtgaaagttacataaagacttggatgcagagttcaaaatgcgatgtctatcttggagcctacctaaatggtgaacactggcagatggtggtcatcctacccaaggaacacctagttgtctggttttattcattgcataacatgccagacaactaccttaaggggattattaacagacaaaaaggaagtactgagtgcggttactatgtcatgcactggatgtccaccatcattttaggaacttttaggaataactgggaagtg

SEQ ID NO: 24428 - DNA, 437 bp, Glycine max
  Peptide Sequence Number=SeqID_116113
gtactgatatagacgaccggtgggtacacttttcagatcatgtggtgcctacagggaagctctatgtagttcctgggcaagtggccccagactacatggagtggttttttcagatttcgcacccttttctgacgccgacggaggacactgttgagccgagacctgcgcctccccctcccactcatgatgatgacttcgtcgagccacctgtcgtcgaggtttcagtcacgtcggatctccctacgcattcagtggttgattgcacaacatgtgtaaggattggaaggattgctgagcatttggagcgcgtcatcaacctcaggatggtgactgaagggactgactcatatgatatcatggatccttgtctgaggatagctagagatgacgacccagatgacagtcttaggccgcgacagagaccccgcatagattag

SEQ ID NO: 24429 - DNA, 318 bp, Glycine max
  Peptide Sequence Number=SeqID_116114
atgggtgactcagacaaatgcgggctgtacatcaaagaaaatccttctcgcctagttgccctaggaagagtttatgagggatccacagcggttcacaacatccctttgttgcatggccaagtgaaggttggtgttgaagaggttaaaaatgcagaggctcccattcctatacccactgacgaggaagttatgtctccagcaaaacctccagataggccagatcatgagatcgatgatcccctatatttaatgacattgaccatcccacaactttttgtgaggcctctccaagttatgtgggatgctatcatgttcggg

SEQ ID NO: 24430 - DNA, 81 bp, Glycine max
  Peptide Sequence Number=SeqID_116115
tcccgagacgtgccggaaatcaaaaggaagcaggcttacacgatccgtgaaattccgtaatgtgacggaaatcaaaaggag

SEQ ID NO: 24431 - DNA, 399 bp, Glycine max
  Peptide Sequence Number=SeqID_116116
atggagaggagtatgattgatgctgccagtggtggagcccttggtgatatgactcctgctgaggctaggaatttgattgagaagatggcttccaactcccaacaattaagtgcaagaaatgatgctattgtccttagaggattccatgaggtggccacagattcatcttcatctgctaaaattaaaaagcttgagggaaaacttgatgccttggtcaacctaaggaatcatccaaatctgagatggacaagtcctccacaacaacaacagcctgtccctcctttccagaatgccgctggtccaagcaagccacatgttcctcctctaatggagcaacagcagcagcagtcacaacaaagacaacaagcaactgaggcccctccctcaaccttcctttag

SEQ ID NO: 24432 - DNA, 166 bp, Glycine max
  Peptide Sequence Number=SeqID_116117
atggctgcgagaaatgagcgagaacgacttcttacccaggccttgaacaacttggcgcaagttatggccaatcagggaggcggtggaggagcaactatgtaccatggtttagatcgctttcagaggaacaacccacctaccttcaaagggggttatgatcctgagg

SEQ ID NO: 24433 - DNA, 252 bp, Glycine max
  Peptide Sequence Number=SeqID_116118
atgatgataacaaaagatgatgacaaaggtgatgacaaaaagctcaaagatcaatcaaagaacaactcaagtgaatcaaaggataagaatcatgaagaattcaagactcaagaagaaagtttagagtcaagaatcaagattcaaggttcaagatctcaagaatcaagatcaagattcaagactcaagattcaagaatcaagagaaggcttaatcaagataagtatgaaaagtttttctcaaaaattgagtag

SEQ ID NO: 24434 - DNA, 324 bp, Glycine max
  Peptide Sequence Number=SeqID_116119
atgcatgaacgacaatcaattcatggggatccgaataacagtggagaatggagaattgcactaggcaatcactacgcgtgtctccagacttatgggtggaggatgcatgaacgacaatcaattcatggggctccgaaaaaaagtggagaatggagaattgcactaggcagtcactacgcgtggctccagactcatgggtggaggatgcatgaacgacaatcaattcatggggttccgaataaaagtgttggcaggacagaatggtccaccgggttttttccacctaagaaagcaaacatgctttctgcaaagaaaaataaatga

SEQ ID NO: 24435 - DNA, 288 bp, Glycine max
  Peptide Sequence Number=SeqID_116120
atgcagaacagtgaggtgagtgttgatgtgtgtcgcaacctaccttcgacgggagggcgatgcggggctcacgggtgtgtcttccaagggaggaaggtgatgcaatcctaccccccaaaggtatcggatagaagacaccaagaggcttgggctagagctactaaagaaggccctagggttctcatgaaccttaggctaagctctagcttctcaaggaagttttctcaaagaagcttctcaaggaagttttctcaagaaagcttctcaaggaagctacctagtctataa

SEQ ID NO: 24436 - DNA, 225 bp, Glycine max
  Peptide Sequence Number=SeqID_116121
atggcgaggatctgtagtcctctaaaggcgagggcgtgtagccctctgaaggcgaggacgtgtagtcctgtgaaggagatgaggtctagtcctctgaattggaggacgtgtagccctctaaggggaggacgtgcagttcgcttgaggctcatgcacgatgcctttcattgccccgtaggtctgaggtatccatcgttgttttgttttcacaaccctgtagcatga

SEQ ID NO: 24437 - DNA, 693 bp, Glycine max
  Peptide Sequence Number=SeqID_116122
atggacaccgccgcccgcctgtttgatagcggtaaagaattctggatgtgcgccagccggggggatgactattcgccgggctatttttctcctcagaaggagaactggctggatatcattcgcgcctccagcgccattcccggtttttatcgtaccggtgcgctactggatggcattagctatctggacgggggcatcagtgacgcagtaccagtgcaggaagctgcccggcgcggggcgaaaaccattgtggtgatccgtaccgtgccatcgcaaatgtactacaccccgcagtggtttaagcggatggagcgctggctgggcgacagcagtctgcagccgctggtgaatatcgcgaagcagcatgaaaccacctacggcgcgatgcagcgtttcattgaaaaaccgccgggtaaactgcgtatttttgaaatttatccccctaagccgctgctgagcatggcactgggcagccgcattcctgcgctgcgcatggattacaaaacgggtcggctatgcggacgctacttcctggcgacggtgggaaaaatgctggcggagcaaccgccgcttcaccggcataaacgcattattacgccgcctgctattgtggccaacgacgccctgacggtgccgctggtggatatcccgcaggcgaatgacgctttattagataacgaggatctggcgtga

SEQ ID NO: 24438 - DNA, 1140 bp, Glycine max
  Peptide Sequence Number=SeqID_116123
gagaacttcgaagctccggaggaagatgaagaagttcgagctctaaaactagagctagggaaggcaagactcgccaaggagaagttcaaatcggctgctatccacatccagaaggagtgcaccgagttacaagaggaaaacgcggccactgcaagagcccttgaacaagaaaccaaaagggcccgcaaggaagaatatggccgagagaaattccgaggaacactgtggggtagcaacaatgagctcaagctccgaagagaggagagagatcggtcacgggtgcatggcatgatcttaaaagaggagttagttgcttgcgcgaggtccaaaaggagtttggctcaacacttggaagccacggagcaaagcatgctagctatcatagggcaatacaaggaagagttgaaccagtctgtggcccatgaacaaaagctagtggaggattttgcacaagtgtacgccgaaaaagaagcaagagggagggtgattgatgcattgcatcaagaagcgactatgtggatggataggttcgccttgaccttgaatggaagtcaagacctcccgcgtctattagccaaagcaaaagccatggccgaagccgatctatcggctttaaaagatcaaatggctaccatctcggaggtcatgttaaaactccagaaaactatagaggataaagccacggcaaccgcctccagtacagttagggaagcagagccggtgctgcaacccgccttaaatccgggccgagaaagaaacacgacaatgtttggtcgaaggtatagcccgcaagcttatccttatggcttgcctccggacttcactccttgtgccaccccgggagatttaagccaagcccctactttcgaggggcagctcccaccttatgacgactatcccgggcaagacgatgaggaaggagatacccatctcggtcccctgctccacctcaaagatccgtccccccatgaactaccccaaccaaacatagtccgccatatcccgatttcacccacacccgtaaaagaatctgttcccttcgtggaagataagggaaaaattgaggcgcttgaagagaggttgagagcagtcgagggcctcggcaattacccattctcggatctagcggacttatgtctc

SEQ ID NO: 24439 - DNA, 317 bp, Glycine max
  Peptide Sequence Number=SeqID_116124
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttggacttcaagggcatcaaccccgtcgaccaagacgaccttgtggtcgtctccatcatcatttcaaacttcatagtgtctaggaaccttatcgactaa

SEQ ID NO: 24440 - DNA, 642 bp, Glycine max
  Peptide Sequence Number=SeqID_116125
atggctatttataggaaaaagccattttggggcagggaaggctcgcccaagcgagctggtttcttaggcatgaagctatttcatggcccaggcgagccagatgctagcctaggcgagctaggatctagaaaaatccaaaaaaaaagatccttttgcccccttccatggtatctttttgttctcttgatcaaaacactaagtgattcattgcttcacactggtaaatttgacattcctgaaggttcaactgccaagaagaaggtgatgtcaacggtcgccaccaaatggaggcaatttaagtcttccctcaccactaaatatgtatatgctaacaatgaaggtcaagataaacatgatccttctgctaagtatggtctggatcctgaaaatttgaaacaatatgcaaaaagccgacaaacccctaattacaatgaccgtcgatcctccatcctcgattgcaatacaagtgaagtggaagatggctcaaacaaagcgatatgggtagatgacatctatagtgtgatgcaatcctaccccgtaaaagcattggatagaagactccaagaagattgggctagagatgcaggagaagaccttaggattctcatgagccttagggtagattttgggcccatgggctaa

SEQ ID NO: 24441 - DNA, 459 bp, Glycine max
  Peptide Sequence Number=SeqID_116126
atggttgaagctggcaactggccggatgaaaccgcccttgaagggctcgtcagaaagtcggtcgaggccgcctgggccaatcttggcctgaaaagcgcggcaagcgagctgagtgttgtcttcgccgacgatgccttgatccagaccctgaatgcagaatggcgcggcaaggacaagccgaccaatgtgttgtcgtttccggcgtttccggtcaaggccggggcgcagccgggcccgatgctgggcgacatcatcatcgcgcgcgaaactgtcgagcgtgaggcccgtgaagagggcaaaccgctcgaaaaccatctcgctcacctcgtcgtgcatggctttttgcaccttttgggttacgatcatgaaaccgatgcggaagcggaggttatggaggggcgcgagcgtgaaatccttcatgctcttgccatccccgacccttatgctgtatccgaataa

SEQ ID NO: 24442 - DNA, 493 bp, Glycine max
  Peptide Sequence Number=SeqID_116127
atggttatttcgctaaccgttcacttcgaattcataaacgtcgctgcggcacaagatatcgctgaactccagcgcctcaccctgggcattgcggctggtctgggtgatgtgcaacaacggcgcgccacacggcacgttgagcagctcggcaacctcgtcgctgcaggataccgccttcagcagaaagaagcgcggcggaatataggtggtttccagcgagaccgggctgccgttcagcaagcgcaaacgccgcagtttgaccacctcatccccttccgtcagccccagcgccgccgcggccttggccggcgcgccgacccgggtgcgcagcagccatcgattgctgacgctgctgccgtgacgcagcgcctgagcggtgaaaccgctgtccttatcgagggaatagccaatgtgcatcgccacgcgggtgccaacgccctgctgtcgcaaaatcagccccttctcctccagcagtttcatcgccttgctgacg

SEQ ID NO: 24443 - DNA, 666 bp, Glycine max
  Peptide Sequence Number=SeqID_116128
atgagaaagcgccacgcttcccgaagggagaaaggcggacaggtatccggtaagcggcagggtcggaacaggagagcgcacgagggagcttccagggggaaacgcctggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtacccaggttgtcgtcggtgttgaggttaaggcggtcggagcggtattccagggggatcctctagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatag

SEQ ID NO: 24444 - DNA, 663 bp, Glycine max
  Peptide Sequence Number=SeqID_116129
atgctgtccggcatgctgctgccgccacaaacccgaccgcagggtgagctacgccagggcgcgagcggtggctgggcggcgtggcgtgacctgctgcgcgagaacagtgtctggcgtttcatgctgtgcgtaacgctgatgcagggtgcgcacgccgcgtattacagcttcagcgccatctggtggcaggaagcggggtattccgcgtcggtcgtgggctacctgtggtcgctgggcgtggtggccgaaatcgtgatttttgccctgagtaaccggctgtttcgccgctggagcgcgcgcgatctgctactgctgtccggcgtgtgcgcgctggtgcgctggacgctgctgggtgccagcacagcgctaccgctgttgattgtggcgcagattctgcactgcggcagctttaccgtctgccatctggcggcgatgcgctttattgccgcgcgcaaaggcgcagaggtgattcgtctgcagtcgctctattcggcgctggcaatgggcggcggcatcgcggtgatgacgatggtgtgcggcgtgctgtttacccacctgcacggccagctgttctgggtcatggcgctggtggcgctgcccggcgctgttcctgcggccacgcgcggcttaagactccagcagctgacgaatgcgctgctgctg

SEQ ID NO: 24445 - DNA, 993 bp, Glycine max
  Peptide Sequence Number=SeqID_116130
gctggagtcatgagcagccggatcgccgtcgtcccgggttccttcgatccgccgaccctgggtcacctcgacgtgatccgccgggccgccgcgctctacgacgaactgcatgtgctggtcgtgcacaatcccggcaaagaggccatgctccccatcgcacagcggctttccctcctggagcggtccatcgccgacgacggtatggagggtgagatcgtggtcggttcgtggagcatggggctgctggtggactacgcccgcgacgtgggggcaggggtgctcgtcaagggcatccgctcgcagatcgatgtcgcctacgagtcgccgatggccatcgtcaaccggcacctcgccgacatcgagaccgtcttcctcctgccggacccttcgcatgcgatggtgtccagttcgctggtccgtcaggtcgcctcgctcggcggcgacgtcacaccccctttcgtcctccccgtacgcgacatcgtccgacgcccgggggagatgcgcgagcacgagttctcggtggctttgcgggagacctggggtgagggcatcgtctcgttcgaggccgggacggagatggacctcgacatcaggctggagtccgttcacgaggggattctggtgtccggaacggccgatgccgagtacaccggagtctgcggtcgatgcctgatcgacatctcccggcccgtcgaagtcgagttccaggagcttttcgcgtatcctggtgaggaagaaactgacttcgaggttcaagacgaccacgtggatcttgaaactctcgtcagggatgcggctgtactggcccttccttttcagccggtgtgtcagccggattgcccgggtctcgacccgaaaacgggtgagcgactgaccatgagcaccggaacggagcaggtcgctcccatcgatcctcggtggagcgcgctccagaacatcgcagaccaagacggcggggcagagagccacgtcgccgagaaagaagagagctag

SEQ ID NO: 24446 - DNA, 323 bp, Glycine max
  Peptide Sequence Number=SeqID_116131
ttcgtctttgtcacaaactggcctgcgcttccgtgactgcaaccacattgtggagttcgtctctgccacttatcgattgaggttgaagaaatctaggaaaggaaagagtcccggaaaagactcccaaggcgttcttcttctttctccttctgccctaagttcgtctttgtcgcaaactgggctgcgcttccgtgactgcaaccacattgtggagttggtctttgtggagttcgtgtctgccacttatcgattgaggggggggggggaagcgatttggaagtccattgtggttggctttaagcctcctagggaagccatcgaag

SEQ ID NO: 24447 - DNA, 231 bp, Glycine max
  Peptide Sequence Number=SeqID_116132
atgttggcaacccattctggataccgagcgacggccagaaaaccagcgtcaaattgcttcttcacttcttcttttatctttaaggatgtttcgggcttcatccttctcagtttctgctttaccggggaacactcgggatttagaggccccatttcttggtcctcatgggcgaccattctttctaattctgggggaagtcccacatcctcgttcccttcatcttccgtttga

SEQ ID NO: 24448 - DNA, 485 bp, Glycine max
  Peptide Sequence Number=SeqID_116133
atgaccgatccaggtctaaaaaggaagaagcaccggatgacgccgatcgagcatttcctaatagaaatcggtaccgagctcgaattcgtaatcatggtcatagctgtttcctgctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaaccccggtaagacacgacttatcggcactggcagcaggcactggtaacaggaatagcagagcgag

SEQ ID NO: 24449 - DNA, 108 bp, Glycine max
  Peptide Sequence Number=SeqID_116134
atgggacaccttaggttgtcatactttttggtaggaataatcaacatgaaaatacagaaaaaggtgttgaggaaaaaagcccagagtttcaagaacctcgggatttga

SEQ ID NO: 24450 - DNA, 249 bp, Glycine max
  Peptide Sequence Number=SeqID_116135
atgcctaaatcatctcccaacatgcatgtgaagcaagaactgttacctggtacactaacttggaaccttcccgagtgcattcttggaaagaccaaatggttgccttcgttaggtagtgtcagtataatggcttcagataggatgcaactacagaacatgtgcaaaaagggggcacagatctttcaaagaatatgcccaaaggtggagggatctggcagcccaagtgtttccctcaatgacgaagaatga

SEQ ID NO: 24451 - DNA, 556 bp, Glycine max
  Peptide Sequence Number=SeqID_116136
gaaagacgccataactaagccggacccaaggcatccttatcacaccagatccaagtctaggatgatgggtgacctagaggaagtacaagaacagatgaaagccgacatgtcagttttgaaagaacaaacgacttctatgatggaagccatgcttggaatgaaacgactaatggagagtaacgcggccaccgccaccgccgctagcacggttgccgaggcagacccggctctcccgactgttgcacaccatcccattctaaacattgtgggacaagggagaagcacactggggcatgtcagcaacccccatccggggtacaaccgaggtgcttaccactacgatttaccacccaactacacaccaccaaccatgcataaagacgcgggtcacgttactcccctcatcctcgaaggggagcctcctcggcatcctgacagggtccacgaggatcctcgagagggcgctcagggagacgtcaactcctactccccatttcccgtggaggggccagcgcccaacacattacctcaacccaacatcacgggagagccttga

SEQ ID NO: 24452 - DNA, 1161 bp, Glycine max
  Peptide Sequence Number=SeqID_116137
atgttgcggctgatatcctctctcgttttgcaggaatacaacaaaatgaaaccttgtaaggtttcctaccaaaacataaagcagaagatgaagttcggtaatcaagaattgccggtacttacaaatgagtttcactaccctggtagagaagctgcgaatgataaattcaattgtctcattgataatatttggaatattcccaaaaatacaaataataatgagcaatttgtttgttcagtaaaaaagggtatcatctgtgctctatacaatttttgcattgcagataaccaaggagttcctcttcttacaaaagcctctccttctggaaaaggctatacagcttttgtcctgttatcaggaccacataaaggagtttataccaatttcaaagacctttgccttgcaaaggaggatattcaaagcccaatctacaaaggtttctattcaagggaagaagcagaaaaagcccttgaattaaataccacagacattaacaaaataaaaaggtctcttgaaccagaaaacccaaccataatcataaacactggccaaaccaagaccagccaaaagacctacaaagacacagtcagcccaaatgccccaggctcaacaaatgacctaaacttagacaattttaagaaaatacaaagtttattgtttaaggtacacaataatcaaacccaaattccgggactatacataggagtacatgcttattttaaccaaaaatttgtatgtatcaataaaaccccatactgccaagacaaaactaattgtccttgcaaaataaaattcctctttaggaaggccaggctagacatggaccagtttaaatctttcggatatgaagacttagcaattactgcaaaaagtctattggactacggatgtttggaatcaatcctgattcctccatctgatagattcgaaggatttaatccctcaatcaatgaggccataaacttaatccagggcagaaatgatggactacattgccatcaagataactacctgcccgagcaacttcactgctcagaattatcccttgccatgttaatgaaactcttaccagaggatcatagagattatccctgcctattcaatgatgagtatgagagctgggatgtacaaggcaatacacataccagtacagccttatga

SEQ ID NO: 24453 - DNA, 828 bp, Glycine max
  Peptide Sequence Number=SeqID_116138
atggaaccagaatactgggacaagaatcctttcaaagcgaccgccaaagtattccccccaggattccattacaagccaatagccacaaacaaaacccgcaaattctacgaattcattctaatagatacgaactcagtatctattaaacacttcaaagaccccaaagatccaaatctaaatacccattccacaatccaaatcctaaaggttatgcagccacgacattatggctcaaacttaaaccaacccaaaaaaatttctgctccatttgaccccgcaggatataactattgggattacatcgacgcttggaccaacgtgttctggcatcaaaatagtaaattcaagcattcatggctaatttacttcaaaaataatactgtgtataattttccaaattggttcctccaatggtggaactacttcggaccaattccacaaatattctcagaagaagtccaacagggattccaacaattcaacaagctctataatagcaaggaatcacgtattccagcagatttaaaatacggaaaaactgaaaacagcaagcaatatccaccgttacagagacacgcctttgtaaaatggtggtcacaattcgatacttcaaaggctgctccagatcaagtcaataactggttccagagcaatcctgagttcctcaaacctgctgatcaagagacatctttgttcctgaatcagaagtcgcaactagcagcattcttagcaagctcaaaatctaaagagagtcttgctcagaatttcaaagaagttctccaactacttcacaggaagtggaagagaaccttccaagaaggaagctga

SEQ ID NO: 24454 - DNA, 125 bp, Glycine max
  Peptide Sequence Number=SeqID_116139
gtgtagttgattcagatgatgtggggtctatagatttgaggaaaaatcctcttcaagagggaggggatgatgcaatcctcccaaggagtggacccatcatcagagccatggctaggagactctag

SEQ ID NO: 24455 - DNA, 246 bp, Glycine max
  Peptide Sequence Number=SeqID_116140
atgtctatcaagacaaacacgatacaatacaaaccatttcataagaggtacaaagttggaagaaatgacaaccctcctaagcctagggctaacctggttgaaggagatgacattattattgcggtcatttctcagactttggggctacctaatacatttgtgctaataagagtatgtttacctcttacactcttgtgggggatagagaataacaagtttatcttggtgattcaagaactactctag

SEQ ID NO: 24456 - DNA, 180 bp, Glycine max
  Peptide Sequence Number=SeqID_116141
atgcttaatctgctaattgattacgagaatcaaattgcttctgagaagaagaaaggaactatcatggtagttggcaagagctccaagaagaaaggcaaagagaaaggtcactggaagagacattgcaagaagtatcttgattctttgaaaaacaagaaacaagggactatagataactag

SEQ ID NO: 24457 - DNA, 170 bp, Glycine max
  Peptide Sequence Number=SeqID_116142
atggtgctgatagcggctattgcagccgcattgacctccattatcttcttcatgctcatcatggcctccatcattgtcgtcatttgctctttcatggcctccatgtcggccttcatctactcttgcacctcctctacttcacccattactctagctctagcacgggtttg

SEQ ID NO: 24458 - DNA, 750 bp, Glycine max
  misc_feature (451)..(451): n is a, c, g, or t
  Peptide Sequence Number=SeqID_116143
atggtaagcatttgggacctagctagggtagaagtctccatggaaccaattgcctccctcgcccagtattatgatcagccgttgaggtgcttcatctttggggactcccagctatcaccaatggtggaagaatttgaagagatcctagggggaaggaaaccatacctcttctcagggttctacccctcattggccagaatttctaaaaaagtccaaatctcggcgcaggaattagaccgccaaaggcaagtcgaaaatggggtggtcggaataccgataaaatatttggaggtaaaagcaagaatcttggcagataaaggcgagtggaccccattcatcccccattctcacactgttgattttcgagggagtcctctttccaaatgtggatggccgacctatatgacaccttcgaccgaagatgtgaagaaagcaatgcaaggattgtttnctgtactccagctctctatgtggggctggtttcacacctttttttccaagaaggtaggcccgtctatccgctacaaggacagagagcttaggggaagcagtaatgggatcatcggcggctatcataagtggctgagagtccgaacacaaggattggattggctcccaaatctaaagactgtgagggacgatgaggttaaagcttcggaagaaagtgatgaggtacaagccctaaaggcaaagcttgaaagagcccgggtagtcgaagagaagttcaagtccatagccatcaaagtctga

SEQ ID NO: 24459 - DNA, 510 bp, Glycine max
  Peptide Sequence Number=SeqID_116144
atggctatgttggtacatgtatcttccattactttcattttgtgttggattccaacagtcagattattcatgactgggtcagtttggtcatcattccaattgtctctaattttttgtcctaatttaccggggagttttaagaataatttttcacctaaagatttatcgataaatcctcctgctatagaggcatacattagtaaaagagatggcatattgaaagttggttctatgggcagccttttccctttggattttatattatctccatgggctaagtccactaggtttgtgattcacgccgaggtttgcagtggagttagtggtgtgtttcgcgatggggttcatgccgaggttcgtaatgtatttcacagtgtggttcaatgggtttcacggtggggttcagtggtagcgatgggtttaacggtggaatttgaacattgtgcaacctcagtcctgacgaaagagtttgaggcttctttcactttatgtttttgggttttgatttag

SEQ ID NO: 24460 - DNA, 98 bp, Glycine max
  Peptide Sequence Number=SeqID_116145
atgaagaaactccaagctgagatgcttccgagacgtttccgtgagcaaatccgtgaagattttccgtcgttcttcctccgttcttcattcttcaaccg

SEQ ID NO: 24461 - DNA, 360 bp, Glycine max
  Peptide Sequence Number=SeqID_116146
ggccgagaggagaaggaaactttctgcaaagacagaacagttgcatccattcttgaggaagagagtcattcctccgacttattatcacctgattcaccatcatcaagggaatctgtcactcaattacctgaagccattaccatggtagaagagcatgaccagaggattacccttgaggattatgcaagtagttcagtaccacaattttttaccagtattgcacgtcctgaagtgcaagctaacaacatcaactatccacattccttaattcatttaatacagggggacttatttcaaggattacctaatgaagatgatggaatcttgcttgtggggcttctatggaggctggatctttga

SEQ ID NO: 24462 - DNA, 106 bp, Glycine max
  Peptide Sequence Number=SeqID_116147
atggcccagttggatcagcctgccgagtggcggcggtgtgcctgcggcctgatgtgcatcaccctgcgcctgcctaggcgtgcagtacttctcgatgaaggctcag

SEQ ID NO: 24463 - DNA, 868 bp, Glycine max
  Peptide Sequence Number=SeqID_116148
atgtcgcacaaaaataaatcaaaaggggttccgatcatgaaaaaaacctgggttttcgccgctgtggcggcgcttttctcatccgcttccgcctatgccgaaacgtccgtgacgataggcatgtcgggctggacgggttttgcgccgctgacgcttgccaaacaggccggcattttcgaaaagaacggcctgaaggtcgagatcaagaagataccgcaggccagccgccatctcgccctcgcatcaggtgatatccagtgcgccgccaccacggtggagacatggatcgcctggaatgccaatggtgtgaaatccacgcagattttccagatggacaaatcgcacggcgccgatggcattgcggtgcgcagcgatgtctcgaagatcacggatctcaagggcaagacggttgcagcgtctgcgccgggcacgtccccttatttcttccttgcctggattctcaaggagaatggtctgacgctcaaagacgtcaaagtcgtcaaccttgagccgggaccggccgcgcaggcattcgtcgccggccagaacgatgcggctatgacctatgagccctatctctccaccgtgcgcgccgcgcccgacaagggcaagattctcgcgacgacgctggattaccctgccgttatggatacgttcggctgcacgccggatttcctgaaggccaatccgcaggcggcgaaagccctggcggatagctatttccaggctctcgacctcatcaagtccgaccccgaaaagtcctatgagacgatgggagcggatgtgaagcaggcgggcgaggcctttgccgcttcggcaaagttcctcgaatggcaggacaaggccgccaaccagaagtttttcgagg

SEQ ID NO: 24464 - DNA, 138 bp, Glycine max
  Peptide Sequence Number=SeqID_116149
atggcagcccaagaacatgaaatggaacttcaacatctcaacaaaaatgaagagactgacaaaaggaaaagaagcatagccctcaaagcctcctcctcaatgcaagaagtgttggaccttgtggccttaataacttaa

SEQ ID NO: 24465 - DNA, 327 bp, Glycine max
  Peptide Sequence Number=SeqID_116150
atggtgggttacacaccttcaagttttacagatttggtcttcgccagcaaaaagatcgaagtgggtctgaaaaaaaaaaaaggcaaatttgatcatcctactaggacgactgagaaaactggggcaaataaagagggtgaggatgagggagaaacccatgctgtgactgccattcctgtacggccaaatttcccacaacccaacaatatctttactcagccaataacaaactttctccttacccaccccccagtatccacaaaggccatccctaaatctaccacaaagtctgtctaccgcacttccaatgacgaacaccacctttag

SEQ ID NO: 24466 - DNA, 396 bp, Glycine max
  Peptide Sequence Number=SeqID_116151
atggttatgggggatcccatcagcagactctcctttccctgttggaatatttgtctctttgctaaagcatgtttgcattttagtggagaaaacaccgagactttttcaagtctcacaagttatccagaactacgtaggtctgagttcctcattggaggatacgtaggagcaagagcctcgcttttgtcgaccacaccgccttttgtcgccatgactcaagagctggtagcccgcggagacaccttacggttatccgcacctcgtcattcagtgaccccaagtgtgattcacgagcagagaccaatatggtcatctgcgccctttccggagatgtcagcattttccgatggagactttccaagtctcacaagttatccagaactacgtaaggtctga

SEQ ID NO: 24467 - DNA, 368 bp, Glycine max
  Peptide Sequence Number=SeqID_116152
gcacttcacaccttccttgcttggctgacacatctggtcaagtccttatcacagcagctgtgtctccggcaaaaccaccttcaaagcccgatccggaggtcgatgatccgctttatctgatgacattgaccatcccagagcttttcttgaggccttaccagtccattcagaggtctgggcaatcacaatttgagtttgaaagttacattaagacttggatgcagagttcaaaatgcgaggtctatcttggagcctacctaaatgggccagacaactaccttaagggaattattaacagtgctttaaaaggtcttgatgatgcttcacagcctaaatcaaaggctcctgctaggtggattgtcgtcaag

SEQ ID NO: 24468 - DNA, 171 bp, Glycine max
  Peptide Sequence Number=SeqID_116153
atggagaattggcgaacagcgctacgcaataacttcgcggggctccagactcgaaggtggaggacacaagaacagcggagaatggagaattggcgaacaagcgctaccaataacttcgcgcggctcctagactcgaaggtggtaggatacatgaacagcgctagggaatga

SEQ ID NO: 24469 - DNA, 573 bp, Glycine max
  Peptide Sequence Number=SeqID_116154
gatctaacggtttctatccgaggggctaggagggcgagggcaaggccagctgagcttccttccacatctgcaactcctactccagcatccacttcagcagctccttctgtcccagctcagacagattctcagcgctttgaagccatgcttcagagcattcatcagggacaaattattttattgcaaagtttacaggtggtggtgcctccaggatccattccttcagttgagcagtttcgggagatggtagcctggcctgggacccaaccttttctctacggggaagatgaaggtcccacatcccaagtaccacagcatgtggaggatgagtcatctgaggccaccattccaaagccattcgttgtaggggaggaggtaggcgagacacaggtgagacaagtagttgctgctactcctgagagatctcttgaggccacttcagagtctcctgcaccagtagtggacctaccctcatctcagcataaagcagacccctccactcctatcctagagatacctgaggacccgaccacaccagtcctgactctagacacttctcctccaactactcca

SEQ ID NO: 24470 - DNA, 150 bp, Glycine max
  Peptide Sequence Number=SeqID_116155
atggcgccaaaaacttgttcgctttcgacaagtgcactggatcgcataagttgtataaaacgcctaatcctgatcaagcatcgtcctcagattcctcttgttggactaaactcaaccaggaccgcattaagacaaacatactacaactaa

SEQ ID NO: 24471 - DNA, 375 bp, Glycine max
  Peptide Sequence Number=SeqID_116156
atgaaaagagaaaaacatgcctcctatagtagtcatgactcttgcaagagtttaagtgaagaacttagcgactattatagagggcgtcatagttcacatactaaacatcactcccaaagaagagaaaaggatagaaggcctcaagaggttaacattagcctcccatatttccacggaaaagataatgttgaggcctacttagattgggaaatgaaggttgaacaactctttgcttgccatcatattagcgaagagagaaaagttccattggctacccttagctttcaagggagttctatgagggaattccagaaaggagtattggatgcatcccttaagaatttgagtcagaagcaaggggaaaaccatccttaa

SEQ ID NO: 24472 - DNA, 135 bp, Glycine max
  Peptide Sequence Number=SeqID_116157
gaaaaggaaggagaagcttgccacccagctcgcccaagggagctcagcttgcccaggcgagctaggttgcttcctctagaaggcaccgccttctggaaaacttccaggaaggcccaaatgggcctgattacctaa

SEQ ID NO: 24473 - DNA, 429 bp, Glycine max
  Peptide Sequence Number=SeqID_116158
atgggtgaagcagaggaggtgcaagagaagatgaaggccgaaaatggaggccataaaagagcaaatggccacaatgatgaaggccatgatgagcatgaagaagataatggaagccaatgcggttatagttgcccgctattagcgctgtcgctaagtacgaatgaccccatgatgtgcaaattcaaaacaagcactacttcctgccatatggcttgcctcccaaactatacaccacccaatgtggcgtacattcccaatgaggatacacatgaaattccccatcacaatctagccaacttcgagccttggctcgaatatgccaatgaagggcaagcagttggtggtataccccttgaaaacacttcggaaggccctcagtatcaccaccaaccacaaccctcatgttccacagcggttaaaccctcatga

SEQ ID NO: 24474 - DNA, 336 bp, Glycine max
  Peptide Sequence Number=SeqID_116159
atgatctcatcttccctattggttgggattggggtgttgaaggcatacgtacctttttcaaggtgtgatgattggagatgccacttcaaaaataaagaaatacatgataaattaagtgtggcaaagccttcagtagctagttaccttaggcaagagatacaaccagagcaagaagctgatagagtgcatggattacctgcgcagcctccggtgaagttcaacaatatggtggttatatcactatcaatgaaactcaaggaagagcactgttctataggttttttgaggccactcacaaaccagaacaaaaacccgctcacttatggctcaatggag

SEQ ID NO: 24475 - DNA, 507 bp, Glycine max
  Peptide Sequence Number=SeqID_116160
atgccaatctccccctgcagatgtatcggttgggatcgcgcccacaagtcgcccagtggacccggagaagtccaacagggccctggggtttccagctctgggatcgcgcctgcaagacacccagtggacccgaagaagtccaacagggtcttggagttgtcaagctctaattacgggtctctgtcggttctacggagtacctgtcacctccaacaaaggcatcaggcccttactaatcgagctttcatcaagaaagtactgcttctccaggcaggcgcagggcgaaacaccacagtagcctggggatggtcggtagcgggcaatagacacaccgccaccacctctagagttaacctcagctcatccgcaaaaaggttagagcgttgcctacgacacatggccgaccagcaggcgaccaaatccaaagccaaaggtaagcaaagtactaggtccgtgacctacaagccatcatgcgtccagctaaagacgttaaagaagcgctactag

SEQ ID NO: 24476 - DNA, 252 bp, Glycine max
  Peptide Sequence Number=SeqID_116161
atgaaaggcctttttgttacaaaacttgaaagcaatgaagtgcttcttagtccaatagctcttaaggtggttggccccttgcttctggactcaaattcttcaagggatggcaccaatcatccttccaattccctatatggcaacccacaagaaggaaacaaagagacagcaataaccaaagaccaaaaaaatggaatgaaagctaaaccaatggagtttaacagacaatttttcaggattattcaacattaa

SEQ ID NO: 24477 - DNA, 261 bp, Glycine max
  Peptide Sequence Number=SeqID_116162
atgaaattaccaatgtgtagaagcaagcttcatgatgaatcaaaattgattcaaagaagttttgatgataacaaaggtgatgacaaaaagctcaaagaatcaaagaatgagttcaagatgttcaagattgaatcaagaacatttcaaggttcaagaggaaatttgatttcaagaatcaagaatcaagattcaaggttcaagcttccaagaataagaatcaatattcaagactcaagattcaagaatcaagagaagaattaa

SEQ ID NO: 24478 - DNA, 214 bp, Glycine max
  Peptide Sequence Number=SeqID_116163
atggcacatcagcgatcatgccattctgcgcgacagagttcattagcccacaaagaaaagcttggtaacagtctgaaaacctgggaagaagttgatgaaaagtttctgaagaaatatttcccggagtcaaagactgcggaagggaaagctgcaatctcttcatttcatcaattccctgacaagtccttaagtgaagcgttggagaggtttagag

SEQ ID NO: 24479 - DNA, 207 bp, Glycine max
  Peptide Sequence Number=SeqID_116164
atgaagatgctcttgataccacatgatgtaagctccattggagcttcggaatggagaaggaagagagagaggagacgccacttcaaggagaagatgagtctagaagaagctcaccaccataggaggccatggataagagcttggaggaagaaggagatgaatgaagggagagcgagagaagagcacgaaattttgtgctccaaatga

SEQ ID NO: 24480 - DNA, 417 bp, Glycine max
  Peptide Sequence Number=SeqID_116165
atggttaggtggatggctatggagaatctcatgctagaaggcactggaacacaatactctgataggattacatatatgtgtggggtagaggatgccacatttagtggtatcagagcagttcgaacctttcggacagtgtgttatgtgcttaccatattttggaaagctggagttgctgcacatgatgtccaacgttatgtcaaggaatcagattgggctgcacaatgcacaaggcaagataaaatgtcaaatgaagaattgaagctgcaggatccacgatgtcggatacaatgtccaggacatcctgcccgaaaatactggacacataaatctgttatatctttaacagattgtgcaggatccacgatgtcggatacaatgtccaggacatcctgcccgaaaatactggacacataa

SEQ ID NO: 24481 - DNA, 58 bp, Glycine max
  Peptide Sequence Number=SeqID_116166
atgacattatggggctcgaataaagtggtttgtcatcatgcaaaaggggaccgaaccg

SEQ ID NO: 24482 - DNA, 628 bp, Glycine max
  Peptide Sequence Number=SeqID_116167
atgaccgcccatgtcgataccacagcaagccaggaaagcgatctccttcagttgcatcacgcattgcaggctcatcttgaacatttattgcctgccgggcagcaggccgatcgcgttcgggccgccatgcgtgccggcacgctggcaccgggcaaacgtattcgtccgctcttgctgctgctggcagcacgcgatatgggctgtgacgtggcgcagcagggtatccttgatcttgcctgtgcggtcgaaatggtgcacgccgcctcactgatccttgacgacattccgtcaatggataacgcccggatgcgacgtggacgcccggcaatccattgtgaatatggggaaaacgtggctatcctggcggcggtcgcgctactcagccgcgcctttgaggtgattgcactcgcgccgggtctgccggcaacgcacaaagccgaagccatcgccgagctctcctctgccgtgggcctgcagggactggttcagggtcaattccaggatctgcatgacggcgcacacagccgcagtccggaagccatcaccctgaccaacgaactgaaaaccagcgtcctgtttcgcgccacgctgcagatggcggcgatttgcggccgatgcgtcagtgcag

SEQ ID NO: 24483 - DNA, 868 bp, Glycine max
  Peptide Sequence Number=SeqID_116168
atggcagagccatcgaagaagagaaagggatcatcttccactgccgctactgctgcccatcaccgccacggaccatctgaagcatccacagcacctattcatccatctttatcatctccaagatcatccacattgttttcttccgatgatcagcgtctacagtacctctctcaattttcttctaggatcatattagatcctaagtacctagatgtagagttctttaatgatgaaacgtttgattgctatcaagtgtttcaaaattctggccttgttgatttcatgtcattaaaactgccacattatcctgaacttgtaaaggtcttctactgcaatttgaaaattcaggatggcattatttcctctgaggtgcatggtattcctatgatcattgatcagtccttattcttttctttaactcatttacccagtcaaggtgcaccttttgagggcaccattgttgataactggaaatttgattattctagtcatgatgctcgccgtatggtctgtaatgaccaggctgaaatgaccggtagattgctggccggttcattaacttttgataatcgcatcatgcattatatcattgttagaattttgcttccctggtcttcaaatttagcacaagcctctgaggaggatttgattctgatgtgggcttttctcaccggtcgtcagatcgactgggcccatttggttcggtaccgaatgcataaggcattacgggccaatgcacctctaccttacccacaattgataactttgtttctgcgtcattttcaaattccgcttgatgatgagccatttgttcaagtcaagcgttcctttgcaattggtgctggtgttgtgacttcctttggttacc

SEQ ID NO: 24484 - DNA, 738 bp, Glycine max
  Peptide Sequence Number=SeqID_116169
atgggagaaatagaggaggtgcgagagcggatgaaggccgacatgcaggccctgaaagtgcaaatagccacaatgatgaaggtcatgaatagcatgaagaagatagtggaagtcaatacgactgtcgttgctgaggtggagccgactcccccatttggccttaaccaaataaatcattcaaccttagatatggtaggtcagggaggcaatgagttaggaagtatggacaacccccatgttgtgcaaattcagaacaagcataccttcctgccatatggcttgcctcccaactatacaccacccaatgtggcacacattcccgatgagaataactccactcccatatccattgagagccaacaaccacaatttgatcatgcacatgtatctcaacccatgggggagacacatgaagtaccccaccacaatctagccgacttcgagcctttcctcagatatgccactgaggggccagcagttggtgatgtacccctaccaaacactttggagggccctcaatttttcccacaaccacaatccttgcattttgcggtgggaagagtccctcctaccatggtggaaagggagaaattggatcacctagaggaaaggttcagggccattgcaggaggtggaaattatgcctttgctaacctagaagagttgttcctagtacccaacatcgtcatccctcccaagttcaaggtgtcataccctaatttcatccagggaccatcc

SEQ ID NO: 24485 - DNA, 246 bp, Glycine max
  Peptide Sequence Number=SeqID_116170
atggctaaagagttgctacaaggtgtcgcaacctacccttcggtgggagggcaacgcgagactcacggtcaaatcttgttgatttcaaatgctggggtggaggttgcacagcagctcgcctgggcgagctgtttgcttcctcctgaaatgaatggcagcggaatggagaaggaagagagacagaggagacgccacttcaaggagaagatgagtctagaagaagctcaccaccataggaggctatga

SEQ ID NO: 24486 - DNA, 715 bp, Glycine max
  Peptide Sequence Number=SeqID_116171
ttggttcccccgatggaaggaaggaaaagaaggagtccttttctcatgtggaagatacccaaacattccgctggtaggaacgaggggttgtattaactacaatcccgcgctcgctataagacaactagggtaccccatgaggggagcaccgacggaagaaagcatgtctcctttccttgtgagggatttcggcgcacaaaattccaagactatacaaagaatccataaggcgtgggaaaccccgttaaagaaagatcaagagcttagaggcattcgtaatggcatcattggtgggtaccacgaatggctgaaagttcatatacgaggtttagattggctcgccaagttaaaagtcgtcagcaaagagagttttgaagcaccggaagaggacgaagaagtccaagctctcaaaagcaagttaggaaaggcaaaacttgccaaggagaagttcaagttggccgctacacacgttcggaaggagtgtgccggaccaagaggggctcgcaaggaagagtatggccggaacaaatttcgcggagctctatggggtagcaatagtgaactcaagttgcaaagggaagaaagagaccagtcgcgagcacatagcatggttctgaaagaggagttaattgcttgttcgaggtccaaaagaagcttgtctcagcgtttatgcgagacggagaccaacatgctagctatcatcgctaagtactaa

SEQ ID NO: 24487 - DNA, 468 bp, Glycine max
  Peptide Sequence Number=SeqID_116172
atgaggttttatcaagtcatggtcaagagcctaaggaccaccagtctaaaggagttagggcagttaatgggtcagctccagtggcaagcttttcacaaagcttacggtaaaatctgggacttagccatggtagaagtctccacagaggccattgcctccctcgctcagtattatgatcagctgatgaggtgcttcacctttggggacttccagctatcacctatggtagaagaatttgaagagatcctaggatgccctctagggggaaggaaaccctacctcttctcggggttttatccctcattagctagaatttccaagatagaccaaatctcggcgcaggaattagaccacaggaagcaagccgaaaatgggttggttggaataccgagaaaatatttggaggcaaaagcaagaatcttgcgatcaatgcttttctcgcctatcataaccacaaggaaagcctga

SEQ ID NO: 24488 - DNA, 327 bp, Glycine max
  Peptide Sequence Number=SeqID_116173
atgcccccctatgccaaatttttgaaggatatgttaaccaagaagaactggtatatccatagtgacagaattgttgtggaaggcaaagctctcatagacttgggagctagtatcaatttaatgcctctttccatgtattggggacttcgagagatagagataatgcctacacgcaagagtttaagtgaagaacttaacggctattatagagggcgccatagttcacatactaaacatcactcccaaagaagagaaaaggatagaaggcctcaagaggttaacattagcctcccatatttccatggaaaagataatgttgaggcctaa

SEQ ID NO: 24489 - DNA, 525 bp, Glycine max
  Peptide Sequence Number=SeqID_116174
atgggtgaagcagaggaggtgcaagagaagatgaaggccgaaatggaggccatgaaagagcaaatggccacaatgatggaggccatgatgagcatgaagaagataatggaagccaatgcggttatagttgccgctactagcgctgtcgctaaggtgaacccgatgctcccatctggcctcaagcaaatgaatcatccaacctcaaatatggcacatgaaattccccaccacaatctagccgacttcgagccttgcctcggatataccactgaagggcaagcagttggtggtataccactgcaaaacactttggagggccctcagtgtcacccacaaccacaaccctcacattccacagcggttaaaaaccctcatgctatggcagaaatgggaaagaggaaaggctcagggccattgaaggaggtgctggactttgacaagtacaaggggactacttgccccaagaaccatccaaagatgtattgtcggaagataagggcatacgcaaagatgaggaactgctaa

SEQ ID NO: 24490 - DNA, 375 bp, Glycine max
  Peptide Sequence Number=SeqID_116175
atgacgttaaaggagtatcttgaggcttttcatctctggctggtaatcgattaccagaggcttccatcaactcccagttccctttttaagcctggtaatcgattacaccccttggtaatcgattaccagaggcttcctgacctcgttttcaagcctggtaatcgattacaccccgtggagctcgcctgcttaggtacatcacaggttctcactgaccgactatgcccgggttgggtcgggattggtcaagcttggttttgggcaatagcaccccacctgacgtccccaaggtctcctgacccccgcgacatatctccaggtggcggtcgggcgatggtgcacaacaagtttttcacatccacaaagcgcgcataa

SEQ ID NO: 24491 - DNA, 243 bp, Glycine max
  Peptide Sequence Number=SeqID_116176
atgaaccctaagagaataaaggtcattcctgagtggctcactccaccaagtgttgagggaaggagcccagagtatgaagaacctcgggatttgaggtcaaatcctttccaaggtggagggaatgatgcaatcctaccccgcaaggcattgggtagaagactccaagtagactgggctagagatccaagggaaggccctagggttctcatgagccttagggtagatttcgagcccatgggctaa

SEQ ID NO: 24492 - DNA, 327 bp, Glycine max
  Peptide Sequence Number=SeqID_116177
atgagtggaagtgggtctaattcaagcggtggagatacaattacgagtggctcttcttcagttgctagaagtaaatacaaaaatgcccctgggaataagactgatattgggtgggaacatgggattgatgttgacggcaatgttaagaaagtcaaatgcaagtattgttcaaagattgcgagtggtggagttttcagattcaagcgtcatcttgttgggactagaaaagattctgagccttatgctacggtgaacaaaggggtttttgttcaaaaggaaaaaaaggtagtgcaagtaatgggagtggcagtgttcaagcaactttga

SEQ ID NO: 24493 - DNA, 219 bp, Glycine max
  Peptide Sequence Number=SeqID_116178
atgacccaagagctggaagcccgcggagacaccttacggttatccgcacctcgtcattcagtgaccccaagtgtgattgacgagcagaggccaatgtggtcattttgcgccctttccgagatgtctgagttcctcattggaggatacgtaggaggaagagcctcgcttttgtcggccaccctcacaagttctgtcatgcttggcactggagtcacgtga

SEQ ID NO: 24494 - DNA, 306 bp, Glycine max
  Peptide Sequence Number=SeqID_116179
atggcgaggaaaagcccggtcgtcgccattttggccatgtatgacacgttcgaccggggatgtgaaaagagcggcgcaagaattgtttgttgtgcactgggctctctatgtgtggctggtttcacacccttttctccaagaagaaaggacagagagcttaggggaagcagtaatgggatcatcggcggctatcataagtggctgagagtccggacacaaggattggattggctcccaaatctaaagactgtgagagacgatgaggttaaagcttcggaagaaagtgatgaggtacaagccctatag

SEQ ID NO: 24495 - DNA, 201 bp, Glycine max
  Peptide Sequence Number=SeqID_116180
atgggtgtaagcctcgctgctcggaaacacccagtgctgaccacactgagagacacgaaagcgcagatcccgcatccaaccaagtctttgaccagggaacgggagaattcccactaccgctggaaggccagccgggccgtgagcgcggtgggaacgggcttcccaaaaagccagccccgggccggggtcggcatagaatga

SEQ ID NO: 24496 - DNA, 141 bp, Glycine max
  Peptide Sequence Number=SeqID_116181
gggccttgtgcagtaaaccccctacgggcggtcgtccgtcgtaaagtagtccccgcgaagctttcgggaagaggggacctcgacccgcctactcgggtcttgtatggatatgcaggaaggggtgctcctaggtgtgtgtag

SEQ ID NO: 24497 - DNA, 228 bp, Glycine max
  Peptide Sequence Number=SeqID_116182
atgtctataaatgaaaaaggctttatatggcttgaacaagccctagggcttgaatcttcagaaaaaattcatattcatggacaagattctaaaggaaaagggaaaggaagcaatgaagatcctcaagaaaagcaaaatcaaatgatgaacttccagaagaatggaaagcctcaaaagatcatccactctagcattattgcaaagatatctcacaaaggggaaaactaa

SEQ ID NO: 24498 - DNA, 720 bp, Glycine max
  Peptide Sequence Number=SeqID_116183
atggcgaacttttggttcgagcaattgcaagatgttgttcccaatcatttaactggcattgcccctgagtctgtggttgccccggatgaggttgagcaggtcaaaggccgtgccgtggtggtgaaaaagctcaaagcgttgccgcttgaggcgattgtacgtggctatcttgtcggtagtggctggaaagagtacacggccaaaggcacggtctgtgatattccattgccagccggactgcaattggcgcaacaattacccaaaccgttatttacgccttcaagcaaagcagccgttggtgagcatgacgagaatatcagcgtcgcccaagtggaggcgctaataggcaaagacctgacgacgcaagtcgaaaaagccgcgattgccttgtatacgcgcgctgccgaatatgcgcgtaccaagggcattatcattgccgataccaagtttgaatttggtgtcgatgatcagggcgtgttacatgtgatggatgaggtgctgactccggattcttcacggttctggcctgcagaccaataccagattggcagtaacccgccgagctatgataaacaatatgtacgtgactggctggaaagttgtggttggaacaagacaccacctggccctgagttgccagcggatgtggcgcaacgcacatctgacaaatacatggaagcgtttgcgaagctgaccggccgtaccttgctggcagagtaa

SEQ ID NO: 24499 - DNA, 195 bp, Glycine max
  Peptide Sequence Number=SeqID_116184
atgaattcaaaaagaaaaggggagaaagagatgagtgaacggattgtcatcatcaaaaagggggagattgtggaagcaatgacttccaagattattttgatgatgccaaagaatcaagagctaagcaagtttcaaataatcaggagtcaaaaagcttcaagaatcaagtttcaaagaatcaagattcaagaataa

SEQ ID NO: 24500 - DNA, 433 bp, Glycine max
  Peptide Sequence Number=SeqID_116185
ggccagacaacgttcggtggagtggcccggggttttcccatggtatgcgcaggttgcgtcagggtcataccactttgggaaaggaggctgttggcctcgggggaaagttccttatcgcttggaaccggcgccaaagtgggcattgccggccgggcgagtcggggttggagccggaacttggggggcctccctctggatgggcgtgggcgccctagcttgtatgggtgctgagttaggagagtccccggcacgagctgagaagctcggttgctccgatcctcctagtgttggtacttgtggaggagacataattgaacttccttctcttcaaacctacttcaattctttccctggcgaataccaagtccgcgaagctggaaggcatgggccacttgtgctgccaggtccctccaccgctgagcgtactctttaa

SEQ ID NO: 24501 - DNA, 213 bp, Glycine max
  Peptide Sequence Number=SeqID_116186
atggcaagatgtggtagggatcagaaccgtgatgtccttgaccgcatcacagctgtcctggaaactctggtggaggaacgtgatgtggagccggcggagtatcagggactcatggcttttcccctgagaacggagaaaatttttgaggcgatgggttgccttgaggagcataaaggtcctctatgcgacattatgctccaagggggaggctga

SEQ ID NO: 24502 - DNA, 1047 bp, Glycine max
  Peptide Sequence Number=SeqID_116187
atggcagaatcatccaagaagcgcaaggtttcatccacctccactgcggcacatagaacatcacgtcccggagccaccggagcatcccaggcaccaattccaccatccttgtcatcctctacactgttttcatcttatgaacagcgtatccggaactcctctatctttcaatctcatcaaattcttgatcccaaatatctagacctagaattctttgatggagaaacatttgattgctatcaagtgtttcaaaacactggtttgattccttttatgtcattaaaattaccatatccagagctagtacgagtcttttactcaaatttgaaaattcaggatggaactttaatttttgaggtgcatggtatccctatgattattgatgagtctcttttcttttctctgacacaactacctagtcagggtgcaccttttgagggtacccttgttgaccaatggaagtttgattactccagccatgatgctcgccgcatggtctgcattgaccaagcggatatggccaacagactgcttgtcgggtcattgacatttgattgtcgcatcatgcactatatcattgttagaattttgatgccttgttcttctaatcttgctcaagcctctgaggaggacttgattctgatgtgggatttcttgaccggtcatccaatcgaatgggcccatttgattcattactgcatgcataaggcattacggtctagtgcacctctaccttaccctcagcttccttttgtgcaagttaaacgttcctttgctattggtgccggtgcagtaacctcctttggctaccgaaaggacatggatgggcaatggttgaagaaggacgccaaacctccgcaagacgaatgtactccttctcctccgcctcaacgagatgactcctcaaccctcatgttctttcggagttacgaggcctccacacctatgttggtgaacgctttgattccttggatggtcgtatatatgccattgatgctcgctttgaaggaatggatacccgcatcactcagcttgaggaggatgtga

SEQ ID NO: 24503 - DNA, 303 bp, Glycine max
  Peptide Sequence Number=SeqID_116188
atgggaggctctcatgaggatacttctgcggtggcgtcaactgtgctctttgtttcgggaatgactacacgttgcatacaagttttgggtcgagaaattcaaacatataatgaaggagctgcaggggactataattattggatcgacttttcaaacttttcttggatattcgggacttatgtcactgttagtaaggtcgatcaatcctgtggttgtatcccaactattgctgcagtaggactttcattttacagctatggttttccactagttggtacatgtctagagattggtgcagtgtag

SEQ ID NO: 24504 - DNA, 189 bp, Glycine max
  Peptide Sequence Number=SeqID_116189
atgtcttcacatgaagaaaacgcgtgcactagccaccaatgtttattcaaggaaaatgctagaaaaaccaaaacgaggtctgcgaattttgaaaataaaggttcgggagttgtttacgcatggggaaggttcattttagttgcgaacaaagagccgtttaaggcgttggaccttgaaacgatgttttaa

SEQ ID NO: 24505 - DNA, 441 bp, Glycine max
  Peptide Sequence Number=SeqID_116190
cgaatcgaacctgccccgactttgactgagaaaaaccacgttgatcaggctcagggccagattcaggttttcctcgataatccaaaacggaggcagggtcctcactctacctacctctctcacatattcactggtttaggatttggagttgccaatttggagttaccgatcctctactttgatctcctctccaatctcaattccgccatcaacgaggacaccaagatagaaagggtagatagaatcttgatgattttttgggtgaattatccatcaggatcaatgattgtgaagagtcttgatgcttctacacacataaaagacaaggaaggttctatgagctatgaagttgttgttgaatgttctagtgtaatgaatgaaatggtttcagatgatgaaggtgaaatgatgggtgctggtgtcactaatttggaggaatga

SEQ ID NO: 24506 - DNA, 531 bp, Glycine max
  Peptide Sequence Number=SeqID_116191
atgtctttcattctatggcttgctaaaaggaattggttgcttactcttgacaaagctgcttttttgaacaaaggaaatctctccaagtttgggctcacattcgtgatttggctcctttccgcaggccttcttgtattagggaggcttttgattttctttagctgcgggcgcctcatgtccattgaatcttcatctccagttttagccagccatggatgtttgcgtaaaagaagtgttggagacttcgattgtcatcgagaggaggccaagaacaacgtcatgttggcgccccttttgggttcggttattgaacttagcgattccgacacgaatgaagacgagggccatgatttggatagtgcagtcacctatgcagtgaacagtgcttcttctttggtagagagtccgtctaagaagcgaaggacgagtgaggctagaggagtggtttttccagttggattcgtcacccctcttccttcggcgctgacacctcctcccactttggtgttgtccttgctggcgatggaatag

SEQ ID NO: 24507 - DNA, 747 bp, Glycine max
  Peptide Sequence Number=SeqID_116192
atgactcattcgtatgagtcacttcctttctctatagcacttatgcttcgtcttcttcctttggttgttcctctgcttcttctttcttcttcctttttctttgctacttcccacgcacgttggtgcttgtttctcacgcacattgttgtttcctctctcgcgcaccgcttctacttcgtcttcttcgcttttgcttcatcttcttcgcttctgcttggtgaacgtcctgagctaaagctatcttcccatgcaaggaagatggctatgttcgggaggcctactccagagattgaaggccttatggctgccaatggactaaaggtgactatcaccttggatgacattgcgttgttgctacatctacctatcgtaggggcgttccacagcttcgagcaacttcatgtcgacgacgctgttgatatgttggtggaattactcgaggtcaacgttgcagatgcgagagctgagacgattcagtatcatggctcttatgttcgactatggtggatgcgagacgtgtatcagacgaagatcgaggcatgtcattggattgtagcagcgcgagcgtatttgttgcatctgattggatgcacactgtttgctaacaagagtgccacacacgtgcacgtggtattcttggatgcaccgtgtgacttgacgcagagtgtgacttatgcttggggcgctacatcacttgtgcacatgtatgataatttaaatgagacgtcgaagagcatgacgaggtag

SEQ ID NO: 24508 - DNA, 717 bp, Glycine max
  Peptide Sequence Number=SeqID_116193
atggatgcctctgggtttgccatgggtattgtcctattgcaaaaagggcacccactttcttattttagcagatattctcctcctcctccttcttctcacagcattaaacgtcgtcgtttccatgactccataattctccggaagcagaacaagaagcagcaacagcagcaacatgagttcacttccttccaacagcttcaccatcaccgacccctccatcccgggacaccccatcgtcttcgccaacccaagcttcctcaagctcacgggctactccctccgcgaagtcctgggctggcccgcagccatcttctcgggcccattaacatcccaaaaatttgtaccgcttcagaaaaaggaatgagggtccggagtaagggatttcgggttcgggtgctatcggaaggaagtgtgcgtggattcgttggcggagatgatcgcatttgttcattggagcaattgctcgaacctgatgttagagctttgtgggatgcagaattggagagagaagagtcgtgtgaggcgagtgatgatgagaagcgaagtgttgttactgccatggactgtatattttctgtgctaacccattacggtgaggccacagggagattggattataagcagcagaggccatcaaaagagcttgttgccaaagacctgcatggtgtggagtggaaatttcatcacatttacagaggttttacctactatgtatag

SEQ ID NO: 24509 - DNA, 715 bp, Glycine max
  Peptide Sequence Number=SeqID_116194
atggggtgcaaactagcccttgaagacaaaacaagagtcgcatttaggaggaggcagaggcatgaacatgttgatgcatcaaggcatgccaaaccttgcaattgttcaagtttggcctctcagcaacaaaaagctaccatgcagaatctgtcatcaagcactgaggttgggtttgtgaattccttggcttttgcaaaatcaggagaattcttagttgctggagttggacatgtgaaaattttctcaaactgtgtcctgcttaccgttgtcctcaaagttggtatgtcatgtcaagggtgtgctggagcagtaaacaggattttgggaaaaatggaagactcttcttctacttgcacttgggttctttccagttttaattccaacattctaactccaaccatcaactatggatgccacctccactcttccaacaccggcatcaccgacattgctttgctctcctccaggatcaagtcagaaaaagcattggcggagaaagttagattggtgctcaatgagtatccacaactcaggctaacccaagggagaaaagtgctagagatctgtctaaccattaaatgggacaatggcaaggctcttgaatttttgttagaatcattggggtacgagaattcgaatgatgtatttccaatctatattggtgatgatcgaactgatgaggatgcttttaggttaacaaatgctgccacgccta

SEQ ID NO: 24510 - DNA, 984 bp, Glycine max
  Peptide Sequence Number=SeqID_116195
atgacgagcaagaagaagaagaagaagcattgtcactctgcgatcttccaatcaacctcgaggacccaccgaggaaccaagaacactctcgtcccaacgaagcatcacaagaggaattcaatttccggtcgtggggtgcccccttctccaaagaacatgaaatgccaaatcctcccattgcgcgtctcgttcagctccgaggccgggttgttagccaccgtgtctcaatctcaacaacattatggtaagcaattcgttaggtccgaatccctggatcgcaattcaagcgatttccgaagcagtaataatagtagtagaagtagtagtctcagaagccagaactcatcaactagctctgtcactgccgccactgccaccacaaccacaacaatccctaaaagtaaacccagaattcgaaaccaatttcacacgcacccaagcccaaaaccccagttaagagcatcagcaccaacacacaaccaaggcagaaaatccacgtcagcatggggaattttccgtttgggtgtggtcgctgctcccgagatagggttacacgatctcaaggttcgaaaccggaactgcgttgtcagtcgaaatagtagtagcagtagcagtaacagcgcaaaaagtgtcaaaacaagtaacaggaacaacaagaagggcaatcataaagttttgaaacagttagttggcaaaggcggtggtctattgagtggttgtgattgttcctatgaaacagtgcaacccaacaacatggtcatgataaaaggtggtaacggtaacgctaaaagaacgaacatgacagaaagtacagcgcacgccgcgaaagaaaaagtggtcgagttgaagaagcatcataagcacaagcagcaaaagcagggaaagaaggttacgtcacgtcgtcgaacgtttgaatggataaaggagcttcatgcaagccatcctgatgatgatgatgaagaggctttgttatcaaacgcatga

SEQ ID NO: 24511 - DNA, 552 bp, Glycine max
  Peptide Sequence Number=SeqID_116196
atggggacaaatcaaactggcaaaaggttttatcaagtcgagattaagggcctagatatcaccagcattaaggagttggggcggttgatgggacctctccaaatgcaagccttccgcaaggcgtacggaaagatcttagatttgaccatagcagagacatccacagaagccattgcatcactcacccaatactatgaccagcccttgagatgcttcacgtttggagacttccaattagtaccgaccgttgaagaatttgaggagattctaggatgtcctcttgggggaaggaaaccgtatcttttctccgggtttcttccctccttgagcaaaattgcaattgtggtcagggattcggtgagaggattggaccgcgtgaagcaaactcgaaacggcatagtgggcctaccacggaagtacttagaaggcaaggcaagggatatgatgaatcaagaggagtgggtcccgtttatggatgtattagcattgctaatctttggggttgtcctctttccaaacgtggatggtttggtggacctagccgcaaattga

SEQ ID NO: 24512 - DNA, 273 bp, Glycine max
  Peptide Sequence Number=SeqID_116197
atgttacctcctcattctagcgtgggtaaaacccaatctaatgtatgggatcacttcacagaagagccagggcccaacttagaaaagaaagctagaagtaactattgtgaaggtttgatcaaatttgagaatggaacaactgctatgtggaatcatttagacagatgcaagaagagagtgggaaatatgagtaagaagcaaatatcaacttcatccatgaaaaatgcctcttttccttccttgccaaagaaactgtaccttcacaggacataa

SEQ ID NO: 24513 - DNA, 417 bp, Glycine max
  Peptide Sequence Number=SeqID_116198
atggaatgcggtagtgccaatgtcgtcacagatttgctccacgctaatgcagatgtgactgcaacggtggaatgcctcatgccactcgcaattagggttaggagcctccacacggtgaagcttctagaagccttcgactgcaaaatagacgaattggttcttcacaagattgttgacatcggagaaacgttgtcattgttcatggagcttcaaaccctaggtgacagaacgctcaagaagttggcgtttaatcatgttgttcatagtataagatgtatgaaccaaaagcataagaatgaagctaagaacaaagtttgtcaatcttttgcttttaatattatctatgatattttgcgtaaaaaggctaaagagctagccaagaaggcgctcgtgactctgtgtgagcttcacagttga

SEQ ID NO: 24514 - DNA, 441 bp, Glycine max
  Peptide Sequence Number=SeqID_116199
atggtgcttgaagaaggacgagttttggaagcggattctatggcccatagcattgtattagaggccagagagcccggttctataaccctgcatgccctctttctcagttactattcttctaaacgaggaaaatctcttgaccccgaagtgtaccctccccacacaggggaggtttatatatgtgggatgtcgaaggagaaagaagtttcggataatcgtgaggagataaagggaaaccctgaattaattgtgatgcttaaaaaggtggtgaagactgtttcaagccatcttagggaaggagtggcatggcataattgggataatattcttaatggtcctgccactggagttgttgctgagcttgttattgatggacattccaacattgttaatcttaagcgctttagtcccaccagattcctggggcgtagaaaggcttag

SEQ ID NO: 24515 - DNA, 267 bp, Glycine max
  Peptide Sequence Number=SeqID_116200
atgtttctaggctatctagaagaaattaagggatacgggttgtggttcctagaatcttgtcactggagatgtatcataagtcatgatgttgtcttcaatgaaactcacatggcttataaaactaattatgacttgattgccttttctctgatagttgcaagtgaggttctggaagatgaacctacaagtttcaaagctactttagctagtaaagagaatgacaaatggcaaactacaatggataaagagatgaagtctctgtattag

SEQ ID NO: 24516 - DNA, 402 bp, Glycine max
  Peptide Sequence Number=SeqID_116201
gatgtgcgtaaaaaggcacaggccatccagaaacagaacactgccccccacgttttgtctggcgggggttatgaatatttggagcagaagctcctggctgagaagacgaagaagaagctggaggaagctgcacagtcaggaagcgttgatggcgtcatcaaccctccatccctggtcagacgccacgtgaagtggaagatggcccacacgaagaaaataggggagatgacaactgaggccgcaaaggaaatcgctgagaagatcgattcctttgaggagcaggcgacacagggatccttcgtcccccatggacatcaggatgttctcaccgctgctattggatgtccaaagcaccctggacgtgtccgtgctactggagccagtgtcaccatcaagcaataa

SEQ ID NO: 24517 - DNA, 786 bp, Glycine max
  Peptide Sequence Number=SeqID_116202
atgcttccaaagttcatcattagcccctttagggtggaatcccaagaagggaagcatgtgaacaagagaagaaagcatgtgagatcatttgagagtaccaacatggatgttggtttgagacttctccctcaaattacaagctcaaataacacatcaaatgtcctcttgaaatctgcagtgagaaaggcaaaccaacaatccatccctcaagacttatgcttccttaaaacttgcaatctatgcaataagcaactcactccaaacaaagatatttacatgtacagcagagatcaaggtttctgcagtgtagagtgttggaacagacaaatagttttggatgagatgagagaattagagagctctaccaagaaaatggtagctgcttataggcaatgttctagtgaggcacgtagtccaacaacaacaaaatttgatgagcaaagtcaggaagaggagaaaatcaagagcagattccatggggaggaaaagaagttaagactaataattgaaaataatcacttttactccgataaacttggccaaattgaagaacagatgcagagaaggccccaaggggaggagaagagctcaggaaagttgataatcaatgatttcatgatggatcagatagtagttaatcagctgagtgagtttgaagaacagatgccaagcaccttccatagtgaaggcatcacaacacaaaaaattagtgtcaaccacatgataagtcccacaaaaggtgatcaaattgagccaggatcaagaagaggagataaactttattga

SEQ ID NO: 24518 - DNA, 672 bp, Glycine max
  Peptide Sequence Number=SeqID_116203
atgtctggtatagggaaaggagtgggaggaggagttgctgttaaggatccatctgctccccttggagttcgacttttgatcgaggactatccttatgcttctgatgggctagagatatgggatgctatcaagtcttgggtggaagaatatgtctcattctactacaagtcagatgaggaacttcaaaaagaccccgagctccaagcttggtggaaagaacttgtagaggtgggtcatggggatttgaaggataagccatggtggcaaaagatgcaaactcgtgaagagttgtatccatatggaggtttaatccttaataggccaactattagcaggagattcatgcctgagaaagggtttcctaaatatgatgtgttggctaagaaccctgagaatgagtttttgaagactattactggcaagaaagagacccacactgaccttacagttatagaaattttatcaaggcacgcatctgatgagttctaccttgggcagagagatggtggtgactactggacttctgatgccgggccattagaggcctttaagaggtttggaaagaatcttgaagagattgaaaagaagcttatagagaagaacaatgatgagacattgagaaactgctatgggccggctaaaatgccttacattttttctctatccttctag

SEQ ID NO: 24519 - DNA, 399 bp, Glycine max
  Peptide Sequence Number=SeqID_116204
atggctactccacctgcctcgcctcctcctcctcttcctcctcctcctgcagacgcatcagcaactccatctacgttgaagcggacacgcaaggtgacatggctacgatcattggctactagaccacctagggcagaaagacctgtggtcaacatcgatcctgctaccagcaaggccgacggtccccacaagaagaaattaagaacatatttggggattgtcgctcgtgataaggtcgacgtcacatatgacacctggaaggaagtccctactgctcaaaaggatttgatatgggaggatattcagaatttgaaatccctgaagcttctgacagtaggacaaagaagaaaattcttcaaattgtcgacgagcgctggaggcagtttagatctgacttga

SEQ ID NO: 24520 - DNA, 606 bp, Glycine max
  Peptide Sequence Number=SeqID_116205
atgtcgaactccccctatggaagtatcagttgggatcgcacccacaagacacccagtggacccgaaggagtccaacagggccctggggttttcagctctggttacgggcctctgccagtcctacagggtacccgtcccccccagcaagctcatgccatcggatcgtgcccacaagacacccaatggacccgaaggagtccaacagggccctggggtttccagctttggttacgggcctctgtcagtcctacagggtgtccgtcccccccagtaagggatcgcgcctgcaagacaccagtggacccggagaagtccaacagggtcctgaggtttccagctctgattatgggcctttgtcaattctacggagtgcccgtcgcccccaacaaggtcatcaggccccatattaaccaagctttcatcaagaagtattgcgcccccaggcaggcgcagggcgagacaccacagcagcctagggatggacggcagcgggcaatagatacaccgccaccacctccagagcccctcaactcatctacaaaggctggagcgttgcctacgacccatgaccgaccagcaggcgaccaattccaaagccaaaggtaa

SEQ ID NO: 24521 - DNA, 264 bp, Glycine max
  Peptide Sequence Number=SeqID_116206
atgacaattctaagaagatttgaccttcctttgcaatggaatgacatagtcctcaacactagcattggtgacaaatacattgttcaaccttggtaccaatttccttttattcctgctgggttggctatagggcctgcttctattggacctagggttggtcaaggcactactgtagggcaagctgtagaagggattgcacgacaaccggaggcagagggaaaaatacgagtattagcacttttatttgcaaatccttttgtttaa

SEQ ID NO: 24522 - DNA, 141 bp, Glycine max
  Peptide Sequence Number=SeqID_116207
atgaacgcccacttgccgttgttgaacgcagtgaacacgcatgaggcaaggcaaggtagtgtggtgagtggtggttgtggacaaagtgcgacccaaagggtggtggttgtggttatggatgaagttggacaaagaggatga

SEQ ID NO: 24523 - DNA, 537 bp, Glycine max
  Peptide Sequence Number=SeqID_116208
atgggcgcaaaaatgttcctatcacaatatgaccagacactactccttaagctgaataatccttcctatttctctttcttcttcacattgtctaaatggtgcgaccttgttataccaaccttattcgaccttgggcttgtgtccactgattaccatgtaggttctagtattggactcgacttagtcagaagcacaagtcaaggggtgttgctaggtgcacccagcaataatgctagcacttcttcttccttcgttggtgttccgtttgagccgttccaccgctattcggtgcctccattgccaaattcaaggaactgtccaccaccatcatgccatttccgccgtcgcgagccctggggagagaagataatcgtgattcagatgatgctccttaacggtgaaggcccacagcatccgcacgtagttgctgaggatgctcctcacgtggatgacgcaactgaagaggtcttccaacatcctgaagaagctggtgttgatgcccagggttttctaggcgggttgcgtgacacatcatga

SEQ ID NO: 24524 - DNA, 1188 bp, Glycine max
  Peptide Sequence Number=SeqID_116209
atggcttcgaaaaagctttccgcaaagagatctaggagggacgccgcagctgaagggaccaatgccgctcccgagtttgatagccaccgtttcaggagcgtcgagcaccaacaacgtttcaaggccatcaaaggatggtcgtttcatcgagagagacgcgtccagctcaaggacaatgagtacaccaactttcaggaggagatagctcgccgacattggatgtcgctggtcactcccatggctaagtttgacctagatatagtcctggagttttatgctaatgcttggcccacagaagagggagtgtgggacatgcggtcatgggtgaggggtcagtggattccctttgacgcagatgccctcagccagttcctgggtgacctgctagtgatggaggaaagccagaagtgcgagtttagtcagagaaggaacagggccgatggattcgacgaggaggccattgcccagctgttatgcacaccgggtcaggatttttcccggaccgctacagggaggcgggtgcggatcatgcgcaccagcatgaccaccttgacccgaatgtggatgatattgctgcttagcaatgtcttgcctagtgatcataactccgaccttcctctaccgaagtgtcagctggtgtatgccatcctgacacggatgaacgtccatgtggctcagttgattgctgacgccatctatttatttgtagcattgatcaggggcctctgccagtcattcggggttcccatcacacctagtaaggtgatccgaccgccgatcatccaggccttcattgagaagtattgcacgcccaggcaggcgcagggtgatgcaccacaagccgcagacgcaccgccaccacctcatcaggctgatcctgttgggtcgttaggcatggagcagtatctacaacacttggttcgccaacaggcagccaaccaccggggacaggtgcggatacacgagtgtctctaccagcttagcctcagtcagcagggccagggtttcgctccttttgcatgccctactccagatcagtttagggctgaggtcgcatggcccggagattggcccgaggcccaggcgaaggaggcgcctgcaggagctcccggcgatgcagaggaggcctgcatggatgaggagatgacaaacttgcttggcttcttgggaggaagcggagccacgtga

SEQ ID NO: 24525 - DNA, 546 bp, Glycine max
  Peptide Sequence Number=SeqID_116210
atgaaaagaactttttatctagagctagtcaaggttttctgcacccgtgcacgtgttaaccttgaaggtgacctcttctttactgtaaatggagtagaaatggtcattgatgttgttatgtggaaggaagtagctggtctggacatgggtggagtttgcaagttcaatgaaacgcctgataggtacaacaagatgcagacctataagggaatacttcttgaccttgctaggaacttgaggaattgcgtaggagttggtggactgattgaagaggacaaaatattagtttatctcattacctacattctcactttgaggtcaagtaatcatgctcagagtcatcgcctagtggattatgaatttccttatgatgtacttgcctcaagattcattgactacttcaatgttgatgtctctaatgatattgtgtactttaccaaaacttctagtgagattaccaaaaggcatctcaagaagcttgaaatgaggtttgttaatcatgaatggataatggctgaagaaccagaagctagaaacattgaatag

SEQ ID NO: 24526 - DNA, 1060 bp, Glycine max
  Peptide Sequence Number=SeqID_116211
ggatcatcctccaccaccgctgctgctgcccatcgccgccgcggaccatctgaagcacctacagcaccaatccatccttccttatcatctccaagatcatctactctattttctttagatgatcaacgtctacggtacctttctcaattttcttctaggatcattctagaccctaagtacctagacatagatttctttgatgatgagacatttgactgttatcaagtgtttcaaaactctagattgattgatttcatgtctttaaaatttccttactatcttgaacttgttaaagtcttttatagcaatttaaaaattcaggatggtattatttcttctaaggtgcatggtatttctatgatcattgatcaatctttgttcttttcattgactaaattacccagtcaaggtgcaccttttgatggcaccattgttgatgactggaaattcgattattctagtcatgatgctcgccgtatggtttgtaatgaccaggctgaaatgactggtagattgctggccagatcattgacctttgattatcgcattatgcactacattattgttagaattttgcttccccggtcttcaaatttggctcaagcctctaaggaggacttgattttgatgtgggatttccttaccggtcatcagatcgattgggctcacttggttcggtaccgaatgcataaggcattacgggccaatgcacctcttccatatcctcaattggtcaccctctttctccgtcattttcaatttcctcttgatgatgaaccttttgttcaagtcaagcgttcctttgctataggtgctggtgctgtcacttcatttggttaccgtaaggatcgcaatggtcaatggttgaagaaagatgcactccctacacaagacgaacgtactccttctcctcctcctcagcgagatgattcagcccttatgactaaagttctttcagaattacggggtcttcgcacttatgtaggtgaacgatttgattctttggatggtccctttgcaagaatggatatccgtctcacgcagtttgaagaggatgtgg

SEQ ID NO: 24527 - DNA, 219 bp, Glycine max
  Peptide Sequence Number=SeqID_116212
atggcctcatcaaattttttatttcccgaagagaactctataaataggcctcctatattcaatgttgtgggttatcattactggaaaacccgaatgcaaattttcatagaggctatagatttaaacatctgggaagccatagaaattagtccttacatccctactatggtagcaggaaatgcaactatagaaaaacctagggaacaatgggatgaatag

SEQ ID NO: 24528 - DNA, 207 bp, Glycine max
  Peptide Sequence Number=SeqID_116213
atggatgacatcaaaaaggcttataggtcaatggctcttcaataccaccatgatgtgtgccatgatccttccatgaaggaggactcaacgaggatatgggaaagtaggtttcatgagcaagtgattgagttgaagacgaggtctcatagacatatgggacaaaaggatggatcatcgggtagtaaaatgagagcacaaaaacattag

SEQ ID NO: 24529 - DNA, 273 bp, Glycine max
  Peptide Sequence Number=SeqID_116214
atgtatcgccattggcagcagcggcatgaaggtggtatcgccattggcatcagtgactggcgagacatgctgagtcacctcatgtcaccattggtactggcgggacatgctaacgtgggcagtcctgtcattggcgcctgcggaacacgtaggggatgcttttttgcagtgtttcagtctgaaaaaagatgggtaggcttgcagggggttgcagtgtatagtctgaaaaagataggcttagggtttgcagaaaacgttgcatgtgaacgttaa

SEQ ID NO: 24530 - DNA, 183 bp, Glycine max
  Peptide Sequence Number=SeqID_116215
atgtgtggtgctagatcgcaaacgaccaagggcatttggatagccaagtgtgctgggattgagccaagcacaattgctatggatttagagggcactcatggaagagagagaggcgagtttggtgatttgttagtcattttagcctcctttagagcatctaataagaaagacctgatagtgtaa

SEQ ID NO: 24531 - DNA, 327 bp, Glycine max
  Peptide Sequence Number=SeqID_116216
atgagatctctgatgagatatagtgggtttgcaggtattaaacaacttgattccactattgaagatgctataagtggaggaaaatctgggagtatgaattcacagaacaatggaactcatcagtcctcacaatggacaagtagtacacacttagtgcgaagagtgaaagaacaagctgaacattgggcaattgaagtgacgctgaagaactataatcttgaacacctgtctgaagctgcaacgcatactccaagtcccacaacacatcaaccatggttggcctatcagaaccaacttcttgcaatcatttttctattgtctcactaa

SEQ ID NO: 24532 - DNA, 208 bp, Glycine max
  Peptide Sequence Number=SeqID_116217
atggttttgtctaagattcgtcacaggcaccttgcgatgaaaggttcgagaagatactggcttggaatttgcattggagctgccaagggtcttcattaccttcacaaaggagtagtggtacggggaatcattcaccatgatgtgaagtcctcgaacttattgcttgatgagaaccatgttgctaaagttgctgattttggcctttggg

SEQ ID NO: 24533 - DNA, 573 bp, Glycine max
  Peptide Sequence Number=SeqID_116218
atggtacgcaaaccaagaaaaattcagaagctctcctcaccttctcacgttgcttttcttctccccttctcatccaccattgttgcccaacaaagctccaaactttgctcaccatttctactccaaatcgcaaaaggaagccattttcggagtcgtgaagcgcacctctacgttatgggacttcaaatttcagggttttatgatgatgctttgcgatatttgtgtgctgaaattgctgatggaaaactggtagacatgaaggggaaagtagaaaactgtgagattttgagggttagagaaactaaattcggggttagtgtaaattggggtctaaaaaaattgctgttaaaatgtgcagcagaattttgtgctggtgcagaaaatgcttatgcattgctggttatgggaaagcttggaagggttgatggggacccggtgctgagagaaacgaggataagggctacgtgggggtacgtgagctcagttgaaggtgggcaactcgtggtggtgggttcatgtttgatttgtggatgtgggagagttcatttgcaccatcgcccgatcgccacctag

SEQ ID NO: 24534 - DNA, 1047 bp, Glycine max
  Peptide Sequence Number=SeqID_116219
atgaatgagttagtgaggggtgttgaggttattggtgttgaagggaataagaatggtcatatccaaaatgatgaagttgatgttggggatagtaggaaagatacgtttccccctgtgaccattcctgggtatgagtgggtgtctagagaggtcaattcttactgtacttgctttcaaactcctgattcaatagccacctttaaaaaggaagttgatatgactatttatgatgattttgagagtttagttgtagaacattgtacttcagatgatcgtgtgtttctgaaagcttctaaaatcatgaagggttatgactataagagtttgagggcttttgttactaatgaccaagcaaatcctcctcttggtggtagtgattttattggagatgacattgttggtggtggcaaacttgttccacaacatcatattatagatttcacggaaaaagaacaagagaaaataaaagagcaagcgaaagaaaaggaggaagaggatcgcactaataaagtaattcttcattattaccaaggcaagttgtgccgattagatcatgttttagttgccccaaatattatttcactttggaatgctgagttgattgctgtaatttggcattggaaagaaatagttgctactgctgatgaaagaattaaattgatgtctgagctattgaagatcatgaaagttgaggttagtaagattgaacaacttggagtggctctagccaaaattacaacattggagaaaagtgttatggatgctaaaactaaacttgaggaactatcattagagcttgttgttgaacaaaacaaaagtaaaactatagaggatgaaaagaaaattgatgaagataacttgacatctgctaatgaggaacttgccaacctaacaaaggttatggaaaatttggagagcaagttgcagaacaaatacaagattaagtctgatttggatactaagttagaagagagaatctcaacttgctacgatgaggaggaagaagaagaaaagaagaatgaagcagactcaaaagtggctaattag

SEQ ID NO: 24535 - DNA, 81 bp, Glycine max
  Peptide Sequence Number=SeqID_116220
atgaggaatggattacaaattcagaaaagaacattacatcaaacatatagtgaaggaaggagctttgaggtaattgggtga

SEQ ID NO: 24536 - DNA, 591 bp, Glycine max
  Peptide Sequence Number=SeqID_116221
atggcttccgttccgtcaaatctcatttctcagtcattccctaactctattgcagagaagcttaatgattcgaattatctccactggcaacaatacgtccaaccggtgctcaaattgcacaagttgcagcggtttttcgttaatccggtcgttctgcctcgttatctcactgaggatgattgtattgctgatcgcatcaatccagagtatgaaacctgggaagttcaagatcaaacgcttcttgtttggctgcaatctacactttcgaagtctgtgttgtcaagagttctaggttccaaccattcctatcagagtaagaagcacactctgtcaattgcagaaatagatgctcttctccatggtcatgaaaccatgctcactatgcgcagccaaacacttacaaaaacagtgattccggtggctctcgaggcttgtatgactgtggcagtggtcgcggtaccttttctgattgaaattctagacgtggtagcggtggttctggcagaggccgtggaggtggccgatttgccaattttcagtgccaaatctgtcttaagtatgggcacaatgctaatgtcggtcatttcataa

SEQ ID NO: 24537 - DNA, 600 bp, Glycine max
  Peptide Sequence Number=SeqID_116222
atggagagaagtatgatagatgctgccagtggtggagtccttggagacatgacccctgctgaagccaggaatttaattgagaagatggtttccaactcccaacagtttagtgccagaaatgatgttattgtcattagaggagtgcatgaagtagccacgaattcatcttcattagctgaaactaagaagcttgagggtaaactagatgccttggttaacctggtaacccagctggccttgaatcagaaatctctacctgtcgcaagactctgtggtttatgctcttctgccgaccaccatacaaacctttgcccttctgtgcagcaatctggagcaattgagcagcctgaagcttatgctgcaaaaatctacaatagacctcctcaacctcagcagcaaaatcaaccacagcagaacaattatgacctctccagcaacagatacaatcccagatggaggaatcaccctaatctcagatggtctagccctcaacaacaacaacagcagtctgctccttccttccaaaatgttgctggtccaagtagaccatacgttcctcctccaatgcaacaacaacaacagcaaaagcagcatcaatag

SEQ ID NO: 24538 - DNA, 171 bp, Glycine max
  Peptide Sequence Number=SeqID_116223
atggaattcttcttgatcatatacccattagacatagacataggatttgtcatcatcaaaaagggagagattgtagaagcaaggcttcaagaagatgttttgatgatgccaaaggaacacacttctcaagttttattcaagacaagaatccatgaaatccaagatatatga

SEQ ID NO: 24539 - DNA, 785 bp, Glycine max
  Peptide Sequence Number=SeqID_116224
atggggtcgtttttaaagttttttcaagagggggctgttttttacgtgatttgcatgcatgcaccacgcaaaccgccagtggaactggcgagtttgctctccgtgaatgaatcgccagtggcaatggcgatattgccatgcataggaaaccgtcagtcaaactggcgagttccactagctggagttgccaatggtattggcgagttaggcgtgggaggcgccaccagcattagcgatttagtgttgtctggaaaatatgttgcgttacaaatttgtgatgacgaagatgttgaaaccatgctcgaaagttttcaacaacaagatcaaatgttagttctggaattgtacatagaaaaggatgtggctggtggttctatgtttcattctgcaaattcacttacatcatgtggaaataatttatctaataatgaggcgcaaccgccaagaaatgtgagcaatttacatggtgatgatgatgatgatgatgattatcttgtgtctaactcatacgtggaagagtctgtagacgaagatgatagtattgacggtgtacaaggaattcaaaatccattttggaatgatgctttgcattataataatatcaactggagtcatcctgatgaggaggacatttgtggtttgaagatgccatccagttttaatgttggccaagaattatatgttggcatggattttgatagtaaagatgtagttaagaatgcagtcaaacaatatgttatgaaggtgcatcaaagtttcaaagtggttgaaagcaaatggaacaa

SEQ ID NO: 24540 - DNA, 924 bp, Glycine max
  Peptide Sequence Number=SeqID_116225
atgccatttaggacttatgagaaagtttggactgtgctagagggaaaaacaaatgaccaaagtgaacaaagagccatttctaggagttttctgcctttgccttgttttcttggctgtgatagtgtgtgctgtttgaatgttgttttacctggatgttggggaaagcttgggaggattgatggggacccggtgttgagagaaacgaggatatgggctacgtgggagtacgtgagctcagttggaggtgggcaacaggggatggagaccttggggacgtcaggtggggtgctattgcccaaaaccaagcttgaccaatcccgacccaacccgggcatagaagctagaggagcttctggtaatcaattaccaggggatgtaatcgattaccaggcttcaaagggaactggagcactgtggaggcctctgatcgtgatggtggcgcagctaatccatgatcgagtagagatggagtgcctagagggagcctgggagaccctcgaaggcaacacgaggtgccgatttcggggcactattcgatttacggagacttctttggtgcatccagatgaacccgtgcgcacgcttcagcgcactgtggagtggatactacccacgcctacaccataccgtctagtggagccagtccaagtgatcgaggtgacgtcatccgaggaagaccctgaggaggatcccgaggagctacctcctgagcctgttgtggatgctcttgactttctagagggcgatgaggaccctgaggtggattctcccgaggaagtcatgtcggcatctgaggcagactctacggaggatagtggcccaagagagatggcgaccagtggaggctcttcatcatacaacataccttctatctcatgttggcagcaacataacattctcccagctgaaccaacaattggttaa

SEQ ID NO: 24541 - DNA, 342 bp, Glycine max
  Peptide Sequence Number=SeqID_116226
atgatgcgaattcctgcagagatgttaatcaactgccatttgttggatagcatgactacacgtgttgtggatagcatgactgacaacttaagaccaactcgtgcagaagccactaatgttgccaatgctattttagatggaagtgatgcaatacttctaggtgctgagaccttatgcgggttataccctgttgagactatttccacaattggcaaaatttgtgcagaagtcgagaaagttttcaatcaagatctttattttaagaaaactgtcaaatatgttggagaacccatgatccacttggaatctattgcatcctctgaacatttgctcacagggtaa

SEQ ID NO: 24542 - DNA, 423 bp, Glycine max
  Peptide Sequence Number=SeqID_116227
atgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttggaaagcattggaaggctacctatagttggaatgcagggtcgcacagatgttgtacgtcacatttgggatgaactaaggacttatgacgttcctgtctcagcattttggttgcaggattggggagggcagagagaaacattgattggttcacagctttggtggaattgggaagtggatgcacaaaggtattggggatggaaggaacttatcaaagatcttagctctcagaatataaaagttatgacgtattgcaatccttgtctagctctggtaattcatccctga

SEQ ID NO: 24543 - DNA, 465 bp, Glycine max
  Peptide Sequence Number=SeqID_116228
atggttggcctcaattttctctccccagcagatattccagaactgaagtttataaacgcggtcaccgttagcaatgcgttggatatcatgcttcaaatcatcataggaaacgacaggaaccttggacttgaatgtgttgcggtctgtggctccattcagtcgaaaccgtttcaggtattctggctgagaatctcagcaaggagcccctcttggacactgtcagtgtttcgtgtcatatcctcaatgaactgcaatgcttttgcgttctcatcatcacaattagcaatggccatggcacagtgcaagaagtggatgagtatgaaacatgacacactggactacctcatgggaggctgcgtcgtggccgacatgtgggcccagatatgtcgtcacgtcagcaaaagtttcctcgtgggtgaaccacaaggtcattcggttgtagggtgtgttggtatgagaaagtga

SEQ ID NO: 24544 - DNA, 960 bp, Glycine max
  Peptide Sequence Number=SeqID_116229
atgtgccaaaatcgctggctatatgagagactctcacaatcgtggaggctaagtggggaatatcattttagtgataagcagaagaagcataaaaggagtactgtggggcttcttgataaggttttctccttaagaagagtttccactcctcacggagagcctaataaggtggccaagacagtggtaaagaaggagaagaaacactcctcttggctgataatttgcaaacaaaaaaaagcatcgatattccacataaaagctgcaggggcacgcacatataagaaaggaggaactgaatttattttagaaaaagaaatacatgaaagaccggtacatgggattcgaagtaaggttgttgctagaaaagctccgcacaaggatcttcctaattatgctcaacatatcgtgccaattttctgtttgccacaagagtggctatggtgtgaatcatggtgtggtaatgctacaaaatacaaggcaaaaaccattgatctgtgcaacaatcccatgacaaaagaacccaaactgcagcttggaggccatagagctagccacaagaagatcaaaggatgctttgcttcaaggaatgaaagcagtgagagcagtgagtgtgtggtggaacatcaacatggtgctagttttcataatgaggtggaaacagttaatgagtccaagaagagcaaggggcatgagtgcccaatttgcctaaaggtttttccatgtggccaagccttgggtggccataagagatctcatatggttggtgggtctaagagtagaagctttcaaacaattgtgcttcaggaaccagtggcagaaattagggacttccttgatcttaatcttcttgctgctactaaggaagaaagcaatagccatgctgactctaacagtaacagaccctggtggatagtagaagacaaccacaaacaggaggcactggtaggccttatctcatag

SEQ ID NO: 24545 - DNA, 228 bp, Glycine max
  Peptide Sequence Number=SeqID_116230
atgattagaagaggactatgcagaaacagatgcaaactgtccaacatcaggagaattgagatgactggaaacataggaggtatgagtttgagtgggaatggaaggaaactgaaaaggaatggaggaggaagtggactgactgagagaagtggaagtctcaaacaagtcagcatagggaaacttggactcattgaaaatgacatccttggagatataaattctgcctga

SEQ ID NO: 24546 - DNA, 483 bp, Glycine max
  Peptide Sequence Number=SeqID_116231
atgtgggcctttcataaaggtttacaaattgattgggcacaccttgttagatatcgcatgcataaggcattgcgattgaatgcccctttgccttatcctcatcttattacccttttccttcaacacttcaacatccctcttgattctgaaccctatgttccaatcaagagatcattccttataggcgtttcaggcatagcatcctttggttatattaaggaacatgatggctcttgggtaaagaagagtgctagaaatgttggtgaagaaggacctgagggagaagattcatctcttctttcgaagattttggaaaggtttgatggtcttcaaacctttgttggtgagaggtttgatactttggaattgcaagtggatatgcgcttcaatgaaatggagtcaagaatgacaaaggttgaagaagatgtatcttacattcagtcaagcttcgatcttccaccaccgccgccaccatcatcttag

SEQ ID NO: 24547 - DNA, 147 bp, Glycine max
  Peptide Sequence Number=SeqID_116232
atggtggcagaatttcaacttgtgctagaacaaatggatgtgaagacatcatttttgtatggaaagcttgatgaagtgatattgatgaaacaacccgaggggtttgaagtcagagcaatccctcaggcaatagaatatgagatttga

SEQ ID NO: 24548 - DNA, 447 bp, Glycine max
  Peptide Sequence Number=SeqID_116233
atggctgttaatgaaccaacatacaacaatgctgacaagaatccttcttgttgtggttgtgtcatgagaactacgcacggtcttccttgtgcatgtataggtgaagattcttggtccttggtgtgcaaccatttgcttaaagaacttcgcaaatggtcagatgactatatcaagctctttggtggcatagacagattcgaggaattaagaaggtccctatttgttgatgggttatccatggttactatggataagtggatggatataactgagatgagatatgtcattgcatcacgatataatgtaatccttgtatcgttgttgctacaacaaagcatggcatattttcctcttagaagtcaaccaccaacagattcttctgtgcatcgcataatatgtatcggtcacgtctatggctatcattttgctcagatagactcaagatag

SEQ ID NO: 24549 - DNA, 501 bp, Glycine max
  Peptide Sequence Number=SeqID_116234
atgatgtcttccaagcaaagaaagagtggcggttcaaagcccaccactcaatatgatacaagaagattccactcttttgaggcttggaccagatacgatgataatgtcatgggaagacatatattagctgagaggaaagtggaaatatatcatacagagctggatgaatttaaggctgaattggagaggcgtaactttcataagtgcctcaccaatttagatgacagtagcattgacctggcattggtgaaggagttctacgccagcctctacagtcctgaggggccttcaccaaaacaagtcagaatacgaggccacttgataaggattgatgcagatagcctcaatgcctttttagaaacacctgtggtgctttctgagggtgaatctttacccgcttactcaagatactgcaggatgcctactgacatcaaggaaattgaggttgctctatgcatacccggccgagggttgattttaaatgctgaaggtcaaccctag

SEQ ID NO: 24550 - DNA, 165 bp, Glycine max
  Peptide Sequence Number=SeqID_116235
atgccaagcaagccaacaagaaaaggaaggaagtggctaaaggcccaagtggagaaggacgaaggcccaagtggagaaggacaaagcccccgagtggagaaggatgaaggcccagaggcagagacactatcaagactattaattgttgctgaagacccaaactaa

SEQ ID NO: 24551 - DNA, 362 bp, Glycine max
  Peptide Sequence Number=SeqID_116236
gatgtaccatctgtggaagagctcatgaatctggatgttgtattcctattgaagaacaccccactcatgaagtcaattacatgggaaatcagcccaagaacaatttcaatgtaggaagattttctggattccaacatggccaacaatataatcaacaacagggacaatggaggaaccaccctagaaatcagttcaacagagatcaaggtggaccatccataaggccacaacaacaagggcctagtctttatgatcgcacaacaaagttggaagagactctaactcagtttatgcaggtttctatgtccaatcaaaaaagcacagagtccgccataaagaatcttgaggtccaagtgggatag

SEQ ID NO: 24552 - DNA, 450 bp, Glycine max
  Peptide Sequence Number=SeqID_116237
atggtggtgacgggtgacggagaattaggttggaccttgggttgggtcgatcggtccgcctccggtgtgcaccggtcggctcgtcccttctgccggcgatgcgctcctgtccttaactggccgggtcgtgcctccggacagtcgggggcattcgtatttcatagtcagagtgaaattcttggatttatgaaagacgaacactgcgaagcatttgccaaggatgttttcattaatcaagaacgaaagttgggggctcgaagacgatcagataccgtcctagtctcaaccataaacgatgccgaccagggatcagcggatgttgcttttaggactccgctggcactttatgagaaatcaaagtctttgggttccggggggagtatggtcgcaaggctgaaacttaaaggaattgacggaagggcaccaccaggagtggagcctgcggcttaa

SEQ ID NO: 24553 - DNA, 441 bp, Glycine max
  Peptide Sequence Number=SeqID_116238
atggggtgtatgggcacatacttaacccatgggcccaaaatctaccctaaggctcatgagaaccctagggccttctcttgcatctttggtccaatcttcttggagtcttctatccaatgcccttggggggtaggattacatcacaaagcatactgggcagtgaagactgcaacttctctatggatcaagctgttctacaaagaaaagaccaagaagttccatgatagcatgatagttaaaaaggacttcatggttgggaaaaaagtgttattgtataattctaggcttggactcatgagtgttgagatcaaaagcgactccacaaacaagagcttcaaggtcaacggacatcgacttaagccattcctcacgaacccttctttagtggacgtagtggtggaagagacttccatactccaccctactcttcctccaccatga

SEQ ID NO: 24554 - DNA, 264 bp, Glycine max
  Peptide Sequence Number=SeqID_116239
atggcaagcaattttaaagtgtctttgatttttgacatagaatacatcaagggcacctcaaattcactacctgactaccttacccgcatcgggaatctccctacggggaggaaggagtacaggcaaaggagccaggctggctcttccagagccaaccatcaagaaatcatctacctcttctgggtcaccaacccaggctgggtcatctacccagaaaaacaatttagaagggtcatcaacccagattgcctcaatcaaacctga

SEQ ID NO: 24555 - DNA, 305 bp, Glycine max
  Peptide Sequence Number=SeqID_116240
atggggacaaatcaaaccggcaagaggttttaccaagtcaaggttaaaagcctagataccaccagcatcaaggaattagggcggttgatggaacctctccaaatgcaagctttccgcaagacttacggaaagatcttagagttgaccttagcagagaaaaccatatctttcatccgggtgtctcccctctttgagcagaattgcaactgtggtcaaggattcagcaagaggtttggacagcataaaacagacttggaacggcatagcgggcctaccacggaggtacctagaagacaaggcgaggg

SEQ ID NO: 24556 - DNA, 154 bp, Glycine max
  Peptide Sequence Number=SeqID_116241
tgtagaagcaagcttcatgatgatgaatcaagttgattcaagtagttttgatgatgacaaagatgatgacaaaaagcccaagaaaatgatttcaagattgagtcaacaaattcaagatcaagaagatgaattcaagactcaagagaagaaatga

SEQ ID NO: 24557 - DNA, 114 bp, Glycine max
  Peptide Sequence Number=SeqID_116242
atgagtgagatatggcagaagggagaattgggaacgagggttttcgaagaagtgcaagaacacgttgtaatcgattacactaatatgataatcgattaccagagagcattttag

SEQ ID NO: 24558 - DNA, 333 bp, Glycine max
  Peptide Sequence Number=SeqID_116243
atgaccatgattacgccaagctcgaaattaaccctcactaaagggaacaaaagctgggagattcgccacttgagtgaatcccccaccgagggtcaggaggccagacaagaaagattcgcgcgcctcaagacggttcttgactcagtcgacagccggttggatcaagcccgagaaatagatcgggttcgtgacaacgaacgtgctcggctacgggcagaaatggatcacgactgtgatcggtggagggctctcgagagaaagaacgcccaaatgcgattgaaagttaatgaactaaatttaaaaaagaggggacctcttattaagtttaagtga

SEQ ID NO: 24559 - DNA, 387 bp, Glycine max
  Peptide Sequence Number=SeqID_116244
cctcaagtcattccgaatcctttacttgatttggttattcccattcccataactaataccttacctaaccttgaccagactagtagccaatcagcacaaccaactaatcgctttaaccatgacccaactaattcatcctcaatccctggctcagatcatcctcacactttgccctctgtcaccttaagaaggagtacacgccactctaagcatcccttatacttgtctgattatgtaatatcacaatctcaggctgcatatcccatccaacatcattgttccctattgcctcttagccctccttacaaaactttcattaatcacatctcctctgtctatgaacctcagttctatcatcaagatattccttatcctgaatggcgttga

SEQ ID NO: 24560 - DNA, 333 bp, Glycine max
  Peptide Sequence Number=SeqID_116245
atgaagaacggtgggaaatcttcacgaaatcgctcacagaaacgtctcggaagcgcctcggcttggattttcttcacggaaacaatttttctcactaatttcaagggaaaagagggaggtggttgtcgcccaactcgcccaggggagctgggttgcttccatgaaaaggcaccgccttctgttggaacaccctggaaggcccaagtgggcttggttgctatttgcacaaccctttttactaaatacaccccctttgccttttttgctgattctttttccgtaacgtcacgaaactttacagattacgtaatgatacttgttttctttctgtaa

SEQ ID NO: 24561 - DNA, 811 bp, Glycine max
  Peptide Sequence Number=SeqID_116246
atggcgcccaccgcctcggtgatcgcctgcagcgcggccggcggcacgccgcccgggtccacgatgatttccgggcgcttggccgcagcctcgcccgccactacgcaaagtccagccagaaaggcccgggccgcccaccgcatgcgtcaggtcggctgctgcacaacgatggacgggaatttcccggccatgtcacggggaagcgccgcaacgcccgccgccagcttcctggcaataccgcggtacaacccggccgcctcgctgcccgggtccgccaccacggtcggcgtgccggcgtcggtctgctcgcggatcgccagcgtcagcggcaggctgcccagccagggcgtgccgtactgctcggccatgcgctggccgccgccctcgccgaagatgtgctcggcgtggccgcattgcgagcagatgtggatggccatgttctcgaccacgcccaggatcggcacctcgaccttctggaacatgcgcaggcccttgcgcgcgtccagcagcgccacgtcctgcggcgtggtgacgatgacggcgcccaccaccggcactttctgcgccagcgtcagcgccacgtctccggtgcccggcggcatgtcgacgatcagatcgcgggcgaatcggcgtcgatcaggaagccgatggagttggcctgcaggccatggccggtcaggggctccatgctcttgttgtccaggctctcgggacggcccgagacgcccagcatggtcggcacgctgggaccgtagatgtcggcgtccagcaggccgaccttggcgccctcggcggccagcgccagcgccag

SEQ ID NO: 24562 - DNA, 142 bp, Glycine max
  Peptide Sequence Number=SeqID_116247
gtcgactctagaggatcccacccgtgacacaccggaaatcaaatggaagcatcgttgcacagttagtgaggaatttcgcgaaggtttcgaccgttcttcgacgttcatcatccgttcttcatcgttcttcgatcttcaacgg

SEQ ID NO: 24563 - DNA, 113 bp, Glycine max
  Peptide Sequence Number=SeqID_116248
ggaggattgcatcagaagaagttgaagtgtttcagagagtgagtagtgctaagagttttgacgtaataggtttttatagtggactttttggctttttcaaaaacgatcattag

SEQ ID NO: 24564 - DNA, 300 bp, Glycine max
  Peptide Sequence Number=SeqID_116249
atggtgacaacaaaagagcttgagacacacatggattcttatgagaagatcatctctgatcttcaagaatcaatgcaaaattcgttcgagatgatacaaaaatctatcaagggactgatggtttcgattgcaacccaacataagggacctaaaatcacaactgaggatggaaatcatagtgggactcatgaacccattgtctcggtgttggatagggcacaaatccctttttcctcttttgatggttctaattatcgagaatggaaggcaaaatccaaacaattttttgaattggaatga

SEQ ID NO: 24565 - DNA, 210 bp, Glycine max
  Peptide Sequence Number=SeqID_116250
atgaatagcttacacacttggttaattagtcaagctttgcgagcgtctgctaagcgcaacactcagtggctaagcgcgaggaagaatccagaagaagatgagctatataggttcgctgagtgcaccgctccgggtcatcaagcgcaccgcttcagctcatccgctaagcgagagaagcgcgctaagccaaaatccactaatgtgcgttaa

SEQ ID NO: 24566 - DNA, 589 bp, Glycine max
  Peptide Sequence Number=SeqID_116251
gtgcgagaaaaacagcgcacgggttgtctgttgcttacccgctctcagtgtgtggttggtttcacacctattccaacaagacacaagacacccgtgtccgcttcaaagttatcgctcatgcgtcgaaaatggaagagtcgattgggaccaacatttggctaggataggaggcagcgcaatcaattggtttcctcgttggaaggaaggcaaggagggagttcttttctcgtgtggggactaccctaatgttccattgatagggactaggagttgtattaattataatcccgcactcgccataagacagctagggtaccccatgaggggagcgccaacggaagggagtctctcacctttccttgtgagagatttaggcgcgcaaggtctcaaggttatacaaagaatccacaaggcgtggagggagtccgttgaggaaagacaagggagcttagggggcatccgtaatggcgtcatcggaggttatcatggatggctaagagttcacacgcgagagttagattggctctccaagttgaaagttatcgatgaggagaacttcgaagctccggaggaagatgaagaagtctga

SEQ ID NO: 24567 - DNA, 256 bp, Glycine max
  Peptide Sequence Number=SeqID_116252
atgcatattcatggagaagatcacaaaggtaaaggagatggaaataatgaagattttcacactggtgaaattaaagcaaatgctgatcttccaagagaatggagagtttctagatatcatcctcttgacaacatcattggtgatatatcaaaagggcaaaccaagaatggaatatttgtcaatcaatcaaaatattgcaaagacttgattcacaaatttgggatgaagaatgctaagcatatggctacaccaatga

SEQ ID NO: 24568 - DNA, 237 bp, Glycine max
  Peptide Sequence Number=SeqID_116253
gctgccagttatctgaattgcagaatcatgcctctgcctttctcttatttgggaataccaatcagggctaatccaaggcgctgtgggttatgggatccaatcctgagaaagactgaatctaaattgtctagaattcctaacagggtagcggaaaaactgacccaaatccagaggaggttcctatggggtggtggccttgatcagaagaaaattgcatgggttaaatgggactgctga

SEQ ID NO: 24569 - DNA, 366 bp, Glycine max
  Peptide Sequence Number=SeqID_116254
aatgtttatacggataggcactcgggtatttccgcccgtcagcgtgactcaaaagtaagtatgacagatcttgtgagcgcggaagatgacgcttttcgtattacagatagcaaaaaggtttatacggataaccactcgggaatctccgcccgtcagcgtgactcaaaagtcagtatgacagatcttctgagcgcggaagatgacgcttttcgtcttacagatagcaaaaaggtttatacggataaccactcgggtatctccgcctgtcagcgtgactcaaaagtcagtatgacagatcttgtgagcgcggaagatgaccgtgactcaaatgtctgtatgagagaccttgggagcgcggaagatgat

SEQ ID NO: 24570 - DNA, 204 bp, Glycine max
  Peptide Sequence Number=SeqID_116255
atgggggtgcaaatagcacccaggcccacttgggccctccagaatattcctccagaaggctgttgcttccggaggaaaaaatctaagccgaggcgcttccgaaacgtttccgtaacgttttccgtgaagaatttcgcgaaggtttcgactgttcttcgatgttcctcattcgttcttcatcgttcttcgatcttcaacgggtaa

SEQ ID NO: 24571 - DNA, 270 bp, Glycine max
  Peptide Sequence Number=SeqID_116256
atgacaggagattggcttggcgcactggaaaggagattaaagatgggatggaatatgccaagggctgatacgagtactcttcctaaagcaccggttattgcaacaacgggacacttagctaacgtaaaccttgtctctctatctactgctcgtggctatcttatccctaccgctcgtagattcacttcattttattttgaaggcggacatgttgacatgaaaaagaaattgattgctcgagttagattgcagcttattctcaagcactag

SEQ ID NO: 24572 - DNA, 135 bp, Glycine max
  Peptide Sequence Number=SeqID_116257
tggagctttgtgatcctcaatctaaagaccttgataggacgtgggtagtgaacggacagaggttaaagcaacatcatggtggagcaatagtgtcgcaacctacccttcggcgggagggcgacgcgagactcgcgg

SEQ ID NO: 24573 - DNA, 489 bp, Glycine max
  Peptide Sequence Number=SeqID_116258
atgtgggcttttcataccggccgacaaattgattgggcacacttagtccgatatcgcatgcataaggaattgcgattaaatgctcctttaccatatcctcatctagtcactcttttccttcaacactttaacatcccttttgattctgaaccttatgttccaatcaagagatccttcttgatcggtgctgttgtgattgcatcttttggttactgcaaagagggtgatggctcttgggtaaaaaagggtgctcaaccccatgatgatgaaggacacttaccagtaggagaggattcctctctccttcagagtatcttggacaagtttgatggacatcaaacctttgttggtgaaaggtctgatgctttggaacagcaagcggacatgcgattcgacgagatggactcaaggatcaccaaggttgaaggagatgtcacttacatccacacatgctttgatctaccactaccaccaccaccatcatcttag

SEQ ID NO: 24574 - DNA, 471 bp, Glycine max
  Peptide Sequence Number=SeqID_116259
atggccgatatctccgactatctggtcagcaacctgcaggatccgctgtcgcgcatcgagggcgtgggggacgtgcaggtattcggctcggaatacgcgatgcgcatctggctggatccgaccaagctggcgagctatgcgctgatgccttccgacgtgcagacggcgatcgaagcgcaaaacacccaggtgtccgccggcaagatcggcgatctgccggccgccgccgatcagcagctgaccgccacggtaaaggcgcagtcgcggctgcaaacgccggaacagtttcgcaatatcatcctgaaaagcgacagcagcggcgcgctggtgcggctgggcgacgtggcgcgaattgagctgggcaacgaggactactccgccagcgcgcgcctcaacggccaccctggcggcggggatcgcagtcaagctggcggcgggcgccaacggccttcaacaccgccaagctggtga

SEQ ID NO: 24575 - DNA, 663 bp, Glycine max
  Peptide Sequence Number=SeqID_116260
atggctacctcaccaaaagatacttcatcacctggttcgccttctgtaccatcatctccatcatccaccaaagcaccatcaaaccaggaacaacctgaattccatatccaacccatacaaatgattcctggtcaagcccctgttcctgagaaactggttcccaaaagacaacagggagtgaagatttctgaaaaccctagccctgcaacaagtcctagggaagtagacccggagatggataagaagattcgcagtattgtgagtagcattctgaaaaatgcgtctgtccctgatgctgatgaagatgttccaacatcctccaccccgaatgtttctgtccctgatgctgacaaagatgttccaacatcttccaccccaaatgctgaagccctcccttcacccagtgaagaggaatcaacagaagaagaagatcaagccacagaagagacccctgcaccaagggcaccagaacctgctccaggtgacctcattgacctagaaaaagtagaatctgatgaggaacccattgccaacaagttagcacctggcattgcagaaagacttcaaagcagaaagggaaaaacccccattactaggtctggacgaatcaaaactatggcccagaagaagagcactccaatcactcctaccacatccagatga

SEQ ID NO: 24576 - DNA, 336 bp, Glycine max
  Peptide Sequence Number=SeqID_116261
atggttgagagagagatgatcaccatgatggtagacactctgccagtattctactatgagaagctagtgggttacatgccgtccagctttgcggatctggtgtttgccggggaaaggatcgaggttggattgaaaagaggaaagtttgattatgtttcctccgcaagcgcgaatgccaaaagaatcggggcaacaggggcaaaaaggaaggaaggagatgcccatgtcgtctcttcaacacccgcgtgggtcaaaccccagcaaacacctcatggtacccatcagtacgcgcaacatcacccaagtttctcggctcatgctgggaaacgcctctag

SEQ ID NO: 24577 - DNA, 378 bp, Glycine max
  Peptide Sequence Number=SeqID_116262
atgaaacaaaaaggaaaaagaaagaaagaccgcgaaggtcgacatgttatagttaagaagtataaatcattcgtaaagagcaaacatatcttctggaaacaagggactgatgctaagagtttattttccagaataaccgagataagaatggatgaattcattgaactgataaaagaacataatttggaaacattgggatgcttgagtgcccacctgactgtagccatgactaattttgcacgttgttttcaaatcatcattgtcacgcgtgccttatggagtgatagaggagttcggcccgagaccgacaccttgacacccaaatttgtttcgccccaaatatcaagattgggttcccacgataaaagacctcattga

SEQ ID NO: 24578 - DNA, 492 bp, Glycine max
  Peptide Sequence Number=SeqID_116263
atgattattaggggtcaagacatttataatagtcaagaggagactacttcttccccttcctctggtggaagtgaagatgaagtaagaggtgaagagtctagtgaggaagtctacccccatgaagaaggtgacctcctaaaggtggccaaagatcaactaactatgaaagataagagggatgaggaagaaaaactagaaaaacaaaagaaaaagaaggatagtaaggccttgtcttcaaaggccaaggggaaggaaaaggaggaaaaggattcctccaagaagattgttaagaaggaaaatcattttgcaacaaaaggtgatattaaaagagcactccttcttaaacaatctttataccttctcctatcaagggaaacatcccctagcaccgccatacctcctgagcttgaggttattcctcaagtaaaggagttgttggatgagggtttggttcgtaagagcttaaatccttgtgctttgttggtgccttaa

SEQ ID NO: 24579 - DNA, 279 bp, Glycine max
  Peptide Sequence Number=SeqID_116264
atggatgtggatgaagaccatgaggttcccatcattttaggacacccctatatgttaattgcaagctgcgtagttgacatgggaagaaagaaactagaaatgggttttgaagatcagatgatcaattttgatctatttgaagaaaacaagcatgtactagatcagaatgtctacttgcaagtgatggagggtgataaggagcgaaacggcccgctaagcgagcgtgttaagaaaccaaacgtttctcactaccgcttagcagccgcactcgctaagcaa

SEQ ID NO: 24580 - DNA, 399 bp, Glycine max
  Peptide Sequence Number=SeqID_116265
gaaaatgggggagttgctagccacccagctcgcccaggcgagcaaagtgacttcctccagaagcaaccgccttctggaggaatcttctggagggcccaattccggaatgtcacggaacttcacgaattgcctagcgatgggtgccaagtacctcaaaatggtcaaatgaaagttgcatgccaccaagcaaaggcctgtggctgctctgcaattttgtgccctggccgctttgtagaagctgttataaaaggtgttgtaaaagatcgcgcggctttgatgctgatgctctgccagattctcctttgcactaagcgcgctaaagctgcgcttagtggtggatatgcgcttaacctaactgctacattttgcaattcaaaacttagcctctttttcacctga

SEQ ID NO: 24581 - DNA, 186 bp, Glycine max
  Peptide Sequence Number=SeqID_116266
atgagacaccttagtgatcaaggggttcccataaacactaagagaataaaggtcattcctgagtggcccactccaccaagtgttgaggaaaaaagcccggagtttcaagaacctcgggatttgaggtcaaatccttttcaagggggagggaatgatgcaatcctaccccgcaagggcattggatag

SEQ ID NO: 24582 - DNA, 66 bp, Glycine max
  Peptide Sequence Number=SeqID_116267
atgggggtttttccctttctgccttataatcttgctgcaatgccaggggtctcttctgtggcttga

SEQ ID NO: 24583 - DNA, 390 bp, Glycine max
  Peptide Sequence Number=SeqID_116268
atgtcccacaactcagatttgaacttggatagagccaggttggtttatggcttagtaacccacatggatatgaacatcggcgtcctaatctcatgtcaaatctcttctattgctcagagtaactcctctaggcttggatttccagccttgatcactaccctctgcaaagctagaggagttacctctgacagtctaacttatgagagcctgagcctggccattaacttggcctacattaagaaaaactgttggaatgtgggtgatctgatagttaacttcagaggggtaaggaaggcaagggctcgaccagctgatgttccttcttctactccactaactcctttcacttctgctactcctacaccagctcctcctggcccatcttcctag

SEQ ID NO: 24584 - DNA, 320 bp, Glycine max
  Peptide Sequence Number=SeqID_116269
ggcctggggtttcaagctctggttacggacctctgtcagtcctacaggggatcgcgcccgcaagacacccagtggacccggagaagtccaacagggtcttagggtttccagctctgattacgggcctttgtcagttctagagagtgctcatcgcccccaacaaggtcatcaggcccctattaacagggctttcatcaagaagtactacgcccctaggcaggcacagggtgaaacaccacagcagcctagggatggccagcagcgggcaataagcgcgccgccaccacctctagagttcacctcagctcatccacaaaaag

SEQ ID NO: 24585 - DNA, 1050 bp, Glycine max
  Peptide Sequence Number=SeqID_116270
atgccgatgcgcagccagaccggcagcgtgatgttcgacgcgttgttcgcgctggcccagcaggagatggaccaggaccgtgtggacgcgattcgcgatcccgcgttcgacgaaggccggccggtgccgtgcgagtgcttccagaccggcgcgcgctggccctatgtgtggacccgcgatgtcagcttcgctgccgatctggcgctggcgcggctggacccgcagcgcacccggcagtcgctgcagttcaagctgtcggcggcgcgcgacgggcacacgcccggcctgttcgtggcgcaggacaccgggtccggcggcagctggccgatcagcagcgaccgcgtggtgtggttcctggccgcgcgccacctgctggaggacctcgcgtttgccgagcaggtctggcaggcgctgcagggcacgctggcgcaggaccgcgcgatggtgttcgacgcgcagatgggcctgtaccgcggtgagacctcgttcctggactggcgcgagcagacctatccggactggacccgcgaggacgtgcgcttcatcggtgattcctacgcgctatccaccaacgtactgcactaccaggcgctgcgcctggccgaacgcctggccggcaagcgcggcgatgcccgcgcggacgagtacaaggcgtgggccgatgcgttggcgcagcaggtcgatgcgcgcttctggcgggaggacatgggccagtacatgagctacatcggcgaagcggcgcacccggtgccgtacgccaaggtcgatctgctgggcctgtcgctgggtatcctggccgacgtgctgccgaccgggcgtgcgcgccgtgcgctggcggcgtacccggtcgggccggccggcagtccggtggtctggccgcaggaagggcagcagccgatctatcacaaccgcgccatctggccgttcgtcagcgcctattcgctgcgcgcggcgcgccagctggatgatgcgccgcgcatcgccgccgagatccgttcgctgatgcgcggcgccgcgctggccggttccaacatggaaaactacgagctt

SEQ ID NO: 24586 - DNA, 302 bp, Glycine max
  Peptide Sequence Number=SeqID_116271
ctccggattttcaagggcgccgggggcgcaccggacaccacgcgacgtgcggtgctcttccagccgctggaccctacctccggctgagccgtttccagggtgggcaggctgttaaacagaaaaagataactctttccggggcccccgccgacgtctccggactccctaacgttgccgtcagccgccacgtcccgatctgcaccgacgaccgctccgcccgggctcgcgccctgggttttgcagcgaccgccgcgccctcctactcatcggggcttggtccttgccccgacggccgggtatag

SEQ ID NO: 24587 - DNA, 263 bp, Glycine max
  Peptide Sequence Number=SeqID_116272
tccggacacaaggattggattggctcccaaatctaaagactgtgagagacaatgaggcatcagaagaaagtgatgaggtacaagccctaaaggcagagcttgaaagagcccgggtagtcgaagagaagttcaaggcagcaatagtgagctcagctccgaagagtgaaaggatcatcacgggtcaaaggcatgatctgaaggacgagctaaaggcttgccttaggtcggaaaagaaatttgtcccaacagttaagcgagactga

SEQ ID NO: 24588 - DNA, 426 bp, Glycine max
  Peptide Sequence Number=SeqID_116273
atgaggtcagagcctatttgtgcgtacgtttatattaatggtgaaatcattcaaagttcaagtgcaaatgcaattttcagaggtgacaagacaaaatcgttactcttgaatccaacaatgatgctgccaaacataatcaccgtaatacagttatcaattacagataatgatggtacgcctataattactgcactttggtatcgtcgtcctgtatatgaattcaatggtgaagttcaatatagggcaattcaaattattgacgaagaaggtgttttgtgcatgtttcatacatttgcgaatatgacaagtgtaatatgtatggaacttaaagatgatgttcataattcattatcacctactcaagttaatgacctaagttgggttgacatggagcagcagttggacaattccctgaaattagaataa

SEQ ID NO: 24589 - DNA, 232 bp, Glycine max
  Peptide Sequence Number=SeqID_116274
gttaattaggcaaattggcaaaagtgttgtttttcactctttcgctaagccaagctgctggcttagcaagaattcgctaagcgcaaccatttgcttaaagaacttgacaaatggtctgatgagtatatcaacctccttggtgattagcatggataagtggatgaatatagctgacatgggatatgtcattgcatcaacgtacaatgtgatgcaatcctaccctcccccctaa

SEQ ID NO: 24590 - DNA, 1041 bp, Glycine max
  Peptide Sequence Number=SeqID_116275
tttgattacgtctccccgataggtgccagtagtaggaggactagaatagctggggcaaagaagaaagagggagatgcccataccgttacttcaacacctgcgtggcccaagccaccacaaaccccccacggtacccaccaatatgcacaacatcacctgagtttttcggctcgtgccgaggcctcttccgatacagcactcacccacaggggggagctcttcaggctccggctccgactcggcctcactcggccaacaacgctcactttgacgcaaacacggcgaggaacttttcacctcgatcccaatgacatatggggaactcttgccatctttcatcaccaaccaattggccgtggtggtcccgggaaagatcatctggtctccattcccaaaatggacgggcccaacataaaaatgaacccgcttgccaatcatggaggggaggcggttaatgccatcgaggtgagtaggtcacacgggccaaagcttttgaaggacgtaacgacccccggaaggtttatcaacaaagtcttgcaaaaggcgggcatgattccctgcggcgggcgcaaagaagattcttgcttaatgcatccgggtgtactccatgacatggaaacatgttcggcgataagagatctattacaacagatgataaaccaaggccggcttgaggtcggcagtaagagggaggaggaacaacatgtatgcatgcagtcggtggatgaagaaggacctaaaatgcctaaacccttgaaaagccgcgcagttccgtggaggtatgccccttcgagcggtaggaaggaagaagctaccgatatcagctcactatcggccaaagtgaccaatatcaccgggctaagcggcatatcccgcagcggtcgcgtgttcgcaccccctagcctaccgatacagcccgcaatcactaaagggaaagcaaggatggtcgaaggacaaaatgtcaaggtgatccccgcaccggacgaggatgttccgacaaaggatctttctgaggggagagagggctgtggcaagaaagag

SEQ ID NO: 24591 - DNA, 594 bp, Glycine max
  Peptide Sequence Number=SeqID_116276
gagtttggtctctcgtcgcgggtggatttgtgggtgctggaccacaccctgcgcttcctggcagaacaccgcgagcaactacccggtcatcgttttgccattaatctggccccttcaaccgtttgtcgggtgcagttcccgcttgaggtgagccgcctgctggcgaaatacgccattgagccgtggcagctgatttttgaggtgacggagtgcagcaccttcggcaacggggagcaggcgcaacacatcctccagcagctgcagaaaatgggggtacgcattgcgattgatgattttggcaccggctatgccagctacgcgcggctgaaaagcgtggatgccgatattctcaagattgacggcagctttattcgcaacatcgtcaataacagcctggattaccagatagtggcttcaatctgccatctggcgcgcatgaagaaaatgctggtggtggctgagtacgtcgagaccgaagagatacgcagcgcggttcacgcgctgggcatcgattatgtgcaggggtatctgattggcaggccggtggcgcttgcctcgctgctggaggcagaggcgtccgtagcggacgcctga

SEQ ID NO: 24592 - DNA, 495 bp, Glycine max
  Peptide Sequence Number=SeqID_116277
atggcgcctaccaggcaccctctggacccagataagtccaacagggccctgggatttcccgccttgatcacaggactctgccagtcgttcggtgtccccgttgcacctagcaaggtgattcggccgcccatcacccgagctttcattgagaagtattgcacacagagacaggcccagggggatgctccgcaggccgcagacgcgccgccacctcatcaggctggcccagctggatcgtttgatacggagcagtatttgtggcatttggttcgccagcaggcggccaaccaccgggcgcatgtacagacccatgattgtctttaccagttgagcctcagcctgcagagccagggttttacttcttttccgtgccctactccggaccagctcagggcagaggttgcatggcttggagattggcctgaggcctgggcaggagaggcgccagcagaggctccgacgaggcagatgaggcccgcgaggacgaggagatga

SEQ ID NO: 24593 - DNA, 534 bp, Glycine max
  Peptide Sequence Number=SeqID_116278
acgtccggaaagagtgtgccgagttacgagaaggaaatgcagttaccacaagagcccttgaacaagaaaccaagagggctcgcaaggaagagcatggccgagaaaaattccgtggagctttgtggggcagcaacagtgagctcaagcttcgaagggaagagagagaccaatcacgagcacatagcatggtcttaaaagaggagttagctgcttgctcaaaatccaaaagaaacttgtctcagcgtttatgtgagacagagaccagcatgttagccatcatcaacaagtaccaagaagaattaaatctagccatggcccacgagcataaagtggcggacgagtatgaccaagtgtacgcggaaaaggaggctaggggaagggtgatcgactcgttacatcaagaggcaacaatgtggaagcaccgatttgctcttaccttaaacgggagtcaagagcttccccgattgctagccaaggccaaagcaatggcggacacctactcgccgccgagagatccacagacttctcagctat

SEQ ID NO: 24594 - DNA, 405 bp, Glycine max
  Peptide Sequence Number=SeqID_116279
atgactagaggcaatccatctgacttacaaccttttgatcctgagatagataggacatttcatagattagttaggcatcattttgtaccttttgagcatcctgagcattctgtggttggtaattttgaacatcctgattttgagcattctaagaacatggcacaacctccaccccgtgagaggactctaagggaaatgggtgcacctgatttcacctatgaaagcttgtgcatccaatatcctgatgaggatgtcccatgtgttcttaaaattggactgatccatttgcttccaaagtttcatggccttgtaggtgaagacccgcacaaacatctgaaagaattctatattgtctgctccaccatgaaacccccagatgtccaggaggatcgtgggatcctctag

SEQ ID NO: 24595 - DNA, 384 bp, Glycine max
  Peptide Sequence Number=SeqID_116280
atgaggtggaaaattgtaggaggtgataaggtcaggctttgggaagataaatggaatcagcagcagcaacctctagctgagaggtatcctagattgtaccaaatatctacacagcaaaaccaaatcatcagacacatgggacagcacatgcagtcaggctgggaatggcaatttctatggagaagatcgctgtttgaaaatgaaattgagtcagcagtcaattttttaaaggatattgaaggtatacacattcaacagcaaggatcggatgaatgggaatggttaggtgatcaaacaaggaaatattccacccgtagtgcatacaatctgattttggaagcttctaaagggggtcagcatcaggactggtgtaaggaactatag

SEQ ID NO: 24596 - DNA, 490 bp, Glycine max
  Peptide Sequence Number=SeqID_116281
acctagcagcaatcgacgctttccttgcctaccaccatagcaaggaaagtccggtggtagctgtcttggcagatctatttgacacatttgaccgaagaatagattgggaccagcttttggccgggataggaggtagaacaatcagttggttcccccgatggaaggaaggaaaagaaggagtccttttctcatgtggaagatacccaaacattccgctggtaggaacgaggggttgtattaactacaatcccgcgctcgctataagacaactagggtaccccatgaggggagcaccgacggaagaaagcatgtctcctttccttgtgagggatttcggcgcacaaaattccaagtctatacaaagaatccataaggcatgggaaaccccgttaaggaaagaccaagaacttagaggcattcgtaatggcatcattggtgggtaccacgaatggctgaaagttcatatacgaagtttagattggctcgccaa

SEQ ID NO: 24597 - DNA, 237 bp, Glycine max
  Peptide Sequence Number=SeqID_116282
atggttgaaaatcttcgcaaaatcacccacggaaacgttacggaagcgcctcggcttggattttcttcacggaaccaatttttttcactaatttcaagtgattctcaaattaccaggagggctgaacatttttccctttcacctctccccctatttataggaaaatgggggagaagcttgccacccagctcgcccaggcgagctcggttgcttcctccagaagcaaccgccttctag

SEQ ID NO: 24598 - DNA, 507 bp, Glycine max
  Peptide Sequence Number=SeqID_116283
atggggacaaggggttgcatcagctacaatcccgttcttgctataagacaacttggctaccctatgagaggggcgccactagaggatgagctcgcgcctgtcatttcacgaggcttcaataagaccaacgtggagacacttcagaaggtccgcaaggcatgggaggtgttgcaaaagaaggacaaggaactcaggggcagtaacaatgggcccatcggtggctatcaggaagttgaggcaccggaggaagacgaagaggtgcaggcccttagggcagaactcgagcaagcccaaacagttaaagaaaggttcaaatcagcagctttgaaaatccgaaaagagaataccgaactaagagatcggttatgcgagacggagaccaacatgttagctattatcaccaagtaccaagaagaactaaatctagccacggcccacgagcatagagtggcggacaagtatgcccaagtgtacgcagaaaaggaggctagaggtgggatcctctag

SEQ ID NO: 24599 - DNA, 534 bp, Glycine max
  Peptide Sequence Number=SeqID_116284
atggaatttggtgatattgttgttcattttaacattcttgatgccatgaaacatccatctgaggatcattctgtttttcgtgctgagataattgatcagattgttgatgattatatgaaacatccatttttatctgatctccatacttgtcattccttatgcattgaatctgaatctgagtttgaatttgatcatgtatctgatttttatgctgagaatgaatctgaatttgagtctggttctgattttctgggtgttgtatctcttgatgttgattttttagagtcagaatgcactaaccatgttgtaggaagtacatatacttttgacttactttatgaggtacaggccgaggaaccttcttcttctcctaccctagttcctcccactattcagccaccacccacaccagagttgaagctcttaccagaaaccctcatatatgcttacttggaggacaaggaaaaatttccaatgatcatctctgcctcccttgctgctgagcaagaggagaagttgttgctagttctctag

SEQ ID NO: 24600 - DNA, 372 bp, Glycine max
  Peptide Sequence Number=SeqID_116285
atggcttattccctagtggatggcgcctcccctcacctcttctcctttatcttccactacataaaggttaccaatctacaagaattggggcaattgaagctcaaagatccagcctccatagaagctccacaagcaagctttcatcataaagagtctcttttattggaattaatgttaaaatttgtacaatttcagcgcgtatccatcactaagtgcgacttcagcgcgcttagcatgaagaaggaatctagaagagcacctgaatcaaaacagagcgctaagcgcgagatcaactcgctaagcgagtcgtccgtctcttgccaggctcagcgcagcattggcgccaagcccaaatccacttactcgcgctaa

SEQ ID NO: 24601 - DNA, 1170 bp, Glycine max
  Peptide Sequence Number=SeqID_116286
atgaattaccatacaaaatttgatgaattcaagactaagcttgagagaaggaattggcataaggagctaaccaatttcatggatgggagcatcgatgttgccattgttaaggagttctatgctaacatttatgatcctctggataaatcacctaagcaggtgagggtgagaggccacttaattaagtttgatgaagatgccctcaacacctttttgaagacccccgtgatcatagaggagggggagaacctgcctgcttactccagattccgtcgtttgaggccagatccacaggaactggcagcccgactatgcatccctgggaggggatttgagcttaatgctgatgggctgccattgaagatcttgcgggggaatctgaccatgcttgctcaaacatggagcgttttatcattctccaacctggcccctacttctcacacatctaacatcacactagacagggccaggatgatatacgacattattcagaagatggatatgaatctgggctacattatctcagctcagatttctatgatagctcagcatgactcctcgaggctgggtttccctgccctcgtcattgctttatgcaaagcccggggagtcacttctgattcattgacttttgagagtctcaatctagccattaatttggcttataccaagggcaagaggtctgaggctccactatcttctgctctccctaccccagctccttctacttctactgcagctccatctactccaacttcatctttaccagctccagcttcagctccttcgacttctaccgcagctctttctgccccaacttcatccactcctttgccagttcctgctcaagtttctacaggaccttcaacagtggcttggccaggagtccatccttctcgttcgagagtgggtgaggcctcctcagcccaagagcctgtgccagaggaggatgagcccatccctcctgagccagacacaaagattgctcaggaggaggcaacatcaccagagcttgttcctgagtcatccccatcaccagctccagtccttgaagacccagagtcatctgcactggcaccgatgcctgatcagtctcttgctcaggaccctccagttgcactgatgttggatctgaacgagaatgcagaggatcatttacaagatgattaa

SEQ ID NO: 24602 - DNA, 792 bp, Glycine max
  Peptide Sequence Number=SeqID_116287
atggccaagttgatctatggtattatcatgaagatggacatgaatctgggctacctcatctcccatcaaatttctattattgccaagcatgactcctctaggcttggatttccagccttaatcacagctttgtgtaaagctaggggggtcacatcagattccagatccttggagagccttagccctgccattaacttggcatatataaagaagaactgttggaatctagatgatccaacagtgacatttagagggccaaggaaggccaggggtaagagatctgaggctccccctacttctgcagcaccagatgcttctgctcctttttcatctactttactagatccttctacagtagcaccttcttcttctactccagctactcctacacccataccagttcaatttccagttcagctcccggcttcttctgctcttgcatcaagcctccatagagggcaggtcattatcatgcagagtctccagagctcaggcctaccatctattatgagcacaaatgagttactgactcaggtaacagaggaaccagttttagcaaaggatgagctcactcctattgagccctgttcagttgccgcagatacatctatggctcaggaggaggtatcttcaccagatcccatgccagagccatccccggcactaatatctgaggacaccatgccatcagcaccagccatggagccagggcagcccattattcaggatgcaccagttgctacaatgctagatttaaatgaagatccgccacaggatgagcaggatgtttaa

SEQ ID NO: 24603 - DNA, 387 bp, Glycine max
  Peptide Sequence Number=SeqID_116288
atggcttcgggcgcaacttgcgttcaaagactcgatggttcacgggattctgcaattcacaccaagtatcgcatttcgctacgttcttcatcgatgcaagagccgagatatccgttgccgagagtcattgacgaggaggccgggcgcacggggcgccgtggtcatcccctccctcccgacggtaagatgaataaacaagttcgcgggtcaatctggattgtggaggcatcgacaatgatccttccgcaggttcacctacggaaaccttggtacgacttctcccttcctctaaatgataaggttcagtggacttctcacaacgtcgcgggcagcgaaccgctcacgtcgccgcaatccgaacacttcaccggaccattcaatcggtag

SEQ ID NO: 24604 - DNA, 715 bp, Glycine max
  Peptide Sequence Number=SeqID_116289
atggcgagagatagattggcacatagtgaagtacataatatcaggctaaaattgattgctgaccatgaaaaagatggtcgtatatataatgtgcctactgtttcagaagtagctgcacttattgcaggtgattttgatacatattcaagaagagatattattcttgagactcggaatggccaattaaaaaggatagatgaattgcattctagctatctaggtttacaataccatctattatttccttatggcgaagatggatatagacctgacatacttcatcgtgctacatcaagtggtcaaaaaagaaagagaaatcgtcttacaatgagggagtggtttgcttttagactacaatgcatgtcaaatgaagcacaaactttgttgcactctaggaaactcttccagcaatttgtggttgaagggtatactatggttgaatcaaaaagactttccttcatcagaaacaaccaaaaaaaacttagagttaacaagttttgcagcttgcaacagtcattggatgctggtgccaccaaaggcttacaaaaaggtaaaagggtcattttgccttcaatgtttgttggaggcccacgatacatggatcaactttattttgatgatagaccagacattctctcacgagtttttaaattgaagtatgaacagatgctttcagacctaacaaagaatcatctgctgggaaaagtagttgcat

SEQ ID NO: 24605 - DNA, 231 bp, Glycine max
  Peptide Sequence Number=SeqID_116290
atgaaggaaaccaacaaaggatccccagtggagtcgccaactgtcgcaacctacccttcggcgggagggcgacgcgtgactcgcgggatgcgtgttccacgaaaggaatacgcgcggagtcgccaccaacgtttatttgaggaaaacgtcagaaaaaccggaaaagacgcgatctacgaacttttaagtgaaaggttcgggagttgtatttgcgcacggggaaggtattaa

SEQ ID NO: 24606 - DNA, 129 bp, Glycine max
  Peptide Sequence Number=SeqID_116291
atggcgaaatcatcaaggtacttaggggatggaggcaaatggaggatagggtcacgggctgaccgttgtcccttcccggcgctagacaaagtagagaatgtcgctgcatggcagcccagtatcctttga

SEQ ID NO: 24607 - DNA, 285 bp, Glycine max
  Peptide Sequence Number=SeqID_116292
atgtttgtctctctgctaaagcatgtttgcatttttagtggagaaaacaacgagactttttcaagtctcacaagttatccagaactacgtaggtctgagttcctcattggaggatacgtaggagcaagagcctcgcttttgtcgaccacactgccttttgtcgccatgactcaagaggcgcttccgaaacgtttccgtaacgttttccgtgaggaatctcgcaaaggtttgaaccgttcttcgacgttcttcattcgttcttcatcgttcttcgatcttcaacgg

SEQ ID NO: 24608 - DNA, 429 bp, Glycine max
  Peptide Sequence Number=SeqID_116293
catcaaattgccaaggaaatcactgccaaacaagtccagcattggccaaagaaaggaaagctttctgcagggaagctaagtgtgaagtatgcaatcctgcacaggattggggctgcaaactgggtacccaccaatcatacttccactgttgccacagggaaagctgctgcttcaggtgctgtgtccaaggatgctttgattgctgaactcaaggacacatgcaaagtgctggaagcaaccatcaaagccaccacagagaagaaaatggagctggaacgcctgatcaaaaggctctcagacagtggcattgaagatcgagaagcagttgaggaagaagaagaagctgaggaagaagaagaagctgaggaagaagaagatgcagcagaggatacagaatcagatgatgatgattctgaggccaccccatga

SEQ ID NO: 24609 - DNA, 47 bp, Glycine max
  Peptide Sequence Number=SeqID_116294
atggcttctatggatacctctgctatggtcaactctaagatctttcc

SEQ ID NO: 24610 - DNA, 348 bp, Glycine max
  Peptide Sequence Number=SeqID_116295
atggtgctcaaccaaatgatgatgaaagacactaaccggttgaaggagactcttctctccttcagagtattttggacaggtttgatggacttcaaacctatgttggtgagaggtttgactccttggaacgtcaagtttgtcatcatcaaaaagggggagattatggaagcaagcttcatgatgatgaaccaagcaattttgatgatgccaaaagcccaagtgattgattcaagattgattcaagactgcaagatcaagcatcaagaatccaatccaagattcaagattcaagagaagaaatcaagaagcaacaagtcaagacttcatataggatcggataagtattaa

SEQ ID NO: 24611 - DNA, 1947 bp, Glycine max
  Peptide Sequence Number=SeqID_116296
atgccgctcgacagcttccgtctggagccagacaacagtacccagaatatgcgttcggcacctgataaagaggccgcagagagcgtatcgatctcctttaatggctcgaaaatcgagattgcctcgtcgctgaactcgaccggcatgcgtctggtgtggcaggtgccgtttggcaccctgctgcttgataccctgcaaaatatcctcttgcctctgctgctgaatattggcctgctggcgctggccctgtttggctacagcacgtttcgtttccagccggggcgccagagcgacgcttctgcggttccggccggaaccagcaatgagctgcgcgtactccgggcgctgaatgaagagattatttccgtactgccgcttggggtgctcgttcacgatcaggaggcgaaccgtacggtgatgagcaataaaattgccgatcatctgctgccgcatcttaacctgcagaacatcaccaccatggcggatcagcatcagggcgtcattcaggccaccataaataatgaactgtacgagatccgtcagttccgcagccaggtcgcctcccgcacgcagatcttcatcatccgcgatcaggacagggaagtgctggtgaataaaaagctcaagcaggcgcaaaggctgtatgagaaaaaccagcagggacgtgccgcctttatgcaaaatatcggcgatgccttcaagcagccgttaagggcgctggcaagccaggcggcggcgttgaatacctctgaaagtcatcagcttgcctgccaggccgactcgctggtgcgtatggtcgatgagatccagctggcgaacatgctggagaatgatttctggaagggaacgccaaccctcttctccatccaggatctgatcgatgaagtggttccggaagttctgcccgtgattaagcggaaagggctgcagctgctgatcaataaccatttgtccgcgaatgacgaacgccatggcgatcgagaagcgctgcgtcgcattctgttgatgataattcaatatgccgtcaccaccacgcagatcggcaagatcaccctggaagtgaatacggacgagtcggctgaggatcgcctgacgttccgcattctggacaccggggaaggtgtcacgacaagtgaaattgataatctccacttcccgttcctgaatgacacacaaagcgatcgttacggcaaagccaatgccctgaccttctggctgtgcgaccagctggcacgtaagcttggcggccacctgaatattaaagcacgcgaatccctcggcactcgttattctctgcacgtgaaaatggccgccaatccgcaggaagaagacgaagaacgtctgctggatgatgtcgtggtgatggttgatgtgacctcaaatgagatccgcaatatagtggttcgtcagctggaaaactggggtgcggcctgcatcacgccggatgaaagacttgcaagtcaagaatttgatctgtttttaacggataatccgtctaatcttactgcctcaggcttgcttttaagcgatgatgagtcaggcgtgcgaaaaatcggcccaggccagttgcgcgtcaactttaatataagcaatgcgatgcaggaagctgtactacaactaatagaagagcaactggcgcaggaagagatagcggaatcaccgttaggcggcaatgaaaatgccgagcttcacgccagcggatactattcactctttgttgatacagtaccagatgatgttaagcggttgtatactgagtccgctgcgaatgattttgcagcgctggcacagacagcacaccggcttaaaggggtgtttgccatgcttaatctggttcccggcaagcagttatgtgaaacgctggaacatctaattcgtgagaaagatgcctctggcattgaaaaatacatcagcgacattgacgcctacgtcaaaagcttgctgtag

SEQ ID NO: 24612 - DNA, 420 bp, Glycine max
  Peptide Sequence Number=SeqID_116297
atgaatgccgaaaaatccccggtggctcacaacgttgaccacgaagagattgccaaatttgaagcggtggcgtcccgctggtgggatctcgaaggtgagttcaaaccgctgcaccgtattaacccgctgcgtctgggctatattgcggagcgttccggcggtctgttcggtaaaaaagtgctcgatgtcggctgcggcggcggttgcccgtcttcacgcgctggagtctggcatacaggtagactacgtgcaggaaaccgtggaagaacatgcggcaaaacatgcccatcagtacgacgtggtaacctgcatggagatgctggagcacgttcccgatccgcagtccgtggtgcacgcctgtgcaaaactggtgaaaccgggcggccaggtcttcttctcaaccctcaaccgcaacgctaa

SEQ ID NO: 24613 - DNA, 738 bp, Glycine max
  Peptide Sequence Number=SeqID_116298
atggacctcatcaaggcagcaggactgatgaaaactgtcaccaagttgggagattgctatgaaagtctagtcagggaatttattgtcaacattccctctgacataacaaacagaaagagtgatgagtatcaaaaagtatttgtcagaggaaaatgtgttagattctcccctgctgtgatcaacaaatacctggacagaccaacagatggagtggtggatattactgtctctgagcatcaaattgccaaggaaatcactgccaaacaagtccagcattggccaaagaaagggaagctgtctgcagggaagctaagtgtgaaatatgcaatcctgcacaggattggagctgcaaactgggtacccaccaatcatacttccactgttgccacagagaatctcctctatccctgcactacaaactgtttgaggggacacatgtcccagacattgtctcgacaagctgctgcctcaggtgctgtgtccaaggatgctctgattgctgaactcaaggacacatgcaaggtgctggaagcaaccatcaaagccaccacagagaagaagatggagctggaacggctgatcaataggctctcagaaagtggcattaatgatggagaagcagctgagcaagaagatgaagcagctgaggaagaagtagaagcagccgaggaagaagaagaagctgctgaggaagaggaagatgcagcatcagatgatgattctgaagccaccccatga

SEQ ID NO: 24614 - DNA, 594 bp, Glycine max
  Peptide Sequence Number=SeqID_116299
atgagcgtccacgtggcccaggtgattgctgatgccatctatttgtttgcaggtatgccacccaccaggcaccctctggacccggataagtctaacaaggccctggggtttccggcattgatcacgggcctcttccagtcgttcggggttctcgtcacccccaataaagtgatccgaccgccgatcacccgggccttcatcgagaagtactgcacgcttagacaggcgcagggtgatgcacatcaggctgtagacacaccgccaccacctcagcaggccgatcccgctggatcactaggcatggagcgttatctacagcacttggttcgccagcaggcggccaaccaccgtgggcaggtgcagatacatgagtgtctctaccggttcagcctcagtcagcaggggcagggttccgctccttttgcatgccccactccagagcagtttaaggctgaggtcgcatggcccagagactggcccgaggcccaggcaggggaggagcctgcaggatcccccgatggggcaaaggaggcccgtatggatgaagatatgactgacttgctcgatttcttgggaggaagcggagccacgtga

SEQ ID NO: 24615 - DNA, 420 bp, Glycine max
  Peptide Sequence Number=SeqID_116300
atgtcaaatcataaaagcactgagtcagcattgaaaaaccttgaggttcaggtgggacaactggccaagcagatagctgacaagtcatcaagcagttttgtggcgaatacaaaaaagaatcctaaggatgaatgcaaagctgtgatgacaaggagtaagaggtttgtggaggcagaggatgaggatagtgttgtatccaagaagaaaggttctgaaaagaaaggtgctgatgaaaagaaagatgatgtgagaggtgaaggcaatcaggaaaaagaaaaacaaataatggtcaagagaaaagaattaaatgaccaagaaaaagaaaaagaagtagaaaaagaaaaaaaaatgaaaaaaataagaatgaagagaggagtagaagtgaacaagctagagagaagaaaagagaaaaagctgtga

SEQ ID NO: 24616 - DNA, 144 bp, Glycine max
  Peptide Sequence Number=SeqID_116301
catcctcttcaagcttcttatccgaggaaattcatggtggtgaagctccttcttccttggcttattccctagtggatgcctccatagatgctccacaagcaagcttccatcaagtggtaatcagagcacaagagcttcaagtag

SEQ ID NO: 24617 - DNA, 114 bp, Glycine max
  Peptide Sequence Number=SeqID_116302
atggaatgccaggggctcctccacgataagcacacgttgcgttcgagtcgtatcgtcagaataatggaggtggtcttcgccattggaagtgcggtagacaggctttgtggttga

SEQ ID NO: 24618 - DNA, 258 bp, Glycine max
  Peptide Sequence Number=SeqID_116303
atggaccaactctcaaagtacatagcgagaatcgccaaaactgtcgtaccttacccttcggcgggaggagcgagtctcgcgggaggtgttcacgaaaggaatacgcgcgaagaacggttcgccacaacctttgcgaaattcttcacgaggaaaacgtcggaaaaccggaagacgcatctacggcttagatttttacgtgaaagtcgggagttgtatttcacgcaaattcggggaaggatagccaacgtccgtccctaa

SEQ ID NO: 24619 - DNA, 640 bp, Glycine max
  Peptide Sequence Number=SeqID_116304
agaactgcacatcctcaccttcagaggactccacgtcctcgccttcagagggctacaagccctccccttcagaggactacgtgtcctcaccttcagagggatacacgccctcgcctttagaggactacacgtcctcaccctcataggactacacgtcctcaccttcagaggactacacgtccttgctttcagaggactacacgtcctcaccttcggaggactacatgtcctcgccatcagagggctacacgtccttgccttcagaggaatacacgtccttaccttcagagggctgccatcctcgccatctgagggttgcacgccctcgccatcggaggactacacgtcctcaccatcagagggctacacaccctcacctttagaggactgcacgtccttaccattagaggactacacgtcctcgccatcatggggctacatgtcctcacctttagaggactacatgtcctcagcttcagaggactacacgtccttgccttcagagggctacaccccctcaccttctgaggattacgtgtcctcacctttagacggctacacgccctcgccttcagaggactacgtgtcctcaccttcagagggatacacgccctcgcctttagaggactacacgtcctaa

SEQ ID NO: 24620 - DNA, 327 bp, Glycine max
  Peptide Sequence Number=SeqID_116305
ggacttgcactacctccggagcctaaggttggtccttcagctactcatgtcagcacaaaggagagttgtggtgatccctcaccgaccgatccaaacacgggttcgctgagcgcaccgcttcatctcgctaagcgcaccgcttcagtccatccgctgaatctgcagggaccagagcttgatgaggaagctgttctgagagctttagatgagaggcttcctggttatggaaagctaaaatcctctgttgaatcttcccttggaaattggtctgattctgatgaccttgataggacaaggctaagttgtcgtactatcacgaggaatcgg

SEQ ID NO: 24621 - DNA, 204 bp, Glycine max
  Peptide Sequence Number=SeqID_116306
atgagtgagatacgaagatttggaggtttgggaatggaggaacgtcgtaagagaaaaggggctgcgcagggatttctggaaaatgtgatatttatagagcaggacgtgtggaggaggcagcctactggtaatcgattacaggccatctgttctagtgtaatcgattacagtattcatgtaatcgattaccagaacaaaaaatag

SEQ ID NO: 24622 - DNA, 1050 bp, Glycine max
  Peptide Sequence Number=SeqID_116307
atgccctcaccttcagagagctacacgccctcacctttagaggactacacgtcctcgccttcagagggctccacgccttcacctttagagggctacatgccctcacattcagagggctacatgccctcaccttcagaggactacaagtcctcgccttcagagggctgcatgccctcgacctcagaggactacacttcctcgcctttagagggctgcacgtcctcacattcggagaacaacaggtcctcgccttcagagggctgcacacactcgcccgtcctcaccttcagaggactacgggtcttcactttcagaggaatacacgtcctcgccttcagcggactgcacgtcctcaccttcagaggactaaacgtcatcgcctttagagagttgcacgcctttgcccatcctcaccttcagaggactacacatcctcgccttaagaggactccacagggcaacacgccctcgccttcagagggcaacacgccctcgccttcagaggactacacgtcatcgccttcagatgactacacgtcctcgccttcagagagttgcatgccctcgcctattatcaccttcagaggactacacgtcctcgcgttcagagggctgcacgccctcgcctttacaggactacacatcctccccttgagaggactacacgtactcaccatcagaggactacacgtcctcgccatcagaggactacaagtcctcgccttcagaggactacacgtccttgccttcacaggactagaaatcctcaccttcagcgggctacacgccctcgcctttagagagctgaacaccctcgcctgtcttcatcttcagaggacaacaagtcctcgccttcagaggattacacgtcctcgccttcaaaggactgcacgtcctcaccttcagaggactgcacgtcctcaccttcagaggactacacgtcctcgccttcagaggactacacgtcctcgccttcaaaggactacacgtcctcgccttcagaggactacacgtcctcgccttcagaggactacatgtcctcgcctttag

SEQ ID NO: 24623 - DNA, 416 bp, Glycine max
  Peptide Sequence Number=SeqID_116308
taaataccgattcttccgagcagaccgttaatctcggtcagtaccgtaccgcgaaattcaccaaagtgggtgataccaccaccaacattccattcaccatcgaactgaacgattgcgatccgctggtggcgaaaacggctgctgtggcgttcaccggtcagatcgacgcaactgacaaaaccctgctggcagtgacttccggtagcaacgacaacaccgcgaaaggtgttggtatcgagatcctcgacagcaaatccagcgttctgacgccagacggtgccaccttctctgctgcgcagaacctgatccagggcaccaacaccctgaacttcagcgcgcgttataaagccactgctgcgaccactgaaccaggccaggcaaacgctgacgccactttcgttatgaaatacgaataa

SEQ ID NO: 24624 - DNA, 78 bp, Glycine max
  Peptide Sequence Number=SeqID_116309
atgaagaaacaacaatggaaagagaagcggaaggcaaaggagaagaggataggggaggcaccatccactagggaataa

SEQ ID NO: 24625 - DNA, 651 bp, Glycine max
  Peptide Sequence Number=SeqID_116310
cggcgggatgcgctgttcgggttcgacaggcgcgggtgctcagtgccgaagggtcagcaggccgtacagggcgtgctggcgcaggtgcgcgaaggccagtcagggtgcagtcgatccggggtgaccgggtacaccgaccgtatcggcagtgccagctacaaccagacccctgtcgcagcgacgtgccgaggccgtgcgcagcgcgctggtgcagggtggggtgcctgcggccagcatcagcgccgaagggcggggcgcagccgagccgatcgtgcagtgcgagcagcgcaaccgtcgcgagctgatcgcctgcctggcgccgaaccggcgtgtgcagattgctggaatggcccagccgcgctgagagtcccacaccggggtcatgccccggttttccatggtgcacgcgatgaacgcccaattcctgcctctttccatgaagacggaagccacattgagtgtgtacggccagctcggcaaccatgcggtggtgcgcattcccgggcggcgcctgccgggcttgatcctgcaggcagacaccgtggccggcttccttgcccagctgcaggaagcccaggcctgcctgcgcagtggtcgcgcacagcgcaccgacgccgaactggacatgctcatcgacgtgttgcagcagtg

SEQ ID NO: 24626 - DNA, 246 bp, Glycine max
  Peptide Sequence Number=SeqID_116311
ttattactggcgatcttggactgatatccgcattcgtggagaggtggcacggtgagaccagcaccttccaccttccagtaggagagctgacaatcacattggatgatgtgtcatcactccttcatttgcccatcactagcgccttgcacagtttccatgctctttctacggaggaggctagatttttgctgacagagttgctcgaggtgtctgtcgaggaggccagagtcgagatagcactgacac

SEQ ID NO: 24627 - DNA, 234 bp, Glycine max
  Peptide Sequence Number=SeqID_116312
atggaccttaaaagtgatcttttttacttacaaaataggggaggagcttgccacccagctcacccaggcgagcaaggttgcttcctccagaagcaacagccttctggaggaaggatctggaaggcccaactttcgaagaagttacggaaacttacggattgcgcaaaaacacctcttttcgatttccgccacattacggaatttcacggattgcgcaagcctgcttccttttga

SEQ ID NO: 24628 - DNA, 582 bp, Glycine max
  Peptide Sequence Number=SeqID_116313
atgggtccagaactgaccggctcgcacgtgattgggtctcgagcgtggctcatccaccattttatcacggcgaagtcggccatgaacccagatttcaacccaaccacgaggcgggtgctcgcgggaggtcagcatacaccccgcgcagcaacatgttacatgtttgcgttggggaaacgatgtgtgacacccaggcaggcgtgccctcggcctaatggcttcgggcgcaacttgcgttcaaagactcgatggttcacggggaattctgcaattcacaccaagtatcgcatttcgctacgttcttcatcgatgcagagccgagatatccgttgccgagagtcattatttgagttccttggcgcacgaagcgccggggtttgtgtttgtcgcgaggacgaggaggccgggcgcacggggcgccgtggtcatcccctccctcccgacggttcagtggacttctcacaacgtcgcgggcagcgaaccgctcacgtcgccgcaatccgaacacttcaccggaccattcaatcggtaggagcgacgggcggtgtgtacaaagggcaggacgtagtcaacgcgagctga

SEQ ID NO: 24629 - DNA, 477 bp, Glycine max
  Peptide Sequence Number=SeqID_116314
atgaaggtaaaggtgaggactttgagtcccatgaaagataaaggtgaggaatttgagtcccatgaaatcataaatcaaaggatgttgagtcctaataaacaagccagtaggcactacccgggggatccactagttctagagcggccgccaccgcggtggagctccaattcgccctatagtgagtcgtattacaattcactggccgtcgttttacaacgtcgtgactgggaaaacactggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 24630 - DNA, 915 bp, Glycine max
  Peptide Sequence Number=SeqID_116315
atggcctccaactcccagcagtttagcaccagaaatgatgccatagtcattagaggagtgcatgaggtagctacaaacccatttgcatcatctgaaactaagaagcttgaaggcaaactggatgcgttggccaacttggtaacccagctggccttgaatcaaaaatctgtacctgtcgcaaggcctgaagcttatgctgcaaatatttacaatagacctcctcaacctcagcagcaaaatcaaccacagcagagcaattatgacctttctagcaacagatactaccctggatggaggaatcaccctaacctcagatggtccagccctcagcaacaacaacagcagcctgctccttccttccaaaatgctactggcccaagcagaccatacattcctccaccaatccaacaacagccacaaccccagaaacaaccaacagttgaggcccctccacaaccttccctcgaagaacttgtgaggcaaatgactatgcagaacatgcagtttcagcaagagaccagagcctccattcagagcttaaccaatcagatgggacaattagctacccaattgaatcaacaacagtcccagaattctgacaagctaccttctcaagctgtccaaaatcccaaaaatgtcagtgccatttcattgaggtcgggaaagcagtgtcaaggacctcaacccatagcaccttcctcatctgcaaatgaatctgccaaacttcactctactccagaaaaaggtgatgacaaaaatttacctaacaatttctgtgcaggtgaatcttcttccactggtaattctgatttgcagaagcagcacatccctcctcttccattccctccaagagcagtctccaacaaaaaaatggaagaggcagaaaagagatcttggaaacattcagaaaagtag

SEQ ID NO: 24631 - DNA, 195 bp, Glycine max
  Peptide Sequence Number=SeqID_116316
atgactggagatgcatcaaattttgcacatatctctccaaagaaaagcgggcatgtaacatatggtgacaacaacaaaggtagaatccttggagttggtaaaataggccttaagcacagcctgcttagcgttagtcaattatgcgacaaaggctatctgtcgcaacctacccttcggcgggagggcgacgcgtga

SEQ ID NO: 24632 - DNA, 458 bp, Glycine max
  Peptide Sequence Number=SeqID_116317
aagttcctcttaaagcttgcggtaaccacatgacagtcttaaggcgacatggccccccactacaatggaaagttgaaaccctgaatcctgctattggtggaaaaggtgttgtccaaccatggtatgcttttcttgaagaaatggattttgatgatggagatgaaatctctatttacgataggacgagacagtttggtgctaagatgtgtcacctcagtagaaggaaaattgtggcttggttcaacctagggtggttttgttgcaactccactacgcacaacttaaatgctcggatgtggtttgatgagggaaaaacctttatggtttctacatatggtgccaatgttctaccccaacttgacattcggcctaaactgagagatgtgccaccagaaacctgcaatgtaaacttcaacaaccaagtcagtgagtggaatggaaaattaagtgaaatctga

SEQ ID NO: 24633 - DNA, 522 bp, Glycine max
  Peptide Sequence Number=SeqID_116318
atggttaggaccagaggattaggtcgtgccttaggtcacgttactggcagaggtgtgggcagaggagatcgtgatgattccaatgatgctccgcagcatcgatggcctatcgcatctgcacggaggcagcgagtctctgtcactgcggcgcatgatgagccagtggtccctgcaccagatattgaggctgatgtatttctggatgacccgatggcaccaattgatgtagaggacattgtggcagacattcctgcagacataggcgcagaggcttctgaggatgagcatgagggatttttgggtggtctgagcgacccattcgtgctgacccagtatgcggatcacgttgcttgcagcgtatggatgggagagttatcctctcatgggaggaaggtccatagtttaggcaggtctgtccctaccatagagggactcgttgctgggataggactaagtcctctgatcgtgtgttcagtagacaccagcaatcggggacttttgtcgtcgtttgtcgatcggtga

SEQ ID NO: 24634 - DNA, 486 bp, Glycine max
  Peptide Sequence Number=SeqID_116319
atggggtacccgccatatgtggtactaggtggcgatcggccgatggcgcaaatcaactctcccaccatccccagttgcccaccttcaactcagctcacgtactcccacatagcccttatcctcgttcctctcaacaccgggtccccatcaacccctccaagcttccacaatatccaagcaattcaatttccaaacatcatgaactaccctaaaccaagaaaacagggcagaggcagaaaactctgcccaaaacacattcacatattacaactttccttactcaaataccccaaagtctacccaaacctgaaatttgaagtcccacaacgtagaggtgcgcttcacgactccaaaaatggcttccttttgcaatttggagtagaaatggtgagcaaagtttggagctttaatggaggcttcaatggagaggaagaagaagagaaaagcaacgtgggagatgagggaaaagcttctgaattctgctga

SEQ ID NO: 24635 - DNA, 289 bp, Glycine max
  Peptide Sequence Number=SeqID_116320
ggaaacatcccttagcaccgccatacctcttaggcttgaggttattcctcaagtaaaggagttgttggatgagggtttggttcgcaagagcttaaatccttgtgctttgttggtgcctaaaatagggcttcccatggaccctaagagaataaaggtcattcctgagtggcctactccaccaagtgttgagggaagaatccctgagtttcaagaacctatggatttgagttcaaatccttttcaagtgggagggaatgattcaatcctaccccccaagggcattggatag

SEQ ID NO: 24636 - DNA, 684 bp, Glycine max
  Peptide Sequence Number=SeqID_116321
atggttaaggaggagtgtaaggaggtaagtgtctcctccaagaggttagctaagaaggaaaggcattttgaaataaagacaaatattaaagaaatttcccctcttagacaacctccacattttctcctttgtaaaaagacacttgttagcattgccacacctcttgggcttgagtttattcctcaagtaaaggagttgttggatgagggtttggttcgcaagagcttaaacccttgtgctttgttggtgcccaaaataggtattcttaggcaccaaatccctaaaataggtggtatgatgaatgttttgagtggtgcaaccctcttttgtaaaatcactcgagcacccaacatcttcatgatttgtgtacatagggactcattaggtagggattcccatgaacctaagagagtaaaggtcattcctgagtggcccactacaccaacaccactcattgagttggtgaggaaccatgttccttcatgggaagatgcacaagaaatgggttttcagaccttaccttacttcaacttcccaaacgccactaatatatatgttttagtttttttttttacacttgttgaggaaaaaagcccaaagtttcaagaacctcaagatttgaggtcaaattcttttcaagggggagggaatgatgcaatcctaccccacaagggcattggatag

SEQ ID NO: 24637 - DNA, 135 bp, Glycine max
  Peptide Sequence Number=SeqID_116322
atgtggtggggcattgacattatctgcgaatgcttgacatttgtggcacttcctcacatggacacaatgtcataccctaatttcgtccgggaacctttgctcgatgacgtgcgaccattctttggtcctcgtgag

SEQ ID NO: 24638 - DNA, 306 bp, Glycine max
  Peptide Sequence Number=SeqID_116323
atggcccgcaccaagaaaactgggcagatgacgtctgaggccgcaaaggaaatcactaagaagatcgtaagagcagtcagggtcacaggatcgtttgtcccccatggacgtcaggatgtcctgactgctgccattgggcgaccagaacaccctggccgtgtccgtgctgctggagccagtgtccccataaagaaatacttcggatcgaccccacgaacctcctgcagttcttcatccctctctcctgaagacctacaacaactgacccaacaaatcagggaccagctaaaggagtcgatcacataa

SEQ ID NO: 24639 - DNA, 1172 bp, Glycine max
  Peptide Sequence Number=SeqID_116324
atatacgaggtttagattggctcgccaagttaaaagtcgtcagcgaagagaattttgaagcaccggaagaagacaaagaagtccaagctctcaaaagcgagttaggaaaggcaaaacttgccaaggagaagttcaagttggccgctacacacgttcggaaggagtgtgccgggttacgggaagagaatgcaattaccgcaagagcccttgaacaagagaccaagagggctcgcaaggaagagtatggccggaacaaatttcgcggagctctatggggtagcaatagtgaactcaagttgcgaagggaagaaagggaccagtcgcgagcacatggcatggttttgaaagaggagttagttgcctgttcaaggtccaaaagaagcttgtctcagcgtttatgcgagacggagaccaacatgctagctatcatcgccaagtaccaagaagagttaggtctagccgcggcccacgagcataggattgcggacgaatatgcccaagtatacgcggaaaaagaggctagaggaagggtgatcgactctttacaccaagaggcaaccatgtggatggatcggtttgctcttaccttgaacgggagtcaagaacttccccgattgttagccaaggccaaggcgatggcagacacctactccgcccccgaagagattcatgggcttctcggctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaggtatgaaacagctcatggagaagaacgcggccactgccgccgctgacggggaagggacacactggggcacgatggcagccctcacctgggatacaaccgagcggcttacccttatggattgccgcccaactattcaccacccatcttgcaagaagatgcgggccacattgcttctcccgtccatgaaaaagagcctcctcagcagcccgacgaagtccataaagaccctcaagagtatgctcggagggatgtcgagttttatcccccgatccccgaagggccggcaccaggcacgttgccccaacccaacctcgcagcatcgccaatag

SEQ ID NO: 24640 - DNA, 483 bp, Glycine max
  Peptide Sequence Number=SeqID_116325
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatcactaataactactattctagatacatcatggcacgggattatttggactacaagacccaatcagattatagagcaagatttgataagtactag

SEQ ID NO: 24641 - DNA, 351 bp, Glycine max
  Peptide Sequence Number=SeqID_116326
atgaagaaaagattcacacacatagtcaaccaccttgcctccttaggaaaaaccttccctaatgaagatttaattaataaagttttgagatgcttaagtagggaatggaagcccaaggaacatgagatggaactccaacgactaaatcaaaatgaagaaaccgacaagaggaaattaagcatagcactcaaaacctcctcctcaatacaagaagaagatgaagaatcagaagatgaagaagacttctcactctttgtgaagaatgtgaatgtatgtatacatgattttgatgatgtcaaagaagaatctaacaaggctgcttcaaatgataagcatttgcttcaagaataa

SEQ ID NO: 24642 - DNA, 357 bp, Glycine max
  Peptide Sequence Number=SeqID_116327
atgtcctttcctttagaagactacacgccctcgccttcagagggccacacgccctcgccttcagaggactacacgtcctcaccttcagaggactacacgtcctcgccttcaaagggtcatgtaccctcaccttcagaggactgcacgtcctcgccttcaaaagtcatgtaccttcaccttagagggccacacgccctcgccttcaaaggactacacgtcctcaccttcagaggactacacgtccttgccttcaaagggtcatgtaccctcaccttcagaggattacacgtcctcgccttcaaagggtcatgtaccttcgcctcagagggccacacgccctcacctttagaggactag

SEQ ID NO: 24643 - DNA, 234 bp, Glycine max
  Peptide Sequence Number=SeqID_116328
atggagaattggcgaacagcactaggcaatcaattcgtggggctccaaactcgttggtggaggatgcatgaacgacaatcaattcatggggctcctaataaaaactcgttggtggaggacatgaacgacaatcaattcatggggctccgaataaaagtggagaatggagaattggcgaacagcgctaggcagtcaattcgcagggctccagactcgttggtggaggatgcatga

SEQ ID NO: 24644 - DNA, 207 bp, Glycine max
  Peptide Sequence Number=SeqID_116329
atgaaaaggaaaagaaggattcccgatcgaagatcggaagaaagtaaaaaggaaaagatcggaggaaaacagaatagttcccgatcaataaaggaaaccaagaaagagaatagaagggtcttcagaccagataaattttcggcgagtggttcttcctttgggattgccattcagggtcgctcccaactggcgatgtcgcgcgtgtaa

SEQ ID NO: 24645 - DNA, 309 bp, Glycine max
  Peptide Sequence Number=SeqID_116330
atgattatgaggggccaagacatttatagtagccaagatgaggctactacttcaccttcctatagtgaaagtgaagaagcaaaaggggaagaatctagtgaagaaatctacccccaagaagatggacaaccattagtggttaaagagaagtgcaaggaggtaagtgtctcctccaagagaaactttctgatgcaatcctaccccgcaagggcattggctagaagactccaagtagattgggctagagatccaaggcaaggccctagggttctcatgagccttagggtagatttcgagcccatgggctaa

SEQ ID NO: 24646 - DNA, 315 bp, Glycine max
  Peptide Sequence Number=SeqID_116331
acttggggttggactgagaacaagagagggtacatctcttgtggatcagttctagtgaagggtacatccactaggttcaaagagaacaagggagggttattccaagatcatgatgaagaccaagtaaacttttgtctcatgacaaaatctcatgataacaacaaagaagtatctgtaaggaagaagtggtacatcgacagtggatgttccaagcatatgacaggagatgtatccaaatttataatcatttccccaagtaaagtggacatgttacatacggcgacaacaatattagtaaaatctcaaaagatgtaa

SEQ ID NO: 24647 - DNA, 312 bp, Glycine max
  Peptide Sequence Number=SeqID_116332
atggagaattcaacgagaatgccttccttcaaggcaaaggcttcgccaaaaggagatcacatccatccatgtggagagaagctggcatctagccatacattaaaaatcaagttcaacaagttgaaggcatcaaaactcttattttctaccttctgcgcaatctgccaacggaggcaatgcaatgataaagtctggaacaatcttgaaactccaccaaacatcattgtctctctagcgaagcaattccactcagattggcttcatgctcgtaactatgctcatgatacaacaactaacagagacacccactag

SEQ ID NO: 24648 - DNA, 422 bp, Glycine max
  Peptide Sequence Number=SeqID_116333
tcctgtcggatttcgccacctctgacttgagcgtcgatttttgtgatgctcgtcagggggcggagcctatggaaaaacgccagcaacgcggcctttttacggttctggcttttgctggccttttgctcacatgttctttcgtgcgttatcccctgattctgtggataaccgtattaccgcctttgagtgagctgataccgctcgccgcagccgaacgaccgagcgcagcgactggcacgacaggtttcccgactggaaagcgggcagtgagcgcaacgcaattaatctatgaccatgattacgaattcgagctcggtacctaccctttccttatttgggtgtccctattggggcactcccaagacgctgcggcagtggttcttgtggggaggcactcggatcagaaaaaggggatcctctag

SEQ ID NO: 24649 - DNA, 180 bp, Glycine max
  Peptide Sequence Number=SeqID_116334
atgtgcacgtgtgcaatttttggtagccaagatgctttgagtatgcatgtagaagaatatcttgtgcgagtgaatgttcataaggaagaaatggccccgaggaagcttgcctcaaagaggtccagaaggataagcggccgaagaactagttccgctctcgagatgacagtcacgctttag

SEQ ID NO: 24650 - DNA, 747 bp, Glycine max
  Peptide Sequence Number=SeqID_116335
atggttaatatctcacctctctatgacgatgttagctggccggcagatgaaggtgttttaggcgtcgtgggcgtagccccctgggcaacactggatttttgccagcagctgtatggcctggttcaggcagataaagagtggcaatatccgcgacttattattgataataatagtaaaattcccagccgcgggcgtcatttgcaactgggtgaacgtgatccttctccctggattcacgcaactattacagaactcgctgctgcgggtgcgacggttgccgttgtgccttgtaataccgctcacctcctttggtcgcgctggagcaaggacgcagctattccggttattaatattattgatgccacacttgagcatattgcgcctcagggcaagcgggttgttgtgctcggttcgcaaatgttgtaccagagcaggctgtatcagaatgcgcttacgcaacagcacgccgagatcgtcaatgtagctgcatccacccaacagcttttgacacgctgcattaacgagataaaagcgacaaaaagcgtgtctgaactctcaatgcggcagttagcggacgccgtaagtagctggaagcaacagggcgctacgcacattattctggcttgcacagagttgagtttgttaaaacacagcgcgatctggcaggaaatgacgttaattgattcgagcgaagctctcgcgcgtgccgctttgcgcgccatatcatttcgccgcctgcgtgattaa

SEQ ID NO: 24651 - DNA, 210 bp, Glycine max
  Peptide Sequence Number=SeqID_116336
atgctgacatctctggaaagggtgcagatgaccacattggcctctgctcatcaatcacacttggggtcactgaatgacgaggtgcggataaccgtaaggtgtctccgcgggctaccagctcttgggtcaaaaagcggtgtggtcgacaaaagcgaggcttttgctcctacgtatcctcaaatgaggaactcagacctacgtagttcttga

SEQ ID NO: 24652 - DNA, 483 bp, Glycine max
  Peptide Sequence Number=SeqID_116337
atggaaatcatatcgaaacactttgagcagctcgatgtttgtggtaaagtacatttgaagtcaaagctgcaagaaattgcttatcctgatatgaactccatgtgtcctcttccagaaaaggtgaagaccaagggttctccaaaaaaaccactaaccaaacaacaaaagtcaacaaaacgcgatctgtcttattgggagtatgttgatgcgttacactctatgcaaaatatggatggtaattgtggttatcgggcaatagttgtgttattgggtatgggtgaagaatcatggtcattggtacgcaaccatctgcataaagaactgacaagctggtccgaagagtgtggaagcaatgtttttccaagtttatttttaatgatgccaaagactcaagtcaaggaatcaagagtcaagaatcaaagagtcgttcaatcaaagcaagtttcaagaatcaaagagtcgtcaatccagattcaagattaa

SEQ ID NO: 24653 - DNA, 436 bp, Glycine max
  Peptide Sequence Number=SeqID_116338
aatgttgctaagtagcaatgtcatctatgtctgtgtaagagtggtcatgttggtgcgcatgatccgcactcgtctctttgcagcggcacgggtgaaatcttgccccgggggtggcccaggacgtgtatcaaaggaaacgtgtactggtcccttaccgggagggtcaagtccaaggcgtgtagtccctctgaagttcgagggtacgtgtccctttcaaaggcgagggagtgtagtcctagatggtgaggacgtcagtcctctaaagccctacaaaggcgaaaggcacatgtaccctttagacggcgagggcgtgctagctcctctgaagttgaaggcgaggacttatagtcctctggaggtaagggcgtgcagccctctgatggtgaggacgtgtagtcctctcaaggcgaggacgtgtagtcctctgacggtgagg

SEQ ID NO: 24654 - DNA, 372 bp, Glycine max
  Peptide Sequence Number=SeqID_116339
ttgtttatggttttaatccactaactcctcttgatcttttgcctatgcctaatgtttctgtttttaagcataaagaagatgcagaatccgatttgaggacaaatccttctcaagaggtagagaatgatgaggacatgaccaagagcaagggcaaggatccacttgaaggacttggaggacctatgacaagggctagagcaaggaaagccaaggaagctcttcaacaagtgttgtccatactatttgaatacaagcccaagattcaaggagaaaagtccaaggttgtgagttttgtaataagggccccaattggcaacctaggcatcagccttttgggagaccaaatggtggctgacttgttggctgttgggg

SEQ ID NO: 24655 - DNA, 123 bp, Glycine max
  Peptide Sequence Number=SeqID_116340
ggtatggtggggctaatgatagagtcagcgcagccattactactaaaatgggagcaacttatcgagagccaaggaagtgccactgctgaagttaaagttgatgtaaatttggggatcctctag

SEQ ID NO: 24656 - DNA, 519 bp, Glycine max
  Peptide Sequence Number=SeqID_116341
atgtccaaatcttttgaatttgggatgaccggctctctcgatgagtcgatctcttgctttctcataaggatggaccctcggaggactgcatgtcctcaccttcagagggctacacgccctcgccatcagaggactgcgtgtcctcaccttcagagggctacacgccctcgccatcagaggactgcatgtcctcaccttcagagggttacacgccctcgccatcagaggactgcatgtcctcaccttcggctgcacgccctcaccttgagaggactacacgtcctcgccaacgtagggctacacgccctcacctttagaggactacacgtcctcgccaacagagggttgcacgccctcacctttagaggactacacatcctcgccttcagaggactccacgtcctcaccttgagaggactacacgtcctcgccttgagaggactacacatcctcgccttgagaggactacatgtcctcaccatcagagggctgcacgccctcacctccagaggactacat

SEQ ID NO: 24657 - DNA, 129 bp, Glycine max
  Peptide Sequence Number=SeqID_116342
atggtatggccacaccggtccgagatgaattggtggtgttgctacggaactaccaagacatcttcgcttggtcgtagcaagatatttgcttttcgagtcacgacgttgtacaacatcgattgctgttga

SEQ ID NO: 24658 - DNA, 357 bp, Glycine max
  Peptide Sequence Number=SeqID_116343
atgccgattccgtggcacgattcgactcactgctacttcattggtacatcccagaggaacccgcacgcacgcacgcttcagcagcctgtggagtggatactacctacacctactccatatcgactaatggagccagtccaagtgatagaggtgtcatcctctgaagaagatccagaggaggacccagaggagttacctcctgagcctgctgtggatgctcttgacttacctgaggatgatgaagacccactccttgatgttgattttccagaggatatcatgtcagcatctgaggcagactctatagaggatagcggccttggagggacagcgaatagtgaagactcttcatcatag

SEQ ID NO: 24659 - DNA, 303 bp, Glycine max
  Peptide Sequence Number=SeqID_116344
atggagaggaagagagagaggagacgccacttcaaggagaagatgagtctagaagaagctcaccaccataggaggccatggataagagcttggaggaagaaggagatgaatgaagggagagggagagaagagctagttcttaatgagggtgattcaccgggttctccttcaatcctcaccctcttcatttgccccagttttctcattcgtccaagcaggatgactaaatttgcctcttttcagacccacatcgatcctttcactggcaaagaccaaatccgcaaagctttgaaaggtgcgtag

SEQ ID NO: 24660 - DNA, 183 bp, Glycine max
  Peptide Sequence Number=SeqID_116345
atggtgctggtagcggctattggaaccgcattgacctccattatctcctttatgctcatcatggcctccatcattgtgaccatttgctctttcaaggcctccatgtcagccttgatctgttcttgtacctcctctatttcactgattactctagctctagcacgcatttggacatggggttga

SEQ ID NO: 24661 - DNA, 1512 bp, Glycine max
  Peptide Sequence Number=SeqID_116346
atggctgaactaagcgtcaataaaaccccttttcatgttcatcgctggctgccgggactgctgctgaccgccgccatcgccgcaggtgccgcgtggctggccagtcagccgtggctggctggcgcgggattcggcgcgctgacgctggccatcattatcggcatcgtgctgggtaatagcctgtatccccgcgttgcgaccccgtgcgacagtggtgtgctgctggccaaacagcgactgctgcgcctcggcatcattctttacggcttccgcatcaccgtgcagcagatcgccgatgtcggcgtcagcggcgtgctgattgatgtgctggtgctgagctcaacctttctgatcacctgcctgatcggcatccgtttactgaaaatggatcgcgaaaccgtgtggctgattggtgccggcagcagcatttgcggtgcggcagcggtgctggcaagtgaaccggtgatcaaagccgcaccgtcgaaagtggcggtcgcggtggccaccgtggtgctgtttggcaccgtcggcattgtgctgtacccgtttatctggacgctgctgccgcaggtcagcgcgcagcactttggcgtctttaccggctcgacgctacacgaagtggcgcaggtggtggcggctggccatgcaatgggcgcggaaacggagaacacggcggtcatcgccaagatgctgcgggtgatgatgctggcaccgtttctgctgatcctcggcagctggctgcagcgccagcccagccaccagcctggcgaatctgctgctggcgatggcgatggcggcgctgggcttaaccacccgtttcggcgcgctgaagcaggcgggcgtcaaaccgctgctgcttggtctgctgatgtttatctggctgattctcggcggcggcgcactgaatgtgctggtgcaacatttcatggcgtaagcgcatccgctatcatgggcgttttgcatcagcaatcgcccattcaggagagcggcatgaaatatatcggcgcacacgtaagcgcatccggcggcgtagaccaggcagtgatccgggcccatgaaatcgaagccacagcctttgcgctgttcactaaaaatcagcgccagtggaaagccgcgccgctctctgcgcaggtgatcgacgcttttaaaaccgcctgcgatcaatacaactttagcgccgcgcaaatcctgccgcacgacagctatctgattaacctcggtcacccggtgatggacgcgctggagaaatcgcgcgaggcgtttatcgatgagatgcagcgcgccgaacagcttggtctgacgctgctcaacttccatcccggcagccacctgcagcagattgatgaagatgcctgcctgaagcgcatcgccgagtcgatcaacattgcgctggataaaacccacaacgtggtagcggtgattgagaataccgccggccagggcagcaacctcggtttccgctttgaacacctcgcggcgattattgaccacgtcgaggataagcggatatga

SEQ ID NO: 24662 - DNA, 47 bp, Glycine max
  Peptide Sequence Number=SeqID_116347
gacggtttttcggaaaatgataactataatgagtatgcttcttcagg

SEQ ID NO: 24663 - DNA, 198 bp, Glycine max
  Peptide Sequence Number=SeqID_116348
atgtatagttgttttggtagtatttgtcgcaacctaccctttggcgggagggtgatgcgagggctcacgagtgcgtcttccaagaaaggaaaatgcgcagagtcgccaccaacgtttattcgaggaaaacgtcagaaaaaccaaaaagggaaggtattagcaccccacgcgcccatcacaaaggatgacaacctttaa

SEQ ID NO: 24664 - DNA, 398 bp, Glycine max
  Peptide Sequence Number=SeqID_116349
tctcacaagttatccagaactacgtaggtctaagttcctcattggaggatacgtaggagcaaaagcctcgcttttgtcgaccacaccgctttttgttaccatgacccaagaactggtagcccgcggagacaccttacggttatccgcacctcgtcatttagtgagcccaagtgtgattgatgagcaaaggccgatgtggtcatctgtgccctttccggagatgtcggcatcttccggtggagactttttcaagtctcacaaaggccaatatggtgattctgcacccttttgtcatccagaggcggcgggcccgatgacacgtagaggccaatgtggtcattctgcacccttttgtcatctagaggcggcgggcccgatgacacgcagaggccaatgtg

SEQ ID NO: 24665 - DNA, 387 bp, Glycine max
  Peptide Sequence Number=SeqID_116350
atggggtcctttggagaagctggttgggagtgggaattctcatggagaagaaatcttttcgacaatgagttgggaagagcttcagcctttattgaacaggctacaacactaagccctaatgcagctttgaaggattattgggtgtggggagctgacccaaagggaatctttactactagaactgcctatctttgtattaaaggtgatcagccaattggctacctaaatcgtggcttcagtcagctgtgggaaatcaaagtacctcctagagccctatcctttgcttggagactactttgggataggagatggcatctcctttgtatctttgtagcaaaaagaatacatcaaaccgctccatacaagcctatgggctatcctatatag

SEQ ID NO: 24666 - DNA, 123 bp, Glycine max
  Peptide Sequence Number=SeqID_116351
cacaagcaagaaaaacacagaatccacctttttcttattcttcacgccctggattacgtcctggatcgttagataggaatccgaagcatgaaaatttcgagaaagaaaatgatgcactaccgt

SEQ ID NO: 24667 - DNA, 204 bp, Glycine max
  Peptide Sequence Number=SeqID_116352
atggcgactaaaatgaagagatgcccatttgaagccttgggttcgatggccccgatcacgtctatgccccacattgagaatggccatggtgctgccaagacgttcaatggtgcaggtggagaattaacattatcaacgaaggtttaccatcctcctcctcctcttctatcaaacaacaatatgcaggctcaccactacatctga

SEQ ID NO: 24668 - DNA, 483 bp, Glycine max
  Peptide Sequence Number=SeqID_116353
atgaaggaaggcataggtcacatcttagacctcactcccatagtagagaaaaggaaagaaagcctcaagaggctaacattaacctcccatacttccatgggaaggacaatgtcacattacttctcaatgccccaccaagacatttatagtagccaagatgaggctactatttcaccttcctctagtgaaagtgaagaagcaaaaaaggaagaatctagtgaagaaatctacccccatgaagaaggacaacctttaatggttaaggaggagtgtaaggaggtaagtgtctcctccaagaggttagctaagaagaaaagtcattttgaaataaagacaaatattaaagaaacttcccctcttagacaacctccgcatcttctcctttgtaaaaagacacttgttagcactgccacacctcttgggcttgaggttattccccaagtaaaggagttgttggatgagggtttgggacccattaggtag

SEQ ID NO: 24669 - DNA, 498 bp, Glycine max
  Peptide Sequence Number=SeqID_116354
atggcctcatcaaactacttgttccccgaaggcaattcaattaataggcctcccatttttaatggagtgggttaccactattggaaaacccgcatacaaatcttcatagaggctatagatttaaaaatttgggaagccatagaaatagggccttatatttcgaccatggttgccagagatacaacaatagaaaagcctagcgaagataggagtgaggaagaaagaatactagtacaatataacttaaaagccaaaaacataattacatctgccttaggaatggatgaatactttagggaacatgaaatggagttgcaaagactaaatcaacatgaagaaaatgataagaagaagaagggaattgctcttaaagcctcatcttcaatccaagaagaactttgtctctttgtcaaaagattcaacaaatttcttaggatgagagaaactcaaagaacacaaaacttcaaacctaaaagaaggattgaagaatcatcttaa

SEQ ID NO: 24670 - DNA, 161 bp, Glycine max
  Peptide Sequence Number=SeqID_116355
gggcattgcacaggccgaagggcatcctcctataggcaaaagtgccgaaggggcaggcgttcaagcactggtcaatgaatggcaggggagaatggtcctttttggtaacctggttcagcctcctatagtcaatgcagaccctccaactgttctgcacccaa

SEQ ID NO: 24671 - DNA, 750 bp, Glycine max
  Peptide Sequence Number=SeqID_116356
atggattggatcctatctcaatttttcgttgctagacccgtagttaaaaaacccactttcttacgattacgaggttcattcgaatatgaaatccaatcttggaaacacagcataccacttttttttactacccaaggttttgatatatttcgaaatcgagaaatttcaagtggagcgggtgctatccgagaacaattggccgatctggatttgagaattcttatggattcttcgttgatagaatggaaagaattaggggaagagggatccccggacaatgaaaacgaatgggaagatcgaaaagttggaagaagaaagaattttttggttcgacgcatagaattagctaagcattttctccgaacaaatatagaaccagaatggatggttttatgtcttttaccagttcttcctcccgaattgagaccgattattcaaatcgatgggggtaaactaatgagctctgatattaatgaactatatagaagagttatctatcggaataatactcttatcgatttattaacaacaagtagatctactccaggagaattagtaatgtgtcaggagaaattggtacaagaagccgtggatacacttcttgataatggaatccgcggacaaccgatgagggacggtcataataaggtttacaaatcattttctgatataattgagggcaaagagggaagatttcgcgagactctacttgggaaacgggttgattattcgggtcgttctgtcattgtt

SEQ ID NO: 24672 - DNA, 477 bp, Glycine max
  Peptide Sequence Number=SeqID_116357
atggcctccaagaaacgtaagagcattggggcaaggccaactgctcaatatgatactagatggttccatttgcttgatgcttggaaccgttatacagataatgtcttggggaggaatattttgccagaaaggaaggttgatatataccacacggagttcgaagacttcaagacagagttggagaggcgtaatcttcacaagcgcctcaccaacttggctgataggactattgatcttgctttggtggaggatgttaatctctacagctctgagggtccttcaccaaagcaagccagagttagaggtcaccaggtgaagatagacgcagacagtctcaacacatttttagagactcctgtagtcctagaggagggggagacattacccacctactctaggtactgtaggttacccacaaactatagagagattgaggctgctctttgcataccaaggagggttcatcctgaatgctga

SEQ ID NO: 24673 - DNA, 478 bp, Glycine max
  Peptide Sequence Number=SeqID_116358
atgcatcattcgcatacatccatgcttttcattggttgcattgctcattgcattctttccttgaaaaaaaatgaacttaatcattgttaccaaaggaaagcacacgctttatggcgcccttaccgaacccgtgctagagctagagtaatcggtgaagtagaggaggtgcaagagtatatgaaggccggcatggaggccatgaaagagcaaatggccacaatgatggaggccatgatgagcatgaagaagataatgaaagccaatgcggttgcaattgccgctaccagcgctgttgctaaggtgaacccgatgcccccatctggcctcaaccaaatgaatcattcaacctcaaatatggtatgcaaagatatgggaagtacgggcggcccccattatgcgcaaattcaaaacaagcacgccttcccgccatatggcttacctcccaactatacactacccaatgtggcgtacactccta

SEQ ID NO: 24674 - DNA, 424 bp, Glycine max
  Peptide Sequence Number=SeqID_116359
gaagcggaagagcgcccaatacgcaaaccgcctctccccgcgcgttggccgattcattaatgcagctggcacgacaggtttcccgactggaaagcgggcagtgagcgcaacgcaattaatctatgaccatgattacgaattcgagctcggtacccgtaggagactagggcacgttattgctttgcaggagactagggcattgttgttgcattggttagggcaatcagaagcatgtagcaggtcacatgcattgcaggttaaaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 24675 - DNA, 855 bp, Glycine max
  Peptide Sequence Number=SeqID_116360
gtcgcaaaaaccacacggccgatctccggcaggctcgaagacttgctggctttcgatgacgtggaggaccctgcgggggaaccagatgtttctctgaccggtaaagacacctttccgcgcatccttgcggagccggctgagccgccccctccagctccggataaaaagccgaaaatccaccagccgatggaaaaaccggtcaagcgtaagctgacccgcggccgcctgccattggaaggacggatcgatctgcatggcatgttccagagcgaggcccacgccgtactgctcgattttctgttgcgcgcacatgagcggggtctaagacatgtgctggtcattaccggcaagggtcgatcgattggcagtgacggggctttgaaaagggcggtgcccatgtggttttccaaacccgaatatcgccacctgatttcctcctatgaggatgcgtcggccaatcacggcggcgatggcgcgctttatcttcgtgagcgcaagggtgtaacgcagaagcaaatggccgccgccatcggcgtctctccggcctacctttcagcgcttgagcatggcaagcgcggcaagccgagcttcgatctcctccagcgcattgccggatatttcaacatcatctgggacgaggccgaggaactgttcttccttgccggctcatccgacccgaaaggtggtgatcgacacagtcggcctgccgccgcaatatacggctttcgccaaccggttggcacgggatattcgcaagctgccgccgagtgtggtagaggaactgtcagccgtgctgcaaaaaagccgttcttgcgattgaaacccctctatcccctgctttatgcagcatcctga

SEQ ID NO: 24676 - DNA, 396 bp, Glycine max
  Peptide Sequence Number=SeqID_116361
atgggcccaattttgtcagagccgcagagacccttcgtgggaggatgtacaaaaaaaagcataggccatccagaagcaaaacactgccccccacgtgttgtctcgtggggtattcgttggagaagtaggtcacagggttcctttgttgcccatggacgtcaggatgtactgactgctgccattaggcaaccagaacaccctggtcatgtgcgttctgctggagctagtgtcatgatcaagaaatactttggaccgactccaaggacctcccacacatcttcctccatggctcctgaagacctggagcagctgatgcaaaaaattagggaccagctggaggagtcaatcacagaaaaagtgactcgacaactaatgttatccttcaaccaaatgtag

SEQ ID NO: 24677 - DNA, 543 bp, Glycine max
  Peptide Sequence Number=SeqID_116362
atgccgatctccccctgcggaagtatcagttggtctgtgccgtcccgacatagggatcgcacccacaagacacccagtggacccggaaaagtccaacagggccctggggtttccagctctggttacgggcctctatcagtcctacagggtgcccgtacccccccagcaaggtcacgtcatcatagggatcgcgcctgcaagacacccagtggacccgaagaagtccaacaggagtacctgtcacctccagcaagggcatcaggccccctactaatcgagctttcatcaagaagtactgcgtctccaggcaggcgcagggcgaaacaccgaagcagcctgaggatggccggcagcggcaacagacgcaccgccatcacctctagagttcacctcagctcatccgcaaaaaggttagagcgttgcctacgacacatggccgaccagcaggcgaccaagtccaaagccaaaggtaagcaaagtactaggtccatgacctacaagccatcatgcgtccagctcaagacgttaaagaagcgctactag

SEQ ID NO: 24678 - DNA, 216 bp, Glycine max
  Peptide Sequence Number=SeqID_116363
atggcgatacatttataccaaaacttctaccctcaatgcacacgcaattggttagccgtagacgagtcaagtaaaatccaatccacgaaatcatttgatctatggacagcatcggttgtggtaaaggccgtaatggcacagaggaatcattcccagggcatgacgccaatgggagccctccctcataagtctatccggatttttgttcaagaatga

SEQ ID NO: 24679 - DNA, 528 bp, Glycine max
  Peptide Sequence Number=SeqID_116364
atggatatgaatcttggatccttcatttctagtcagattatactcatggcccagcacgactcctcgaggctctgcttgcctgccctaatcactgctttatgtaaagcccggggagtccactctgattccttgacccatgagagattaagtcctaccattaatttggcatatattaagaagaactgttggaatattgatgatccaatagtaactttcaaaagacccagcaaggccaaggggaaaaggtctgaggctcccccatcttctgagctaggagaccaaccctcttcttctagagggggtggggcctctacagcccaagagcctgatactaaggagccaccaacaccagtagcagtagaggaagagactactctagatcagactccacagccatctccagcccctgcacatatacctaaggatgctgcaccagttgtggagcctaagcagcttatacaggattcatcagcagctccaacactagatcttaatgaagatcagccacaagaggagtcggacgtttaa

SEQ ID NO: 24680 - DNA, 336 bp, Glycine max
  Peptide Sequence Number=SeqID_116365
atgccatatgatcatgatgattcgatgccttatgaaaatgcgcttcttaagtttaattcaagacaaaaattcaagaatacaagatacaacatcaagaagatatctagtgttttaggaagggaattccaaattgaaactgcaaaagaacttgtaaagggattttgcaagatattggaactctcgagcgggttgtttggggactggacgtacgcacaagggtgtggccgaaccaggaattggaaaggaaaattggtgccatcccttgaagactttgagtcaagaagcaaggggccaaccaccttaagagctattggactaagaagcactccaaattga

SEQ ID NO: 24681 - DNA, 363 bp, Glycine max
  Peptide Sequence Number=SeqID_116366
atgtctccttcacctctaggatctcacaatcactcacaaactcatctcaagctctcagaacggcttccgcttcgaattcccgtctctgcagatcttcacacagcaaaatctctcagaactctctggaacttggacctttctctctcaagaaccttcgtgcatgctgagcttctcaagaaaagtggccttgttcgtgctcgtgcgcttagcgcagatctggatcgcttagcacgcataagtggattttggcttagcacgcttgttttgcttagcggattaactgaagtggtgcgcttagcaaacttgacaactcatcttcttctggattcttccttgcgcttagccactaaaggttgcgcttag

SEQ ID NO: 24682 - DNA, 123 bp, Glycine max
  Peptide Sequence Number=SeqID_116367
aaagaaacaccttttgctgaggctgctctcatggagatccctcaccaggttgtgtttcttcctgtgttggttggtgcatttcttaatcaatatttccaatctcttgttatatttggcatgcag

SEQ ID NO: 24683 - DNA, 940 bp, Glycine max
  Peptide Sequence Number=SeqID_116368
atggatttgggaattgtctctgaggcaaccttatcctggcttgagcaattgcaacaaacgtggagtgggacctctcaaattctcagccgagaagggaagcggtttttgcgtttgggaagctatgtcggttatctacaatccccgaatggcgagtcaattgaaattctgccaaaaaccacatttgaagcgccaacggaggtagaccctctacgtcagcttttacgccgaatgctaagcgcctctttaggtattacgccccgcgaggcgaaccaggcggcattgcaacgtagtgagcagcctctacatgaatggataatcagtgagtttttgcggcatcttgctgatttagtacgcaaaggactgcgtttcgattatcacctcatcgaggacgaacatagcgcgttcatccgcggtcaattgaatgtcactgcacaaatgagaatgcctccgggcagaggcactcattttcatgtgcgctatgcggagttctcccctcagcgcatcgaaaaccgcctgttacggacggctttggattgggcgcttaaaatgaccagacaagggcagagctggaggctagcaaattcacttagccaccaactggatggaatagagcctatttgtggcaatacgacacaatccttgaggcaatggagtgacggcaagtatctcctcgactatcgtgccataaaaccgtggtgccagctcattcttgagcaaatgaatccagattttcaacatggaccccatcagggaatttccctgttgttcccgatggagaggttatatgaaggctgggtaggatacggcctggctggagcgttgcatcatgatttcaaacttatagaacagactaagagccagtacatgttagagcatgtccctgttggtgaagagtcatatcaacgatggtttatgcttaaaccggactttcttatcaacg

SEQ ID NO: 24684 - DNA, 360 bp, Glycine max
  Peptide Sequence Number=SeqID_116369
atgggaaagttggatcatctagaggaaaggctcagggccatcgaaggaggatgcaactacaaaacatgtgcaaaaagggggcacgaatccttcaaagaatacgcccaaagtggagagacccggcagctcaagtggcacctcatgacgaaaatgatgacaatgatagtagacacattacccagtattctactatggaaaatggtgggttacactccttcaagctttgcggatttggtctttgtcggcgtaatgatcaaagtgggtctaaaaagaggcaaatctgatcattttgctttgataaatgcaaaaaaactggggcaagtgaagaggatgagaaggagggagaagcccatgctgtga

SEQ ID NO: 24685 - DNA, 316 bp, Glycine max
  Peptide Sequence Number=SeqID_116370
atggtcaaacagagctgcctcgcacatcttgatatgtattgggaccaggggagttcgaacgtgctggacgttcaggatgacaccgtcttcatcacaatcttgatagcaagttggcccggactagtttttgcacttcattcttcaggacatagcagttttcaacgtcgtgacctggggccccttggtggaaagcacagggcggggagtaagtcagcatatttcatcgggatcggatcaaagggtattgtggctgatggtattgctgtggaggatattgttgtggagggtattgttgtggagggtattgttgtggagg

SEQ ID NO: 24686 - DNA, 276 bp, Glycine max
  Peptide Sequence Number=SeqID_116371
atgtatgcaagtgctagggttttcagaagtcataatactcccctgttctgtcagactttggatcaacagtgccagcttctctttgacagggcttcaagaattccagttcaaattcttgacaatgttctgatggcatacttgctttgtggagaggagatgatgcgaggtcttgaccagtctgagttcttttggagtcccaggagaaataagtcagctcttggaaggactcattcggaaattctgagatctgttgggaaatgtcgaagactcgattga

SEQ ID NO: 24687 - DNA, 254 bp, Glycine max
  Peptide Sequence Number=SeqID_116372
gtctctgtcagttctacggagtgcctatcacctccagcaagggaatcaggccccctactaatcgagctttcatcaagaagtactgcgtccccaggcaggcgcagggcgaaacaccacagcagcctggggatggccggcagcgggcaacaggcgcaccgccatcacctcagctcatccacaaaaaggttagagcgttgcttacgaccaataggcgaccaagtccaaagccaaaggtaatagtaggacacacctag

SEQ ID NO: 24688 - DNA, 93 bp, Glycine max
  Peptide Sequence Number=SeqID_116373
aggatccccttattcttcacgccctggattacgtcctggatcgttagataggaatccgaagatgaaaagagaaacgaagaatatcactaccgt

SEQ ID NO: 24689 - DNA, 126 bp, Glycine max
  Peptide Sequence Number=SeqID_116374
atggaggccacaccattcatgctaggtgacctcggcatggtgtactatgggatgattccacattcctctaggtgcctagcaaaaggccctgggtgttgttcacctgaaccgtcatatctaccatag

SEQ ID NO: 24690 - DNA, 384 bp, Glycine max
  Peptide Sequence Number=SeqID_116375
atgggaacaaatcaaaccggcaagaggttttaccaagtcaaggttaaaagcctagataccaccagcatcaaggaattagggcggttgatggaacctctccaaatgcaagccttccgcaagacttacggaaagatcttagagttgaccatagcagaggtatccataggagccattgcatcactcacccaatactacgaccagcctttgagatgcttcacgttcggagacttccaattggggaagaaaaccatacctttcctccgggtgtctcccctctttgagcagaattgcaactgtggtcaaggattcagcaagaggtttggaccgcataaaacagactcgaaacggcatagcgggcctacgacggaagtacctagaagataa

SEQ ID NO: 24691 - DNA, 672 bp, Glycine max
  Peptide Sequence Number=SeqID_116376
atggctagaggaggaaccggtccgatgggttcgatgaggaggccatcacccagttgctatgtataccggggcaagattttgcccggactgctgccgggagacagcaacatcctgcccagcgaccataattccgacctccccctgccgaagtgtcagctggtgtacgccatcctgacgcggatgagcattcacgtggatcagctaatcgctgatgccatctacatatttgcaggtatggcgcccactaggcaccctctggacccggataagtccaacagggccctgggatttcccgccttgatcacaggactctgccagtcgttcggagtccctgtcgcacctagcaaggtgattcggccgcccatcacccgagcttttattgagaagtactgcacgcagagacaggtccagggtgatgcaccacaggccgcggacgcgctgccaccacatcaagctggtccagccagatcatttgacacggagcagtatttgcggcattttgttcgccagcaggcggccaaccacagggcacatcctgtaggaccagggctttacttctttccgtgccttactctggaccagttcagggtagaggtcgcatggcctggagattggcctgccgccctggcaggagaggcaccggctgatggaccagcagaggctcccgatgag

SEQ ID NO: 24692 - DNA, 537 bp, Glycine max
  Peptide Sequence Number=SeqID_116377
atgaaagataagagggatcaggaagaaaaactagaaaaccaaaagataaagaaggatagtaaggccttgtcttcaaaggccaaggggaaggaaaaagaggaaaaggattcttccaacaagattgttaagaaggaaaatcattttgcaacaaaatgtgatatcaaaagagcactctttcttaaacaatctttctaccttctcctatcaagggaaacatcccttagcactgccatacctcttgagcttgaggttattcctcaagtaaatgagttgttggataagggtttgattcataagagcttaaatccttatgttttgttggttcccaaaataggtattatgaggcaccaaatccctatgataggtggtatgatgaatgtgttgagtggtgcaaccctcttttgtaaaatcactcatccacccaacatcttcatgatttgtgtccatagggactcattaggtagggctttccatgaccctaagaaaataaaggtcattcctaagtggcctactccaccaagtataagggaaatttag

SEQ ID NO: 24693 - DNA, 664 bp, Glycine max
  Peptide Sequence Number=SeqID_116378
atgggagatttcatcagcagactctccttccccgaaaacaacgagactttttcaagtctcacaagttatccagaactacgtaggtctgaattcctcattgcaggatacgtaggagcaagagcctcgcttttgtcgaccacaccgccttttgttgccatgactcaagagctgatacgcggagataccttatggttattcgcaccctttttgtcatccagaggcggcgggcccgatgacaagcagagaccaaagaccaagtttggtcattctgcacccatgatacgcggagataccttatggttattcgcacccttttgtcatccagaggcggcaggcccgatgacaagcagagaccaagtttggtcattctgcacccatgatacgcggagataccttatggttattcgcacccttttgtcatccagaggcggcaggcccgatgacaagcagagaccaaagaccaagtttggtcattctgcacccatgatacgcggagataccttatggttattcgcacccttttgtcatccagaggcggcgggcccgatgacaagcagagaccaagtttggtcattctgcacccatgatacgcggagataccttatggttattcgcacccttttgtcatccagaggcggcgggcccgatgacaagcagagaccaa

SEQ ID NO: 24694 - DNA, 249 bp, Glycine max
  Peptide Sequence Number=SeqID_116379
atggatacctcagagccctacactggggcaatgaggggcatcgtgcctaaacctcaaaggactgcacgtcctcaccttcagaggactgcacgtcctcgccttcagaggactgcacgtcctcaccttcagagggttgcacgccctcgccttcagagggctacacgccctcaccttcagaggactacacgtcctcgccttcaaagggtcatgtaccttcatcttcagaggactacacgtccttgcctctag

SEQ ID NO: 24695 - DNA, 491 bp, Glycine max
  Peptide Sequence Number=SeqID_116380
atggtcactacagaggctgccaaggctgagacagggcagtgtcatggaccgtatgtacgcatgcaatgggtaggtgatatctatgagtatcgataccaggcaggacattggacaactgcagctcacgcgtttcttcttcatcttctgggttgcactcttttcgctaacaagagtgcaacccatgtacgccttgggagtagttgcgctgggcatatgtacgaccacctgaatgatgcttctatcagcaccagccgacagcttggtggttacatcacgctattgcagtgctggatatacaagcactttcccttagtggcggagtccactgctgatccgaactacgcgcctagaccgaccctagatttcggatttttgttggatcccatatggggagcaccaactgagagggtcatgcgacagtttggatacacccagaccattcctgctccgcccgccgattcatgggtgtcgtttgatgatatacacgacaa

SEQ ID NO: 24696 - DNA, 351 bp, Glycine max
  Peptide Sequence Number=SeqID_116381
atgttgtccttcagtcagatgcagtcccagtttcaatctcaaatgcaatcattgggacttgcactgcctcctgagcttgaggttggtccttcagctgctcgtgtcagcacaaaggagagttgtgttgatccctcaaggaataatccagacacgggtgactcagagaaatacgggttgtacattaaagaaaatcttccccacctggttgccctaggaagactttatgaggggtcgacaaccgttcacaacatccctttacgacatgatcaagtcaaggttggtgttgaggaagttagagatgcagatgctcccattcctgtacccactcaagaggttctgttagtgggatag

SEQ ID NO: 24697 - DNA, 321 bp, Glycine max
  Peptide Sequence Number=SeqID_116382
atggttacctcaaggaaaaccacgaaggtcagaccgggctttgttctcaaccgaaactgcaagacaagtttggaagattccgcttcggttgaagggttcctctcgatgtggggtttcaacggagaacaatggcgatgttttgtcaaagatcccaacggtcaaattgtggaaaagtgttctctaaagctccagaccaaatttcgagaagatccaacggttaaagaaggctggacagcgtttttaccgagaaagcttcatgtagcttccttgagaagcttcattaagaggcttccccaagaagctttctcgtggcttctttga

SEQ ID NO: 24698 - DNA, 598 bp, Glycine max
  Peptide Sequence Number=SeqID_116383
atgcaggaaaccgtgctacacaagattgtccgcgacaaagcgcaatggatcgcggcgcgacaacagcaacagcccctggccggctttcagaacgacatcgtaccgagcgaacgcagcttctatcacgcgctgcagggcacccggacggctttcattctcgaatgcaagaaggcctcgccttccaagggactgattcgcgagaactttgatccggtagagatcgccacggtgtataaagatttcgcctcggcgatctcggtgctgaccgacgagaaatacttccagggcagcttcgatttcctgccgctggtcagtaaaaccgtcagccagccggtgttgtgcaaagactttatcatcgatccgtatcagatttacctggcgcgctactatcaggccgacgccatcctgctgatgctgtcggtgttgaccgacgagcagtatcgccagctggcggcggtggcccacagcctgaatatgggcgtgctgaccgaagtgatcagcgaagaagagctgcagcgcgcgatcgcgctggaagcgcgcgtggtcggcatcaacaaccgcgatctgcgcgatctgagcatcgatctgaaccgcaccc

SEQ ID NO: 24699 - DNA, 147 bp, Glycine max
  Peptide Sequence Number=SeqID_116384
atgactaaagcaagtcaaaagggggtacggaaagagaagggaggagatgtttgccaccaagctcgcccaggtgagctaggttgcttcttcagaagcaaccgcttctggagaacatcctggaaggcccaagtgggcctgtgctattga

SEQ ID NO: 24700 - DNA, 936 bp, Glycine max
  Peptide Sequence Number=SeqID_116385
atggggacaaatctaaacggaaaaagattctatcaagtcaagattaagggcctggatgtcactagtcttaaggagttgggacggttgatgggacccctccaaaggcaagccttccgcaaagtgtacggaaagattttagatttgaccatagtggaggtatttacggaagccgctgtatccctcgcccaatactatgaccagccgttgagatgcttcacgtttggggacttccaaatagtaccgactgttgaagaatttgaggagattctaggatgccctcttgggggaagaaaaacgtatcttttctctgggtttcttcccaacttgagcaagattgcaactgtggtcggatattcggcaagagagtcggatcgtatgaagcaaactcgaaacggcgtagtaggcctaccgcggaaatacttggaaggcaaggcaagggatatggcgagtcaagaagagtgggtcccgtttgcggatatactagctttgctaatctttggggttgttctctttccaaacgtggacggtttggtggacctagccgcaattgatgctttccttgcatatcaccatagcaaggagagcccggtggtagctatcttggcggacttatttgatacatttgaccgaaggtgcgagaagaacagcgcacggattgtctgctatttacccgctctttgtgtgtggttggtttcgcacctattccaacaagacataaggcacccgtgtccgtttcaaagttatcgctcgtgcgtcgaaaagagaagagtagattgggaccaatacttggctgggataggaggcagcacaatcaactggtttcctcgatggaaggaaggaaaggagggagttctcttctcatgtggggactacccaaacattccgttgatagggacgaggggttgtattaactataatcccatacttgctatatga

SEQ ID NO: 24701 - DNA, 420 bp, Glycine max
  Peptide Sequence Number=SeqID_116386
atgcggagtgaatgccttatttgcaagattggaagacccgttgatatggtcttcatccacctaggggtactcacgaatgaatgtaggaaatatttgaatgtcgctcgggttagcaggagcaacaacattagaggaagggccaaagcagggagtgacaacgtaggcgaaatggaggtttgggccttggaaggatttggtgttgctcatattttacaagagatgcttacttataaatctgatcatattaaaactcgccaagaagtactcgggactacgatcattggaggaacaatacctaaacctacagatgctccagaatcttttagattgctagttcgagaattacgatctttagctatggaactgaatcatttccttgtatccgagaagaacttccggattcataggaaggaagcttaa

SEQ ID NO: 24702 - DNA, 145 bp, Glycine max
  Peptide Sequence Number=SeqID_116387
tgaccctgaggctttgggtaatgatcattccttgatatctaccatgctgatgcaatcctaccccgtaaaggcattggctagaagactccaagtagattgggctagagatccaaggaaaggccctagggttctcatgaaccttagg

SEQ ID NO: 24703 - DNA, 435 bp, Glycine max
  Peptide Sequence Number=SeqID_116388
atggcatccaataaaaggaaggctccttctacacctacccaggccaaatttgatagatctcagaagctattaccggagaggaatgtggtagtttattacactgagttcgacaagttcaaggaggaactcgagagaagacactgggatgagaagttgactgattttgccgatggctgtatagacattgctattgtgaaggaattttacatgaacctctatgaccccaaggataaatcaccgaagcaggtgagggtgagaggtcatctagtgaaatttgataaggatactttgaacacattcttgaagacccctgtagttctggaagagggggaaaatttgtgtacttattccatgtttgcactcctgagacctaatcctcaggagttggctgctaagctctgtatcccagggagaggattcaaggggatcctctag

SEQ ID NO: 24704 - DNA, 483 bp, Glycine max
  Peptide Sequence Number=SeqID_116389
atgacggtgaaaacctctgacacatgcagctcccggagacggtcacagcttgtctgtaagcggatgccgggagcagacaagcccgtcagggcgcgtcagcggatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcgactctagaggatccccgtcttggaatcagcacccttatccaaagtctatcaacatcgactataggatgcagagcaggggtaccgagctcgaattcgtaatcatggtcatagctgtttccttcgggaaacctgtcgtgccagctgcattaatgaatcggccaacgcgcggggagaggcggtttgcgtattgggcgctcttccgcttcctcgctcactga

SEQ ID NO: 24705 - DNA, 571 bp, Glycine max
  Peptide Sequence Number=SeqID_116390
tcagaggactacgcgcctcacatcagaggactacacgtcctcaccttcagaggactacgcgtcctcacttagaggactgcacgtcctcaccttcagaggactacatgtcctcactttcagagggctacacgccctcgccatcagaggactacatgtcctcaccttcgtagggctacacgccctcacctttagaggactacacgtcctcaccaacagagggctacacgccctcaccttgagaggactacacgtcctcaccatcagagggctgcacgccctcacctctagaggactacacgtcctcgccttgagaggtctacccgccctcgccttggggctacacgccctcgccaccagaggactgcatgtcctcaccttcgtagggctacatgccctcacctttagaggactacacgtcctcgccaacagagggctacacgccctcacctttggaggactacacgtcctcaccatcagaggactacacgtcctcaccatcagaggactacgcgccctcacatcagaggactacacgtcctcaccttcagaggactacgcgtcctcaccttag

SEQ ID NO: 24706 - DNA, 372 bp, Glycine max
  Peptide Sequence Number=SeqID_116391
atgacatcaggtggcattgaccctcctcgacccccgtcacatgactccagtgggaaagcgataattgcgaagaaaagacgatacatggttagactattaccacctcgagatagtctgacatcatctacccatccccgtcttctatgtctatcccagttaggcctcccgatgttggacctacaccatctccaccttggactgaagctagaccatcttcatctcatgttaatgcacgtgaaccatctccggtacctgcatccacaccatctccatcctctgttaatgcacgtggactgtcttcagtacctatatccacaccttccccatccccgcctgtttcatccatctaagttcaaaggtttaaatggatag

SEQ ID NO: 24707 - DNA, 465 bp, Glycine max
  Peptide Sequence Number=SeqID_116392
atgccgagagcagacaaagcccgtcagggcgcgtcagcgggtgttggcgggtgtcggggctggcttaactatgcggcatcagagcagattgtactgagagtgcgccatatgcggtgtgagataccgcacagatgcgtaaggagaaaatgccgcttcaggcgccattcgccattcaggctgcgcatgtgttgggaagggcgatcggtgcgggcctcttcgctattacgccagctggcgaaagggggatgtgctgcaaggcgattaagttgggtaacgccagggcacatggctacaccattgagctcccctccttttgagctagcactttccccgtctacgtccaagaggactagaaaagccacactacttagatcattgtctgctagacctgtgggtttggagagaccaccaattcatgtggatcctaacactaggaaagttgtcggtccatacaatgataactaa

SEQ ID NO: 24708 - DNA, 273 bp, Glycine max
  Peptide Sequence Number=SeqID_116393
atggcagggtttgccaccatgaaaggtgttggaaactatggtggggtgaatggcagtaatggtgaacttagtccatgcattaacggattgaagaatcagagtcgacctgcaggcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 24709 - DNA, 444 bp, Glycine max
  Peptide Sequence Number=SeqID_116394
atgatgtcttacgtatcaagtggtgaagaaaattatgaggattttctagataatataaatcatcagccattgaatgaatcttctattgaacataaccagtcccctaaagttacctcagaagttgtggccatcgctgaagatattaatgacatgtcatttattagtgcacaatcagctgaagtcacctcacatacaacagacaagggacatgatggtttattggaggaagatgaaaatggagcagagcaaaggaaagaatatgtcagaaaatctatctgcagtgtttgtgaatgctgggagaaggctgaaaatgaagtgacaagtttaaagaaccaagtccagacactgactctcagaaattcaatacttgaagatagagtcacccatctagacagtgcacttaaggagtgtgttaggcagctaagacaaacaaggtgtttataa

SEQ ID NO: 24710 - DNA, 690 bp, Glycine max
  Peptide Sequence Number=SeqID_116395
atgataacatcagacgacgaaggggaggttggcgatgttcttggcgacactaataccaatttctccttctcgccggagctgcccaaccagaaattgtctccgtctcgtacccaacgggcagaaggagggaccgatgtgcgctgttgtgatcttagacccctgggtaatatccaggcagacgttacacccaaagaaaagtcaaaaggcactgtagaaggtatgctgggctctagctttggtaagctcaacctaggggacagcttcgcaggaacagaagaggaagctgctaacaccaaagaggtaacctgctataataccctacatgatgatcgaaggcacaggaatcacatagagggaaagtatttgaatggtggagcgaaagtagctgctgaccagacctttatcggggaagaagagggacatgtcacgcagtctctctctccttctttatcggggcagattcaacaaggaattgggccaggttgcattaagggcccaatttcgactcaaggagggtgtaataaagaagacatccacccagttgagcttttgggggtgcaagctgtgcagaatcaaaaagagggtgggctaagtaatgatttaggcccaattttgaaaactgacgggtgccataagaaggaatccctacctgtaatccaatccataaagagactccagacagtattctaa

SEQ ID NO: 24711 - DNA, 198 bp, Glycine max
  Peptide Sequence Number=SeqID_116396
atggcttgcttggaccacaacaatatctggaagggagggacatgtctgttaagattgcttattggaggatcttcccatctcagccatgaaacttgggatcctcagcaaatgtatctgttgcttgagaagcataattggaaccctctcaggtgcagccactccctaagacctctcacgaggtgtaaggttgagtcatga

SEQ ID NO: 24712 - DNA, 417 bp, Glycine max
  Peptide Sequence Number=SeqID_116397
atgggtaaagcggaggaggtacaagagaagatgaaggccgacatggaggccatgaaagagcaaatggccacaatgatggaggccatgatgagcatgaagaagataatggaagccaatgcggttatagttgccgctactagcgctgtcgctaaggtgaacccgatgctcccatctagcctcaagcaaatgaatcatccaaacctcaaatatgccgacttcgagccttgcctcggatatgccgctgaagggcaagcagttggtggtgtacccctgcaaaacactttggagggccctcagtatcatccacaaccacaaccctcatgttccacaacaagtaaaaaccctcgtgctatggcagaaatggaaaagttggatcatttagaggaaaggctcagggccattgaggggatcctctag

SEQ ID NO: 24713 - DNA, 267 bp, Glycine max
  Peptide Sequence Number=SeqID_116398
atgaagtcagtgacatgcggggtaccgtatggttatccgcacctttgtcaacaagggacaaacgaggccgttgatgcgcagagactaacatcgtcttctgcaccttctgtcatcctgacccatgaagtcaggtttttactctcgtcgtccggagacattcaagcccaacgacgcacaagattcttatatgttgggtggggggcgatcaagttcgatggcgtggagaaatgtcctggatgtcccactttatcgctttcaagacactga

SEQ ID NO: 24714 - DNA, 301 bp, Glycine max
  Peptide Sequence Number=SeqID_116399
atggagacttttcaagtctcacgagttatccagaactacgtaggtcatgtgacgtgcacccttgtatcatccagaggcggcgggcccgatgatacgcggagataccttacggttatccgcacccttttgtcatccagaggcggcgggcccgatgacaagcagagaccaaaggcggcgggcccgatgacaagcagagaccaagtttggtcattctgcacccatgatacgcggagataccttatggttattcgcacccttttgtcatccagaggcggcgggcccgatgacaagcagagaccaa

SEQ ID NO: 24715 - DNA, 612 bp, Glycine max
  Peptide Sequence Number=SeqID_116400
atgacggctaacggtgcttcgcaagacagtcgctataactacagtgtgacgacgagttatagccaaagcaccgctgaaaatttaagtcaggtgagcgcctatggcagctataacagcgactatggccctcttagcctttccgcatcgtcagattcacaaaacagccaacagtactctgccagctacagtggcggagcgattattcacggtggcggagtcaccttcacgcccggcagcattggtgaaaatgacgcgctggcgctcattaaggccagtggcgcaaagggagcccatgtgagcaacagccgtggcgaaatcagtgactcagggtatgtcgtcatgccttatctctctgcataccgcgaaaatcggatcaccctggataccagtaccttaacggaggatgtcgccgttgaaaataacagcaccgtggaggtaccgcgtaatggcgcggtggtgatggttgattttaaaacgaatgagggtcgctcggcggtgctcgaattaacgcgttcagatagcgggtttattccgctgggcgcagacgtcatgaatgaaaagggagacatcattggaagcgtaggccaggcagggcaagcatatgtcaggggg

SEQ ID NO: 24716 - DNA, 2430 bp, Glycine max
  Peptide Sequence Number=SeqID_116401
atggcagttgctggcgtgcataatgtggctgtgcaatctactttcctaagggaatcccattctcaatcatctgggaggcagggagatggagggaggggaggcacccggtcgccttcggtcttgcaaatgtggcgagagattgaagatgagcaggtagtgagacaagttcaaggaagacctggggaggtacaaaggagtgatgggttggttgtggacctctcacaggaaaatgtgcccaatagcagcaaccagagagaagagcatatgatagaggatgcagttttgggtgagaatgattctgaaacctggtcgcaaagtcagaatgagttccatgatgaacaggaggaattaaacaattctagccgtgaaacctcctctgattttggagtagttgaaagggaaagagtgagacaaatattcagggaatggatgaatagtggttctaggggtcatgcatcgaataattcccaaggaaataattcaaggggagaatggctgggggaaactgagcaggaaagggtgagtgccacaagggagtgggtacagatgagtagccatcagagaggtgtttcttctggggaaaatagggaagagcaatcttctgaaaatggtacccaaattgaatgtgttcgtgatggatttgttgttaatcagaacgagggccaatgccaaactgagcatacacggaggggaatccgtaaattatggggtcgacaggtgtttcttgatatgcttaagaaggctgagatggaaagacaaagagaagtacaggaactgttggaccatcgagttgtatctcattttccccatcgcaatcgcattcaggccttgcttagaggcaggttcttgagaaatgatagatcgattgataataacaggtccacttccattgcagaaagtgaattaggcttattgagacaaaagcagactgtatcaggtctaagggaaggtttcgtttttagaaaggacaattttggttgtagtcatgcaaccagtaacacatctgatacctcatccgagaacgacattgatgttaatacaattgaagacactggagctagcagctcacaagcagtcccaactgtacattctcaacaatctgaacctaataacagggtaagtgatggacttgagatatcaggtgatcagatttgttcaaaaggaaccatttgtgagaatttagattggcaaggctctactgctcatgtggaagcaagagatttggaatcatctttcagtaccagggttgaaagaggagatggcactggaggaaatgttgatatgatgccaactgaaaatccttctaatgactgtagtcaactaagcttgcaaattgaagatacagagcatgacaatatgcatgagtttagtgaggtacatactgagcaatctcagcggggtgatataaataatgatgaaagcaatttttcaaatcatgatgatcgtgtatacagcaatattgttgatgatgtagatttgattgaatctattgctctggaaggggagcaacaggaagaagttattattgaaaatgacggaagtgactggcatcaaagtgtggatgatattcagctcagtagcacaacaaatgaatggccccaaaacatattgggaagtgaagatggagaaaattctcgtatgcaggagcaagaagtccctgaagtgtggcaagaggatggtggctttcaagaggctgtggaaatttggttaggaggaccttctgataatgaagtagctccagttggtagaattcatggattttattttcctgaagatgacaatgtatacagtgttgaactcagggaattgctaagtaggagaagtgtctcaaacctccttcgcagcagttttcgtgaaagtcttgatcaattaatacaatcatatgttgaaaggcaaggtcatgctcacgttgaatgggagctgcaagagacaaccccttcttctcccttggcagaacaagtatcggggcaacggagtaggggtccaattgttggtcctcaggctactgttaatagctcacttaacagacccttgccaccaacgcctccgcctcagcctttatgggatcggcactcacgtcatgacaattggtcccagagtgacataaataatcagcgcttaggaattgtgcgttcatttgccggacataactgcttttctttagctgatgagtgggatattgttaatgacttgagaattgacatggttaggctacaacaaaggatgaataatatgcagagaatgctggaggcctgtatggatatgcagcttgagttgcaacgctcaataagacaagaagtctctgcagccctaaatcgctcaactggttcatcagatgtgggcacatgtgcacatgttcaaaatgtgccaatgatttgctccaaagtagaagaaagtgtccaatgtgtcaagcaccagtggtggaagtga

SEQ ID NO: 24717 - DNA, 311 bp, Glycine max
  Peptide Sequence Number=SeqID_116402
gaaacagctatgaccatgattacgaattcgagctcggtacccgtttcacagtgaggatcactagcgaaaagcctgaatcttttgcgacccttatccactgcgatgcgttgagcttagtggggttggagtggccggtgccccactctgagtcggtgaaggtgttggtgccgaagtggaagaagagggccatgccacccagttgccattggagctggaaggtcgttgggaggggtaaaattggaagaggtgggggcttctggggacaagatgcagggacccagaaggagaatttgaattgggaaattgggtag

SEQ ID NO: 24718 - DNA, 339 bp, Glycine max
  Peptide Sequence Number=SeqID_116403
atggctgatagtaaaaaatgtgggtgtccctttaagttgcaagcgaaaccaatcttgggaggtgaaaggtggatggtgacgttaatatatgagaagattattattggtgatatgacaaagtcaatgatcaaaccaaagaatattcttctcactttgaaggagcacaatgtcaacagttttacaacaatgaaacaagtatacaatgcaagatatgcatatcgttcttctacaagagatagtaatagtgaaatgcaacaactaatgaaacttcttaaacacgatcagtatattcattggtatagactgaaggatgaagatgttgtatgtgatacattttga

SEQ ID NO: 24719 - DNA, 864 bp, Glycine max
  Peptide Sequence Number=SeqID_116404
atgaggaggaaaagatggccctccattgccaacagggccaccaaacccgccacattcacgaccaaagccacgaccacgtccacatcgaagaaacaaacccccataatcacgagcatcactagtcctatgtggaatcacatatgggggccgagaacatcggcacgtagacaatgggtagctacaactgttgttgtggatgttgagcatgtggatcatgctgctgacgaggttcatgaggagcctcgggagccagttacgaatcatgtaggtgctgatacaaagggttttctaggcggatcccatgatacatcaatgttgacgtcatatgttgatcatgtaatagccaagaaggtaaagaaatttggaaggtttgcacctgagattgaaggaataatggctactacaggattaagttatctgattacatgttcgttggagaatggtgacaagggacttttatctacttttgttgagaggtggcacaaggaaattagtagtttccatctaccgataggagagctgactataaccctcgatgatgtgacatccttattatatcttcccattacaagtgccttccataccttttatggtattgatgtagaggaagttattgacttgttagttgagttgcttgaagtcagtagacaaaaagaaaaagatgagattgagcaatgttacacactctttgctaacaagagtgtcatacacatcaatgtggtattcttggacgcattgcgtgacctcagccaatttgaaggctattcatggggagtggctgcactagtccatatgtatgacaatctgaatgttgcgttcaagcatatgataaaacatattgcaggatatatcactctgttatag

SEQ ID NO: 24720 - DNA, 3142 bp, Glycine max
  Peptide Sequence Number=SeqID_116405
tatggaagaaatacagtctcaatcagataattatagatcttcatcatcgtcggcaagcagcccggcaagtagggtgccatcaagtaactttttctacctgcgtaaacctggttcacttaggcatcccatctcttttgaggattcacctgagtgggaggatactgatattgatgctagagttgaggaaggaggtgactctattaatgttgcaacaacaccagcttctccctctctttcaaagctcaacagtgggtccctgccgtctccacatctaccggagggtgcagttattccgcggaaaattgctggggcttcagttgcctggaaagatttgaccattacgataaagggaaaaaggaagtactctgataaggttattaagagttcaactggttatgcgatacctgggaccatgactgtaattatggggcctgctaaatcagggaaatctaccttattacgagccattgcaggaagattgcatccttctgccaggatgtatggtgaagtgtttgtgaatggagcaaaatcacaaatgccctatggttcatattgctattgcattgtggaattccttggaaccgcgatcgcaactccgtccactattgcggctgctatgggtgttgtggttgcagtggctgcagatgcagcatgcatcctgcatcctcttggttatgtggagagagaaactactctgattggatccctcactgtgcgggagtttctgtattattcagctcttcttcagcttcctggtttcttttgtcagaaaaagagtgtggtagaggatgctatacatgcaatgtctttaggtgatcatgcaaataaacttataggtggacattgttatatgaaaggacttcctagtggagagagaaggcttgttagcattgccagggagcttgtgatgagaccgcgtattttatttatagacgaacctctttatcatttggacagtgtctcggcacttttaatgatggttacattgaagagacttgcaagcactggttacactctcatagtgaccatctatcagagcagcacagaagtctttggcctttttgaccacatatgtttactttcaaatggaaataccctcttctttggagaaacattagcttgcttgcagcacttctcaaatgctggatttccttgcccaatcatgcaaagtccttctgatcactttctacgtgcaattaatacagattttgacaggataattgcaatgtgtaaaaactggcaggatgacaatggagatttttcttctgtgaacatggacactgctgttgctatacgcactcttgaagcaacttataagtcatcagcggatgcagctgctgttgaaactatgattctgaaacttactgagaagatgattttgttgaagtatgggacttgcacttctcatgatagtgttaggaaagaggatcaagttagaactgttagacagttatttctgttagaggaagttgggctgagaagtataaagggatccttgctaggacaaggaggggaaggtccagttctcaaaagcaaaggtaaagctagcaatgccacgcggatagcagtttcgacatggagatcattattagttgtgtcaagggaatggaaatattactggctgcatcttattctttacatgcttctcacgctgtgtattggtactgtattttctggtctggggcattctctgtcttctgttgtgctcttgtccagcatcccatttctttttctcatctccatttcttcgagtctagtcttctacttccttgttgggctggaagatcaattcagcttgttaatgtactttgtgctgaattttttcatgactttgttggtgaatgaaggacttatgctagttgtggctactttgtggcaagatgtgttttggagtgtcttgacactgttgtgcatacatgtggccatgatgctttcggcaggctattttagagttcgaaatgctttgcctggacccgtgtggatgtatccaatgtcgtatatagcctttcatacttactctattcaggggctattggagaatgagtacctaggaacctcctttgcagtggggcaggaatccgtgtgttgcgttgttgttctgcttcactgcatgcgtgatctgatcctcttcccgcgtaaaacccgattctggtggcgtccttccatgacgacgtcgtttctgaacggcgagagagcggtggtggttttcttcatctgcagaatcctctactccctcactttctctctcctctcccatggcctcgctctctctctcctcgccctcgcctccttctccctcgatatctccttcgattcttccaattccccttctcttttccgcaccaggccaggtgcttcttctggaattctgctcggcgctgtcactctcccttctcttcttctctccaaattggtccaactgtcgcgggaattctcactcgctcaacttcatcttgaagagattcaatatctgacattgcaatactgggccacatctgccagcgcctgcagcgtcgttttgttcctcgccttcgctcgacgacgccgtgccccttcatccccttctcattggggtgtgaggtttagcttatgctccattttctttcaagctctagtttctgttgctgcccttgctaccacatctcaaattgggttgcacccagcactgaagctaatgtgggccctttgtcatggattggcatctgtgaaactaattcagcatttcctcagaacttttccctcatgtgcttccattggcgaaacatttttggtgacttccggtattgttctctattttggtgacatgttgttgcttactattaaaaagctacatggactattgatgtcatcagagttagttactgcagaatatgaaataagtagaagtgagatcagcattataattcaggggcttgtgcttggtcttctgctatatccaatagctttgaaatacattctccaaatatgggagtggtttataagtacagcttctgctgaagcaagaagatactgtgagattgggagatctcttatgtttgttgcttcccttggaattgtcctgattttgattgtaccatcatggatgcagttcgtgcatgagtttcgaatgcatccttttttctggtatctcatcaatatctga

SEQ ID NO: 24721 - DNA, 302 bp, Glycine max
  Peptide Sequence Number=SeqID_116406
atgaacagaaacccaaggtcaacaaagcgtgatccatcttactgggagtatgtagatgcttttcattctgtgcaaaatagcaattcgtcagtgaggcgtagtgcatcatcttctgaccagcccaatccaagaaaggatttcattgacaacattgtggatgtcaaacctgacggaaactgtggatatcggtcggttctctttggtggcatggacaaatttgaggaattaaggatgtcactacttattgatgggttaaccaagtggatggatataactgacatgggatatgtcattgcatcaag

SEQ ID NO: 24722 - DNA, 3381 bp, Glycine max
  Peptide Sequence Number=SeqID_116407
atggagccacgaaacccttctccgtcgccgtcaccggttcgagtcctcattcgccctccgtcgtcttcgtcttcgtctccgtcctcctcctccgaccatccctctccggcaccggcgccgtcgctccctcgctcctccgacggcgtggtggtcgtcggcttcatcgcacggcggcacgatgattccgcgcagctcctcaaccgcgtcatcgactccaacgtcttcgcctccggcaacctcgacacgccgctgctcgtcgacgatgaggaggcgagggagtggttcgagcggaggagaatcagctactttcacgaccacgacaaggggattttgttccttcagttctcttccactcgctgtccggtgaatcacgccgccgccgcgccgtcgggattcgattccgccgtcgaagagcacgagttcggcgacctccagggaatgcttttcatgttctctgggtcacattttggtactgggattttaaggaattttcgtgtgctgcaagcagccaagcatgctatggctccctttgttagataccagactatggggcctttaccgtctagatcgcatccttcaccgtcctcccaacctgtttcgtcggtgaacaattcttcacctggtagaggtggtggtaacttgggtcgcaatatgtcggccatatctctcatgtcaggtttaggttcttatgcttctttgtttccaggacagtgcatacctgttacactgtttgtattcatcgatgatttctccagtttgtcgaattccagtgcaaatggggaggaatctttggatggctcttcgcttaaccagtcttctagtttgagtagtgcagccaaagaaaacttgcctgctaaaggttctggttcggtagttgtgctggcacgccctgcaagtcgatctgaaggtggatttaggaagaaactacagttgtctcttgaagcacaaattcgctttctggttaagaaatgtcggacattatcaggttctgaaataactcattcgggtgtgagaactgggggtacctcaacttctgcacctttgttttcacttgatgcatcaaggacagttgtcttgttggatcggtcttcaaatcaaagaggtgtgtctcttgagtttgccagtggacttattgatgatgtcttaaatgggaaagcaacttcagattcccttttgcttgaaagccacagtcaaagtgcgagcaaagaagatttaatatcagttaaggagtttgtttacaggcaatctgatattttgagagggagaggggggctaattaataccagcagtggctcagctgcaggtgctggtatggttgctgtagcagcagctgcagctgctgcctcagctgcatctgggaaaacatttactactcctgatcttcctaatcttgaagtttggtcatcttctagtcgtcatatcttgagtggagttctctgtgcaaaaggtggttgtttggatgaatttgaaattatcaaaagaaaacctcgtccaaggaatactgtttcatcaacagtggaaggatcttcaaagagtacaaatccttttgatgttgcagtatcttggttacaaagtggtagagggttgaacactaaattctcaactttgtggtgccaaagagccattccagccgcaaaggagatttatttgaaagatttgcctgcttgttatcctacttcacaacatgaagcccatttagataaggctttgcatgcatttcgctcaatggtaaaaggaccagcagtggaactatttgcaaaaaagttggaagaggaatgcacttccatatggaaatcagaaaggcaactatgtgatgctgttagtttgacaggaaaaccatgcatgcaccaaaggcatgatgttgaaaccagtaattcagacttgggagccccgcccatgccacattcaagtggctattctttccttcatgcttgtgcttgtggtcgttcccagcagttatgtcctgatccctttgattttgaatcatctgatgctagttgcttctctgactgtgataagctacttcctgcagtcaaattaacagaaatagaagttgcaggacctgttcaatcttctgcttggagtttgcttcgtattgggggttcaaaatactatgaatcttctaaaggcctacttcaaagtggattttgtgccactgagaaatttcttttgaaatggactatatacctagagaaaaagaaaataccaaatggttctacagagggtatagtgaagcaagtggaagaccaaggaacatctttagatatattgaaggctgatgataaaaagataagttttggatcaggtttccctattttcaaaatgagaaaacctttttctgaggttgttgctggatcagcggctggtgattcaggattccctcctcttcaacaaaggaaattgcttgcaccaggttcagaaaagggtatgaaacaaagcaggtcaagtagtcagactgttgaacaggttagtgcagtcattgatcatgaaatatctcaaaaatctcaacatgtatcatctactcagggacctcttgatgttaatgccaataatatctgtagggatggtgatccttttttgaggattggtagcaatgtagtacctctattcttgaatggtggtgaaatgaacatatcacattctttaaagcatgctatagtatatgttggatttgagcatgaatgcccctgtggacaccgttttctgttgaatgcagaacatctcaccgaagttggatctgcatactcattatctgaagaatctcatatatcttctatggagcctgctggcagaaatcaggcatttcatactaaagtaagcaagaatgcttcctggaaccaagttcatcgaagctcaaatgaaattctttctgcaatctcaaataaggaaagagatgtgaacaaatctaatcaaatgattcctaatagtgatatgaattcagatggggaccttcaagctattagcatggatggtgatgatcttgcattctccatgctgaatcaaaacttgcctatctacatgatgtgtcctcactgcaagcattctaggaataataaggatacaccaaaggtgacacctgcatttccagtgatactagcaacatgccctgttgtacaatttgagacgtcatgcttgcctccctcagttccagatcgtgaacaaaaattgcagtttagccttggatgtgaagtgatcttgccaccagagagcttccttacacttaaattaccatttgtgtatggcgtgcagcttgaagatggaaacaagcatcctcttaacccctttgaacagcagcctgaaatgactgcctggattaccaagggcacagtacttcagatcttgtccaagggaaacaatgatgagggatatcaaacacagtaa

SEQ ID NO: 24723 - DNA, 3021 bp, Glycine max
  Peptide Sequence Number=SeqID_116408
atggcgaagggcgccgattccgacgagttcgttgtgctttctagggttcgtacgggtctcaagagggagttcgcattcgccatgaaggcccaatctgagatctgcggcggctctctgggccgaacgcgggccagcaagaaccgggtcgaggccccggttcagcccccctcggcccggaaaaggtcgaggaagtccgaggaggcgaaaaccttggaggatgctatgagcgaggaagaggtcaagagcgacgtggtggatcttcagagcgatgatgaacctaagaataataatcacgtgggagaatcagaatccgcggcaatgcaggtttgtgaggaggaacccaagagtgacgtggtgctagagactcttatcagcgaagagcaaccgaagatgttagaacctgaatctgttatcagcgaagaggaaccgaaggtgttggatgatgttatcaatgaagaggaagcgattgtggccgagacgttgaaggaacaggaacctattgtgcctgagacattgaaggaagaggttgtggatgagatggcagaacaacccctttgtatagaggaatcggaggagaaagattctaatggggttgccctagctttggttaatgatggtgctaaggggaagaagagcatgaagaagcggttggagagacctcaatcggagagaaggtttacgcggtcggcattgaaggtaaaatccgaggaaacaaacgatggggaacatgttggtgtggctggaattagtgatggtgttaagagggaaactgaagctggggcttcgttggtaatgactactcctagttcggtgaagttttcgaatagagggaaactgaagaagtttcctgccaagttgagggatcttctggcaacagggattcttgaggggctgccagtgatgtacatgaagggagtgaaggcaggttggaaagacggggaaaaggggcttcaaggagtgattcaagactctggtgttttgtgcttttgtaagatttgtaagggggttgaggttgtcacacccactgtgtttgagctgcatgctggcagtgcaaacaagcggccccctgagtatatttacatccatgatgggaatagtggaaaaaccctccgtgatgtcatgaatgcctgctgctgttgcgattttccattggagtccatggatgaggctgtccaaaagctccttggtgacttcactatgaagaaatcttccatctgtttgaactgcagaggggcatgcaagggtgtgtcaaggctagtatgtgattcatgcttagtaagccccgctcaaacagccgtggctagcaacaaaggaatttcacaaccagttcaacccagatcaccagaaccagttgtgattcaaaaatcattagacaatgaagtgcagccaaattcattacacaatgaggtgcagccaaataaattagacactgggatgcagccaaactcattagacaatggcatggagccagattcactaaacaatagtatgaagccaaaatcgtttagcaatgggatgaagcacagtgcatctcgtggtaagagtcagggaagactaactaggaaggatttgcgcttgcataagttggtatttgaagcagatgttttgccagatggaactgaactagcctactatgctcatggacagaaactgttggttggttacaaaaagggatatggaattttttgtacctgctgcaatgagcaggtcagtgcctctcagtttgaagctcatgctggctgggcatctcgacgcaaaccttacctgcacatatacacatctaatggaatctctctccatgagttgtccatctctttatcaaaagatcataggaggttttccaacaatgacaatgatgatctctgcatcatatgtgaagatggaggggatcttctgtgttgtgatggatgccctagagcttttcacataggtgaaattgttaagttgcatgaagtgaacatgacaagcaaacttgatacaaaaacagaaccagcaactggatggcaagttcccactgtttcatattttacaatttcagattgtgtccctttaccatgcattcctagtggtacttggtattgtaagtattgccagaatgttttccagaaagacaggcatgggcaacacgaggtgaatgctctggcagctgcaggaaggattgcaggccctgatattttggaactgatgaacaaaagatgcattcgtgttgtcagaactttagaagttgaccatggtggatgtgccttgtgcagtcgtcccaatttcagtaaaagctttggtcctcagacagtaattatttgtgatcagtgtgagaaagaatatcatgttggatgtttgaaggatcataacatggagaacctagaggaattgcctgttggaaattggttctgtagtggaaattgcagtcaaattcatactgctctgatggatctggtggcttctaaggagaaggatgtcccagatccccttctaaatttgattaaaaagaagcatgaagagaaaagtttagacattggagctggtcttgatgttaaatggagggttataaactggaagttagattccgattctgttgaaactaggaaattgctttcaaaagctgttgccattttccatgagaggtttgatcctatagttgattcaacatctggccgtgatttcattcctgcaatgttatttgggaacattcgtggtcaggattttagtggaatatactgtgcagtgcttactgtcaatggggatatcgtgtctgctggagtatttcgtgtctttgggttagaaatagctgagcttccattggtggcgacaactgctgatcatcaaggacagacgctacttggatctttaaatgtgaaaaaccttgtcctaccagctgctgatgaagctgaatcaatatggactggtaaatttggctttacaaagctacctcaagatgagataaacaaatataagaaattttatcgcatgatgatatttcaagggacctcagtgttacagaagcctgttgctgaagcactctga

SEQ ID NO: 24724 - DNA, 276 bp, Glycine max
  Peptide Sequence Number=SeqID_116409
atgtggatcccctacatgttaccaaacacctacataatatcagtattaccacctaatattttacgaagtccattgatcgatcatttagaagaatgcggagggggtaatgttaattcctttcaggatcctgtttgtgggagtgcacattgtgcattggcatcctattggagcaagaagctagggaagtgtgatttcaatgcttatcagattacatctgagcaggcatctcccagagggggagttctcaatattcatcttgacgagcagatccaatga

SEQ ID NO: 24725 - DNA, 1224 bp, Glycine max
  Peptide Sequence Number=SeqID_116410
atgagtgtggacccttcatcctctctttcaagacatgtcaagtggaagatggcccgcacaaagcgatatggccaaatgacctctacagcggcacaagaaatatcagacaaaattatactcccattttatgaattaatgttgaatccacttcagtttcaggccaaaagaagaaaaggtctagtagctggtgtctcactaagcgaggcatatgggcttaccaaatactcggttctaaccattttatattacttgcgcgacttggtacactttccgattagtttgccgaagagcgaacaacaggccttacgtggctccaacacttcctcttcatcaatcaccaaacaacaattggctaaaatcatcaataacctcaaggaagagtggaggaaagaagtagaagaggaaaacaagaaccttcaggaagcatggaggaggaaagtagaagaggaaaataaacacagtttggagataattaaacaagaattgaaagaagcaataaaaatagagttaacccaaattgcatcgcagcactcaccccccgttgaggcgccaaatatacaagtattagctacacgtgtgagcactaaggggagttgtgttggagcttatacaaatccattaggtaaagagccttctgatgttcatgtggctactgtggggctgtacgtagttggtgaccagtgtacacggctagtggccttgggaaaagtgtatgataatgcatccatcatacacaatgtcccttgttcagatgatgtggttagggattcacacatgcgtggaatgggcaatgcagtggatggagttgatccgttgggagaattggttaataacttgtttgatgtttaccaaaagccaattgagttgtcgtgggatgggacaaaatttgggatacctaatgtaaagggtgactttttcatcacacatgcagatgttatggttcattgtatggtttccttgagcctcagtctatacacaacgcaaaaagatagacatcaagaatgtcaacattacattgaaacatgggtcaaggaatcatattggcaagtgtacttaggaccttacttgaatcatgcaatgaagacattaaccactagtttggaaggaaaggctcatcaacctgtgcctcactggattgaaccaaagtggttttatgatggaatagcgttagacagtgagaccatcacaacacttcgcaagaaatgggcagcatattttctataa

SEQ ID NO: 24726 - DNA, 822 bp, Glycine max
  Peptide Sequence Number=SeqID_116411
atggttatggacgaaattgatgttcaaaccggtcttgttgtgaatgtaatcgaggccgtgagcgagatctgtggcgacctgcattcgcgacatccacgtggagaggacggtgaagtgcacgttgtttttgttgcggaggcagtcggagagggtggcgccgttgttgacgaagtcgtagacgaggtagatgtggtcgccggagacggaggcgccgaggagcttgatgatgctgacgtggtggctgcggcagacgacggagaggagttgctggagctgtggagtttggagcttgcggcggaacttgcgctggaagacaatgacatcggcgccgcggagggtgcagcgccagcaaggggtggaggaggagtggcgtttggcgaggaagttgttggtggcggcacagatttcggagaagtcatagatgtgagggttttcggggagagtgtcacggagggagaggcgatagccggtggagccgctgtagggtgcgctgttgctgctgtaggaggtggaggggttgtcggagaaagagatgaaaacgcgaaactggtcaaatacaggctaaaggcccaagtggagaaggacgaaggcccaagtggagaaggacaaagcccccgagtggagaaggatgaaggcccaaacttatcttccttcaccggaagtggcgtctaccctgacttatcttccttaaccggaagtggcgtctacccagacttatcttccttcactggaagtggcgtctaccatgacttatcttccttcactggaagtggcgtcatccaaaccttcgtagcctgtatcaaacgatccgctcctactcag

SEQ ID NO: 24727 - DNA, 594 bp, Glycine max
  Peptide Sequence Number=SeqID_116412
atggcacatgcacaacccgaaccaattgatggctccttgttgcgcttacaagacaaccatatctcaaatcaagtgttggaagaccaagagagaatgattcatcagaggtataattttgtttgggcttttatccacttggattggatagatagtcgggtcaaaaatataatcactttagctggtttctatcatgttataaatgatggaaaagttaatattaaccagcatttgttgggtttgaagattgatggattgtcggtaaccgatatcatcactgatgatcaacttcctgttgatgctaatgatgttttcattgcacaacatgttagagctcatatcatgatgctcataggcaattatttgaggccagatacattagtattagcatcccttttccgagctctagatcgggttgtgaagctggaccaaatagaaattgatggatgtcatgaaaatgaggaggatgatgatgatggtgatgatgatgatgacaacggtggtgatcatgttcttcaacaacaacacacaattatacgtgagcatcctagaacaagaggaggtagagatcgtagaccaataggacaacaaacatag

SEQ ID NO: 24728 - DNA, 282 bp, Glycine max
  Peptide Sequence Number=SeqID_116413
atgcagagaatgaaagtgaataggaggatggaaagttacgagttactcgctcagcgggtcctcagagcgaatcatggcgcgttcaatgaattgagtgggaatgagtgcaatggaggggggtgcttagcacatgagcacgctcagtgcaatttccatcacaaagaagcttttaggcttaacgagctagaggtgctcatcccaatcagagtgaaggttcacacaaagagacgtttttgcactcaatgcattggcacgctgagtaaggagactttggctgcttag

SEQ ID NO: 24729 - DNA, 441 bp, Glycine max
  Peptide Sequence Number=SeqID_116414
atgtgcaggacatctgaagagttgaaatcacaagacacagaggaatcatcatcctcagggaatccaaaatgtgttccacagtcagttaaggcttcattgaccaagcagctaccaagtgaatgcatgagatctcctgtttctgatggatcaagaaattccatggataaaactgatggttcaggcatatccccagtaccatctaacggtagcagcaaaagaatcacggaaccttcatcagggtttgggagaaagcaatctaagagggtagactcatttagagaagaagagagggacttaggagtgtcttcttacagttttcagtcattgattgatgagtttgattttaactctacaggcttgcttcaggagctcggattattattcactgcatggggggctagaagtgcatgtggtcccaatggtccattactcatcctgtaa

SEQ ID NO: 24730 - DNA, 400 bp, Glycine max
  Peptide Sequence Number=SeqID_116415
ggacggcgattatgatggtgacaatagtggtagtgtcagtgtcgatgacgacaatggcgaaggtaaaatagtggtagcgacgatggtggaatgtggtggtggtggaatggtggtggcaacggccacatcgatggtaggatggaatagtggtagtgacaaagacgacaatggtggtggtggcagtaacaatggttgtagcagtggtggggacaatgacagtggcatgaatggtggtggtggtggtggtatgatgatggtgagggaattaggtcaagaaatgaagttgggattgcatcacttaagcatgacttgttgtgcgcttaagcgaagggaggaagtaattgttgaaggagtcgacatgccttgctcaaacacatcacttgagcaaggggaaccttga

SEQ ID NO: 24731 - DNA, 915 bp, Glycine max
  Peptide Sequence Number=SeqID_116416
atgttaaatgagctttatgtggaaggggtatgggaggatgatccttataggctgaaagatgaagtgttcaagttttatgatgagagattcaaggaggaggtaaaggaggcggggactttacgaggtacattaatgagtttcatgcctatgggatcattccaaggggttgcaattggtcctttatatctctcattacaaaagtggacattcccccgcacttgggtgaatataggcctatctcccttatgggttgcatgtataaatgctcttatggcaaatgaggttgtgaagaaggcaaagaggagaaggaaaagttgtatgatattcaaggtagattatgaaaaggtctatgtctttgtgaattggaacattttgttctacatgcttggaagtccgacaaaggagttcaaaatcttaaaggaattgaggcaacgagatccaattgcagtatttttgttcaatgtggtaatgaaaggggaggggacttatggagggtggaagggtttggtgggggatgtagagcatagttctacttggtggaaagacttacgaaaaatatgcagggatcttcatgagtctaggtggtttgatgagtgtgttgaatggaaggaggggagggaaagaaggagaagatcaaagacatgggggagtggcatggtgagatgtaggagtgggtttttagttggagaagaagatcttggtttcatagagaacttagtgggggttattcgtagatatggaggggtgaaagctcgagaagatacactgtcagatctacatatcatggtgaggaaagcgttgccaaccggtgataatcttggaaggaggaacattgaaggtcaagaatcgggttgcaattgtcctttctgctgggggattgaagagtctctcgatcagatattgctatgttgtgag

SEQ ID NO: 24732 - DNA, 3366 bp, Glycine max
  Peptide Sequence Number=SeqID_116417
atgaagttcgacaatcaagaattgcctgtacttacaaatgagtttcactaccctgtgaaaaagggcataatctgtgctctatacaatttctgcatagcagataaccaaggagttcctctccttacaaaagcctctccttctagaaaaggttatacaacttttgtcctgttatcaggccctcatagagacttggaccagtttaagtcctttggatatgaggacctagcaatttccgcgaaaagtctattggactatggatgtttggaatcaatcctaattcctccatctgatagattcgagggattcaatccctcaatcaatgaggccataaacctgatccaggaaaaaatgatggactacattgccatcaaaataacaacttgccccaacaactttactgttgagaattacccatgccatgttatgaggaaagagaagaaagataaggagatttacgaagccagcggatgtcatggacaacaaactcctcctttcccatcaaccgacttctcaatggaagactcatccgacatcttctgttctggggatatcaaagacgaagaagatgttactcctatgttaaactgtaagtatgagtctcactatggttcagctaaacaaatggtaaatggtacttgttctagtcacaacgctaaggatgaggaaaataataacaggagggtgacgcgaaacagcgagaagggaaaaatcaaatcacatcgtaatgtatcagatacaactggtgtcagaaggtctcctagagagacatcatcgaagaagaacattcctagcccttcttcaagtacccgtaagtctgggcgacttgaaaatagacccccaccagctcctgtcaacaaaaggaaatctgaaagggttgaaaaaaaaaagccaagtcctttgagaagatctggaagaactaggagtcagtcttctaccggttattctgattctaaaagctcagggtcagtgagttcagaccctaagccaaaaaaagagaagagtgtgaaacagttgatatttgaagctaaggaagtgaatggaactgagcagcatgatctgggaacacctcaggttaaagtaaagagaatgaatgctcgtatgtatcggtctctctttcaattaccaaaggaagagcctaataggatcgataacttaaatcaaggtggcaacaatggtggaggcaagattgatgagtgctctggagagtgtcatgattttgaagaaatctccaagaatggtgcgctaccatctgaagatggaaaatcaaaagagatgagagttgacactgggttgagtgggtctgtgaaagatctggtagaaaataacatgactctaggttcattggcaccatctaatgttgcactaccatccgaagatggcaaatcaaaagagatgagagtcgacactgggttgagtgggcctgtgaaagatctggtagaagataccatgactctagattcattggcaccatctaatgctgcaacttatgagactggtctggcacctgaaagcattcaccctgattactgcagagaggaaacgttacaggtgttagtgtcaagcaattccatattggatgaagattctatcaggaacagtgttggggatgatagaggtgaaaacttgataccttctaagagcaaggaaatcacagtggatgtggattccgatgtttctgccatgttggcgaagggtgacaactgcaacttgacccctgatgctagtagcctgtcaaggctaggtggctatattatggggactgactgtccatctaatgccacactttatgagactggtttgctacctgaaagggttcagcctgattgttgcagagaagaaacattaccgtcaagcaattccaagaatggtgtgctaccatctgaagatggcaaatcaaaagagacgagagttgactctgggttgagtgtgcctgtgaaagatctagtagaaaataccgtcactctcggttcattggcaccatctactgctgcaacttatgtggctagtttggcacctgaaagctttcagactgattaccgcagagagaaagggaattccatattggatgaagaagacttaataagtaacagtgtagggcatgatagtagtggtgaaacattggtaccttctaagagaaagggaatcatggttgacatggattcagatgtttctgccatgttggctaagggcgataactgcaacttggttcctgatagtggtagcccttcacaactaggtggcaatattatggggattgatgggtcatgttctaagcgaataagtgagggagaacttgccattgaccctgattttgtcttgcatggccagaaactgaagaggagagaggagcttgatgagaaagtacgcattttgatgaagggctgggatgaaggagattgtgtagagggagaagtagggtttggagaggataaagttgggttggtagaggaagaggaggaattagatatgacaactatacaactaaccgctgagtcggattataatcctatagacagtgagtcttgtatcccttctgcaactgagcttcaagatggagattatattgatgcaagcatgctgcagaaggattctcaaatcgataatgaaaaagaacctggtttaataaataattccaataacagtgtaactcaactgaaggagaggttgtcaagccatattggatacagatgcaagtttgttgagtattgggttcctgtacaaatatctaatctgcagcttgaacagtattgttctattttactttcaaatgcttcaattcttcgctcctcatcaaaggttgatagtgttgaggctgttcgtgatgttcttatttctacccgaaagtgttgtagtcatccctatcttgttggtccggaactgcaaccttctcttaacaagggtctcaaaccaattgagtatcttgattttgatttaaaagcaagtggcaagttgcaacttcttgattcaatgctcgaggagttgagaaagaatgatttaagggtggtcattctttttcaggtttgcaagcaaagagcagagagatctggatgctggagagctatgggtctgttggaaatactggggttggctgtaaacaatggttgtgagctaggccagatcactgctgtctacatgttcgttgggtatctggcccctgctgaggttgctcaaaactgctggaagaagtggagagactcaaccatccagttgccatgcctgactcatagacaagtgaaaactattgggatccagaagaagaataaggaacatgtgcagctaacggagatagcggcaaatagaagtactgtacaaatgatgcaggatgaacatcaattatcggctaatcctcaggagatggcagaatag

SEQ ID NO: 24733 - DNA, 369 bp, Glycine max
  Peptide Sequence Number=SeqID_116418
atggcttgtcctcatgcttttggtgttgttgttcttttgaaagttgtacaacctcaatggagtcctactgctataagggactatggttacccttctcaatatgcttcccctctttccattggacctggtcaaatggaacccaacaaagcacttgtatcagctttgtacaacaacaaaagaaggccaattgttcacaagtttaggaggacaatgaccaatgttggaagtggtattgccacacatagagccaaggattctactagggcaaaccctgctattaaatacttgagattaagatcattaggtgctaatgtagtgcttctgtccttggtcatgcaaggaatctttcgaggattttcctttgtgtag

SEQ ID NO: 24734 - DNA, 573 bp, Glycine max
  Peptide Sequence Number=SeqID_116419
atggtggggtcccctgctaggaacttggaagaagaggttgaggatgattttaaacctgtgctatgtgagcttttggcaactcatccagggctggagttcttgcagagcacacctaagtttcaagagagatatggtttgtcttccatcttggttataaccttgcatttagggtttatatcaggaaatggtcgtcttaccctgagggagctgaagtgtcaaaacataattgatgtaatgctgcatgctgatgaagaagaggacataaacaagttttgggagctcgatacagatcatgatttcttgatagacaacgagaatctcatcagatatgcatttgttgaagatgcatattttgattcacttcaatattatctcaagttcccagaaggtttaccactttttgagaatatattgtgccagattattgacatgattggacctgaggatgagagctatataactctgcgtgacctgaaaggtagtaaactctcggaacgtgagaatcctacattggcagagtgggatgctttgctcgtagagaatatattaggctttcaatggaagaagatgtag

SEQ ID NO: 24735 - DNA, 240 bp, Glycine max
  Peptide Sequence Number=SeqID_116420
atggcctgcgaccacggtcaaagcaactccttgacacatccgcaggggaaaaatcaagttgaagatatcggaggagggggatgccacatcagtggtagagcacacgagccagggcaatgcataacccaaaaaaattcttccagggaggtgaactacatgggagctcagaatcaccacggattccaaggctacaatcaaggaggaccgtcgggattcaaccaagggagaaatttcacatag

SEQ ID NO: 24736 - DNA, 168 bp, Glycine max
  Peptide Sequence Number=SeqID_116421
atggacgcatcctataaaggtcaagtcaccacacatcagcatgtgaaggcttgccaagggaaaaggagctgctccatcaaaatctcagacagtgtatttggggtagatccgtgtccgggtgtggtgaaaacattcagtggaagcaagatgcacatcaccattgagtga

SEQ ID NO: 24737 - DNA, 714 bp, Glycine max
  Peptide Sequence Number=SeqID_116422
atgacttttagatcaccaaagcagttcaacagcttatattttcatgtcaatgtcaataggcatgttgatgctgatccacccttaaatgacaatggcaatgatttaagaaaattaattgcaattgcaaattttgatggtgggcctcaacagaagcaaaatagcatggatagcaaatggcacagtattgacgaaacaacagatcagtcatggtgttatttcttcattcaacaaatgattgagaatggtatagagtgggaaggaaaaatgaggaaggacaatgtggttttgtatttgactaccctgcgtggcatgacaaacacttacaaggattgttgccatataaggcacattctaaaggggttcggtgtggagggttgggattgccgacaatgtttgttgcgaggaactatgttggttgagcttaggaaattgagcaagagaatgatgaggggaaacattgagaacttggtcaattcttgtgaaaagattgaagacgacgttgattgtgaggggccatgtcaagcatatggggatgtaaggtttcagccgtgtgaaacttgttatggaagttgtaaaattgactatgaagttaataaagaagaagaatatgacggtgaggccaacgaagagaaggttaaagcagctgatgactcgctcagcaagatgcatccgcttagcgaggcatcagcttacttagcggatcggaaaccctag

SEQ ID NO: 24738 - DNA, 540 bp, Glycine max
  Peptide Sequence Number=SeqID_116423
atgactcttcatctcttatgcacagaattcttgaaaggttcgatggacttcaaacctatgttggtgaaaggtttgatgctttggaacgacaagtggacacgcgattcgacaaaatggactcaaggatcacaaaggattgtcatcatcaaaaagggggagattgtggaagcaatgtctttcaagattattttgatgatgccaaagaatcaagagttaagcaaattccaaagattcaagaatcaagtttcaagaatcaagattcaagattcaagattcaagaatcaagtttcaagaatcaagattcaagaacagtcaagatcaagattcaagactcaaaattctagaatcaagagaagactcaattcagataagtaccaaaaaaagtttttcaaaacattgagtagcacaagaatttttcacaaaatcttttaccaaagagttttactctctggtaatcgattaccagaacgtagtaatcgattaccagtagccagcattgttttcaaaactgatttacaaagctgtaatcgattaccataa

SEQ ID NO: 24739 - DNA, 594 bp, Glycine max
  Peptide Sequence Number=SeqID_116424
atggtcatagagcagtcccttttctttgatctcactcaattatcaagtgatggtgtaccatttgagggttcacttgatgatgagtggaagtttgatttctctgtgtctgatgcccgctggatggtttgcaccaaccaagaggatatgaccggaaggcttcttgccagttcattggcattcgaatgccgcatcatgcactacttgattgtgcgaatcctactccttagatcttccaaccttgcacagccctttgtcaaagtcaaaagatccttctctataggtgcaaatgtagtctcttccttcggttaccgcaaagagagagatggctcttgggtaaagaaggatgctccagtacaggccgccgaagaccgctctccatcaccacattctcagagaaatgactcttcatctcttatgcacagaattcttgaaaggttcgatggacttcaaacctatgttggtgaaaggtttgatgctttggaacgacaagtggacacgcgattcgacaaaatggactcaaggatcacaaaggttgaagaagatgttgtcatcattcacgactgcctttatttacctccaccaccatcagtttag

SEQ ID NO: 24740 - DNA, 2286 bp, Glycine max
  Peptide Sequence Number=SeqID_116425
atggcaagtagcggtgctgcaacagcggcgttgcagagcgatgcaagtagtagaatggaaggctggttgtaccttatacgcttcaaccgtattggacttcagttctctcggaagcgttacttcgttctcgatggtaaccttctccgcagcttcaaatcagttcctgtttcaaataatcaggatcctgttagaagcgcgattgtagattcctgcattcgagtcatggataatggaagggagagcgttaaccgaaaagtgttcttcatattcactctctataacacttcgaatcacaatgatcagttaaagtttggagcaagccgtcctgaagaagcggcgaggtggattcagtcctttcatgaagcatcgttaaggggtgcgcctgacggaggagatgatgctgtaggttgttctaagaggagatggcaatcctttagactcagtggatcttctagtagtataagtcacccaaattctgtagactggactctttcttctgctgatgttattgccccttcaccatggacaatctttggctgccaaaatggtttacgactattcaaggaagcaaaagacagggattctaatgggaagaaatgggatgatcaccctgcaataatggctgttggtgtggttgatggaacttcagaagccatcttccagactcttatgtcgcttggtccttcaagatcagaatgggatttctgtttctacaagggaaatgtggtggagcacttggatggtcacactgacattattcacaaacagctatttagcgattggttgccttggggaatgaaacgaagagatctcttgttgcggcgttattggaggagagaagatgatggaacttatgttattctttaccattccgtgtttcacaagaagtgccctccccagaaaggctatgtgcgtgcttgtcttaaaagtggagggtatgttatatcaccagtgaacaaaggaaagcaatcagttgtaaagcatatgcttgctattgattggaaatgctggagatcatatcttaaatcttcatcagcacattccataaccattcggatgcttgggagagttgcggcattacgggagttatttaaagctagactagggaattgttcttcgtctgattattcatctggagagttgacgagaaacagtgagcttcatataaaggaagaagtcatcatcaattctgatactgaaattcaggcagatgagaacaatcatgataattcagttggagaagtagatcaaacgcaatcagaacatgcatgccttgttactctaaatgatgctgatgatgagttctatgatgttccggagccgtcagactgtgacgagtcagaaaatggatggatgactgaatgtagtcaacagaagtctcagggcaaaaaggcaagtcttatcctaggagtaggaggtggactcttccatagctgcatgttttatgcctacaataatgacattcgtcatcagaagttatcaactgctgccaactttgtgaaaagattgcatgatcttgcagttcagaagaggggttatgttgacttgcaagagatggtcagggaggacagtatcacatgctcatatggatccactcttccacaagatcctacttgtacattaccatgtagtttgacagaaacagatccttatactttcctgatacgtggagaaaattatcttgaagaccgccagaaggttaaagcaaagggaaccttgatgaaaatggttgctgcagattgggtgagatctgacaaaagggaagatgaccttggtggccgtcctgggagcattgcgcagaaatatgctgcacagggaggacccgagttctttttcattgtaaacattcaggttccaggttctactacatatagtctagcactatactatatgatgaatactcctgtggaagatgctcctttgctagagagttttatcaagggtgatgatgccttcagaaattccagatttaaacttataccatacatatctaagggttcatggatagtaaagcagagtgtgggaaagaaggcatgcctagttggtcaagcactggaaatcaattatttccagggaagtaactatttggagcttggagttgatattggatcatcaactgttgcaagaggtgttgtgagtcttgtccttgggtacctcaaccatctggttatagagatggcatttttaatacagggaaacacacgtgaagagctccctgaatttcttcttggaacttgccgccttaaccatctggatgcctctaaagcagtttgtctgacgctgtga

SEQ ID NO: 24741 - DNA, 2565 bp, Glycine max
  Peptide Sequence Number=SeqID_116426
atggccgaaagttttaagaggacaactgaatcggcaacccaagtggagacaatattagacaaggagaatttcactttggaagagcttctggacgaagaggaagtgatccaagaatgcaaggccttaaacagtcgtcttatcaactttctgagagatcaagcccaggttgagcaattgttacgatacattattgaagaaccaccagaagatgctgaaaataaacgggccttcaagtttccattcattgcctgcgagatatttacatgtgaaattgatgtcattttgaagaccttggttgatgatgaagagctgatgaacttattattctcttttttggaacctaatcgctcacatagtaccttgttggctggctactttagcaaggttgttgtttgcctaatgattcgaaagacagtgccacttatgaaatatgttcaagcccatcagaatgtttttcgccaactggttgatttgataggaattacatccattatggaggttttggttcgattggtaggcgctgatgaccatatgtatcacaattttatagatgtgatgcaatggttggctgagagcaacctgcttgagatgattgttcataaattgagtccatctagtcctcctgaagttcatgccaacgcggctgaaacattgtgcacaataactcgaaatccctcatcgactctagcaattaaactttcaagcccaagttttgttgccaaaattttggatcatgcactggaagattcacaatcaaagtctagccttgtgaactcactttcagtgtgtgtttctttattggatcccaaaagatctgctatatcatctcccctttttcattcatttcgaagtcaacacatgtatgagccacccattcctgtaaacccagacactattggtgctatgctacctaaattaagcgaattgcttatgcttttgaatgtatcatctgatgaaaaagtattgcctacaacatatggagaattgagacctccactcgggaagcatcgattaaagattgttgagttcattgctgtccttctaaaaactggaaatgaagtggcagaaaaagaaatggtcaattcaggaaccattcaacgagtcattgacctcttctttgagtatccatataataactccttacaccatcatgtagaaagtatcatattatcttgtttggagagcaaaactaatgccattgttgaacatcttcttcaagagtgtaatttaattggaagatttctccaagcagacaaacgttctactctctctgctgacataaatatgccaacagtacctgctgctggaaaacaagtgccacgggcaggaaacattgggcatattactcgaattgttaacaaacttgttcacctggctcataatcgaaacctcatactgacatgtcttcaggaaaatagtgagtggaatgaatggcaagcttcagttcttcaggagcgtaatgtggttgagaatgttcaccgttgggcttgtggacgtccgactgctttacaagataggatgagggatagtgatgatgatgaacttcatgacagagactatgatgttgcagctctagcaaataatttgaaccaggcttttagatataaaatttatgggaatgaggataacgaggaggaacgtggcaaccttgatcgagatgatgaggatgtctactttgataatgactctgcacaagtagtcatatcatccctcagactcagtgacgatcaagggagtagtctgtttacaaactccaactggtttgaattccaagatgacagaattggtgatgcaactgggggaacaacatcatcggagatgatggatgagataaacttgaatggtgctgcaaatggtggcaacagtagtgatgatgaggtagtggttggagaggatgaagaattggatgaaagcaaaaataatctgaatggtacatctagctcaagcacaaacttaaatggaataactggtagtgattccatgaatggagacaccttgaactttgaaagcaaaaagacaagtgcttcacatgatatgggattcttcaggtttgaggcatcggacaatgaagagttgtttggggacaggcctttgcctgattgggtgggatggggtgaaccttcagatatgcaagatgctggatcaagcaagaacccatttatagatcacgatgattcttctggtagcaacctttgtactaccaaacctcaaatagatagccctactccgagtcctccttcaaatggggaatctgttccttcaaacaggtcaccaactaaagaagattcgattgatgggggtgttgactcgagtcaaagagcagtacctgtaccatcgctcttcgaagaagatgttgaatttgtaggtgtagaattagaaggtactgagaaggctatggaacaggctctgaaagaagggatagttggggaggcaggaccattgaaaagaaacatggtctctaaagtgccagaaaaggaaagtactgacgagggtggtcctggaataaaggaattcaatgatgcaaattactggagggttgaccaggaggttgctgttctagagtga

SEQ ID NO: 24742 - DNA, 864 bp, Glycine max
  Peptide Sequence Number=SeqID_116427
atgctgcaggtcgactctagaggatccacgagagctggaaggaagtcctgctgctcagaaggattgatatgggaggatattcaggcggaatttgaaatccctgaagcttttgacagtaggacaaagaagaaagttttcagactatcggcgagcggtggaggcagatgtgcggaaaaaggcacaggccattcagaagcaaaacaccacccccacgtgttgtctcgtgggggttatgactatttagaacagaagttcatggctgagaagacaaagaaaagactggagaaagttgctcagtccggaagcactgagggcgtcattgaccctccatctcccattagacgacacgtgaagtggaagatggcccgcaccaagaaaaatgggcagatgacgtttgaggcagcaacggaaatcgttgagaagattgattctttggaggagcaggcatcacagggttcgtttgtctgccatagacgtcaggatctcctgactactaccattgggcaaccaaaacaccctggctgtgtgcgtgctactggagccggtgtcaccattaagcaatacttcggatccgctccacgaagctcccgaagttcctccttcatgcctcctgaagaactcgagcagctgactcaacaaatcagggaccagctggaggagtcgatcatagaaaaaccagatgcaatcctagttgcaatcacagatccaatcataggacttgcactacctccggagcttgaggttggtccctcagctacttgtgtcagcacaaaggggagttgtgttgatccctcaccgaccgatcagagacaagtgactcaaacaaatgcgggttgcacatcgaagacaatccttccctcctag

SEQ ID NO: 24743 - DNA, 2541 bp, Glycine max
  Peptide Sequence Number=SeqID_116428
atgagaccggcacagattgtgttggttctgttttggttgctctgcattcacactcccaagttgttctgcgccaatgtagagtatgatcacagagcattggtcatcgacggcaagcgcagggtcttgatctctggctccattcattaccctcgtagtactccagagatgtggccagaccttattcagaaatccaaagatggagggttggatgtgattgagacttatgttttctggaacttacacgaaccagttcgaggccagtatgattttgatgggaggaaggacttggtgaaatttgtgaagacagtggctgcagctggtctctatgtccatctccgcattggtcctggtttccctgtttggctgcacttcattccgggaatcaagttccgaactgacaatgaacctttcaaggcagaaatgaagagattcactgccaaaattgtggatatgatcaagcaagagaagctatatgcctcccaaggaggacctgttattttatctcagattgaaaatgagtatggaaacattgatacggcctacggtgctgcgggtaaatcctacattaagtgggcagcaactatggctacatctcttgatacaggggttccatgggtcatgtgtctgcaagcagatgctcctgatccaattattaatacatggaatggattttacggcgatgaatttacaccaaactctaacacaaaaccaaaaatgtggactgagaattggagtggatggtttcttgtgttcggtggtgctgttccttaccgacctgtggaagatcttgcatttgccgtggcacgctttttccagcgaggaggaacatttcaaaattattatatgtaccatggaggaaccaactttgaccgagcttctggtggacctttcattgctacaagttatgattatgatgcaccaattgacgagtatggaattattagacagcctaagtggggccaccttaaagaagtgcacaaggccataaagctttgtgaagaagcattgatagctactgatccaacaattacatcccttggtccaaacctagaggctgcagtttacaagacaggatctgtatgtgcggccttccttgctaacgtaggcaccaaatctgatgtaacagtaaacttcagtggcaattcatatcacttgcctgcatggtctgtgagcatcttaccagactgcaagagtgtagtgcttaatactgcaaagtgtatcggaagtcaaaaacatttctgttatttgctagtccaagaaattaattctgcatctgcaatttcaagctttacaactgaatcttcaaaagaagatattggttcttcagaagcttctagtacaggatggagttggattagtgaaccagtgggtatttcgaagaccgattcattctcacaaactggattattggagcaaataaatacaacagctgataaaagtgattacttgtggtactcattaagcattgattataaggctgatgctagttctcaaactgtccttcacattgaatcacttggtcatgcccttcatgcctttattaatgggaagcttgcagggagtcaaccaggcaacagtggcaaatataagttcactgtggacatccctgtcacactagtcgctggaaagaacacaattgatctcttgagtttaactgtgggacttcagaactatggagccttttttgacacatggggagtggggatcactggtccagtgatattgaaaggttttgcaaatggcaacacgcttgatctctcctcccagaagtggacctatcaggttggcctccaaggggaagatttgggtctgtctagtgggagttcgggacagtggaatttgcaatctaccttccctaagaaccaaccattgacttggtacaagacaactttttctgctccatccggcagtgatccagttgcaattgacttcacggggatgggaaaaggcgaggcttgggttaatgggcaacgcatcgggcgatactggcctacatatgtcgcttcagatgctagttgcacggactcatgcaattatagaggaccttacagtgcatccaaatgtcgcaagaattgtgaaaagccatcacagacactataccatgtaccgcgatcgtggctgaaaccaagtggcaacattcttgtattgtttgaggaaaggggaggtgatccaacacaaatatcttttgtcacaaaacagacagaaagtttgtgtgcgcatgtatccgattctcacccaccacctgtagacttgtggaactcagaaacagaatcaggaagaaaagtaggtcctgtactatcactcacctgccctcatgataaccaagtcatctcttccattaaatttgcaagctatggaacaccccttggaacctgtggtaacttctaccatggacgatgcagcagcaacaaggctctatctattgtgcagaaggcctgcattggatcaagcagttgtagtgttggagtatcaagtgacacattcggagacccttgtagaggaatggcaaagagtttagcagttgaagctacttgtgcatag

SEQ ID NO: 24744 - DNA, 831 bp, Glycine max
  Peptide Sequence Number=SeqID_116429
atgacattcttaggagaaacaagcagtcagacaattgtgaactccatattcgattttattcttccaaatggttctattgttcacaacgacaatggtgtttattttcaaacctccactccagtgccttttcgagtacctaacgcttgtaattttcaaacgttaaaaaccacaatacacaatacccttcagctaatcgacggacaatatttcgatgaaatttactaccggcaaccattcacagatataggtaatcatctttgctttcaacgtatgcaactgaaaaatgatgatgatgttaatacaatgttaatatgtaatcatcaattttcaagtgttggtccaattgagttattatgcactattggtagaacaccagagggtttattaaacatacttgaagccactatgacccttactcatgatgccctgctatattacaatgggaagtggaacatgcgacgccaaaatgagtttgttggttactcgttcacaagaaaaaatcccaaaaagtttgatattcctttcggatgtaccatggataaattgaaggatttgatcaaggaagttgtgcctcatgggattcccccttatggtattcgtgaaacacaaacggtaagacgattgtttttccgacaaccaagtcactatgagtattcagataaaattatcaaattcgaaattattgaattgaaaatcaatgatgacgtgttaaaggtgttagtgcattctaactactggaaaaaattcgagccaatagaaattttagctgcttttagtaagcatgtaatcgaaatggaagataatatgtctatgtccttgtcgcaaaattag

SEQ ID NO: 24745 - DNA, 459 bp, Glycine max
  Peptide Sequence Number=SeqID_116430
atgggaactccaccagcatccccttcgccgtcaaatgtgcatttagaggcggcatctaggaatactagacgattgacacgtctaaggagattgactttaagaacgttggatcagcctagactaactgtgaacattgacgctgcaactggacaaggattgggcccaaataaagagatattccacaactatctaagggtcgtagctagagaaaaaattccaattgtacataacagttggaaggaagtaccagactccctaaaggagcttgtatggaatgacattttggcgaaatttgatatcccagaagcccttaatgcaaagaagaagcttatgtccagtgttgccactagatggaggccgtttaaatcatccctcaccacaaaatttgtgtatagtaattatgagggggaacaacaagaagatccttcactcaaatatggcctagatccacaagcatga

SEQ ID NO: 24746 - DNA, 165 bp, Glycine max
  Peptide Sequence Number=SeqID_116431
atggccatcaccatcactagcattcccgatgccgccgtatatctgcagttcatacctcctcttcccactgacccagagaacctgtttcgttacttggacctagtactcacccctctccctctttcaaaaaccagccaagcctcagccttcggcaaaaggggataa

SEQ ID NO: 24747 - DNA, 633 bp, Glycine max
  Peptide Sequence Number=SeqID_116432
atgagtgctcatcaaaaagaaaaacacaacgcaccttcgtccaaaccaacggtttctcattcacttcacaaggttgatgatccaatgaaggtaaccgatgaaaatgaaaccttgcgtgcttctaataatcaatggaagcgaccgaatctgcagctggaaataccgaccagaacatcggaagagtcttctcaggatcttgtaagaataaggatgccactgacgccaagtccaactcctagtcagaagaaagtgaattttcttgcgacttctcgctctgttgatgctccaaggcctacttcttcatcgaccagagccaaatcatccatgagaaacatcttaccgaaattcggcttccggaatcgtgcaccatcgcccgatgttgaaaaggttgttactactgcagctcaagaaggttccttttctggtcatcaagagaagccttcaatcccaagatcagtgtctctcacaaagatgtttactcctaagattaagagaacgtcttcgttgccagtggaagaacttgggcgtgcaaacgtagaatctgttctttgtggaactcttggtgcttctccatgtgtaagatctctagcctatagctgtcactactacacaagtgtgattcaacatcgttga

SEQ ID NO: 24748 - DNA, 461 bp, Glycine max
  Peptide Sequence Number=SeqID_116433
aaagttgtgcttctcgttttctctttttcgtgccgcattgcctctggttcttgggggtagcagcgttgagtgcagcggtgaaggtaccggcgtcgaacgttgcggtggtcggtggcggcaaacgagatgagtggatgtatgaaataatgtctaaacgagcggatatggattatgaaaatgcagaatcatgtggtgcgaatgaaccacatgttgattgttcggatgcgttcaagacttctcaggtgtttgagtgccgagaggatgttttgcggtgggctcgatccgtggctcatgaaaatggatttgtggcgatgattttaaggtcgaacacaaacacaggagtgacgagtataagtgtaggaaaaaagaatttatcagaagagatactgagactaggaaatgtgggtgtcccttcaagcttcgttgcaagccagtggttggaggagaaggctggatggtga

SEQ ID NO: 24749 - DNA, 294 bp, Glycine max
  Peptide Sequence Number=SeqID_116434
atgaatgaagatcaattgatgtatgacagtataatgtctaaagaagttgatatgaatgaacaaaatggagacgaagctgtgttggctacccgagatgatgttctgcattgggctcaatctgttacttatgaaattggatttgtggcggtgattatgaggtcagacacaaacagtgattccaaacaacaaccattaaagagaagaagaaagcttacctcgacaccgaaaatggcacggcggtggtggagacatcctcaaaggcggcaatggaagcagcggacggcagcgacatga

SEQ ID NO: 24750 - DNA, 1332 bp, Glycine max
  Peptide Sequence Number=SeqID_116435
atggacacagattctttctccgattccaacttcgaattccaggaatccgatctctacaactccgctcgcgctaactctcccgaatttcgcaaatccgtacgcgcctccagatttcacaactactcttcctccggcggccgcgtcggtactccggtgtcgcttccggtgaacgtgccggactggtcgaagattctcggcgacgagttcggacggaaccagaggaggaactacgacgaagcgcagagcgatgaggaagatggagatgggagagtgcctccgcacgagtttctggcgaagacgggaatcgcttcgttctcggtgcacgaaggagttggaaggactctcaaaggacgcgatctcagtaggctttcggattggaccgattattatgcggtgatgaaaatcgaaatggtgaattggctgtgctattgtggaagtaggcatagtagtaggtgttcgatgcaaagcagcgcttatgctagtttcgccaaagctgttggcaaaataattgtcattagattttgcccctttgactggcgatacagcaacaggcagggtgacgtggcacacatgcaggggtcgcaggcaccagaacgtagcagggtagcaggcaagcttttcagaaggtgggaaggcaccctcatttgccttcctcccgatttatcgtctctgtcaaataacttcgtccctaaggttcttccactatcgatgtctcccccatcggagaccatcgccactcgggttcctcctatgttgtcgccggtggaggatgccacctacgttcaacccaacctccaagatcaattgttagcgttacagaacatcaatagcgggaacaacacttatgatcacccgcagacacagtttgttaatagcgcaacgaaccaggttgctcccatgtggccaggctcccaaatcaatcactcgctgtcacggaagggcagttcttcgaagtccaatgagtgcaggagatggagtgaagaagaacacaggttgtttctgcatgagcttcagaaatatggaaagggagattggataaacatttcaagaatcatcaaaacaagaaacccaactcaagttgctagtcatgcccaaaagtatttccttcgtcaggcctcaagtaataaaggcaaaagaagaagcattcatgacatggtcctaccagatggtcctgtccctcaccgcatttaccaacagaatggagtttcttttccaaatcttgatggccctatcactcaccacattgatcatcagaatgaggttccttttcaaaatcttacaatgcaggagttatatgaaatccatttggcagtccctcactacattaattag

SEQ ID NO: 24751 - DNA, 726 bp, Glycine max
  Peptide Sequence Number=SeqID_116436
atgctttgccacagcttagagggcaatgctggtgcactcacaaattttgaggtccttgatttcttacgagctaaagaagcttcaaaggatccaacaagaggtattgccaaagtagcgcagtctgaatacaaggtttatgattatttggttgactctgctgcctctgttcaaacaagagagagcatcaatgagttcttaacaagtgttaaacagcatgacctgacaaaaactgaggttctgaacatattaaacattgggccagctgctgattttgaactatacccagtgatatattaccaaacagtttttgacaagtccacttttaccctctttgtggcttctgatcaagctggtaaggttcctctctattggggaatcacagctgatggatacgtagcatttgttgatgatgcagctttgcttaaaggttcttgtggaaagtcacttgcttctttccctctaggatgtttctactctatagcagttggaggattgagatgctatgagaatccaaagaataagattgttgcaatacctgctaaggaagaggaaatccggggtgcattcttcaagaacagagaatcagtgatcagtcccaacagtaatataaggttaatgtcaattgagactgcattaggtacaaagggaaaatgtgaggtaattttagagcttaagaagttagagttgaatatccattatgtaactaggattgccaattgcaactaa

SEQ ID NO: 24752 - DNA, 1407 bp, Glycine max
  Peptide Sequence Number=SeqID_116437
atggttagaatcagaggtttgagtcgagctttaggcaatgttataggaagagtcctaggaaaagaagatgttcacgatatggatcatgcagatgacgagatccatgaacaacatgaagaaatagctgctgatgatgtggcggatgctaagggtttttcaggcgaaccccacaacacatcagtgttgcaagattatgtttatcatgtggccgcgaaagaacgtcctgaggtgaaattatcctcccatggaaggaaggttgagaaatttggcaagcctgccctaggaacgtccttagtggctgccacaggattaagtcctttaatcacatgttcgctagacactcgtgatcagggacttatgtctgctttcatggaaaggtggcataaggaaactagtactttccgtcagtcggtaggagaagtgactatcaccttggatgatgtggcatcgttgctgcatttgcccattacaggcgcgttccatacttttgagcctcttcatatggacgatgtcatgttgctcttagttgaattgcatgaagtaagtgttgaagaggcaagagctaagacagtacaatgtcatggggcatatgttcgactatcttggctgcaagacgtatatcggagcaaatgtgacacagtacagtggactttagcagctcaagcatatttgttgcatctgcttggttgcacactctttgttaacaagagtgccacacacgttcatatgtgttgcatctacgaacactttccttctattggttctgctgttgctgctgaggattatgagaggaaaccacgtacctgccattggaagtctgggaagacattactagtattgacgtatcgtaggtgtttggatagattgatgtctaatattgtatgttggattccgtatggtgaccaccgtgcattcagagagtttgaaaccatttccccacactctgctgctccttctctctgtatagaagacattgatgatagatggattcaattttttgaatacattgcactggtgggtcagatatgtgtagcgcttggtaagtgttcactagactacatggattggttctacttaatatctcatcccttcatgagtccggcacagcctggggatcctcctatacatccgtccgtgcagcaccatgacacatttgttgaacaagatgttgctcagcatctagtggcggcaatggctatggatgaagcacctgaagatgcacatgttgatgtagagcagcctcgacatgtagtggaagcttgccaagcaatagttgaaaggttggaaaggctattgaacctaagaatagtgaccgaaggaatagaagctacactgtcaccgaagaatgctcgaggatcgcaagaggtgtcactgcacaatgaaatgtctacgttcgatcgagactaa

SEQ ID NO: 24753 - DNA, 114 bp, Glycine max
  Peptide Sequence Number=SeqID_116438
atggaacttgaattgcttgcgaggttgatcgtccacaaaacaacgcaagccaaaagaagagaaggtcaagcagctagtatctcgctaagcgaggcatatgcgcttagcgagtga

SEQ ID NO: 24754 - DNA, 1320 bp, Glycine max
  Peptide Sequence Number=SeqID_116439
atgaatcttcaagtttctccaacaagaaaaaaacattgtcagggtagacaccttggtgttcaactcagtaaactctgtgaggttgatgtgaccaccatcatcagaatctacctcgctgatcattttatgaagctcttcctagctcatgtgttgcccaaggcttttcgtcatggcacccagaatgtaacgcaagaaaggcgaacattttccatcgagaaattctcaacagaggacaaaattgaatttctgcctaatggttgtgatgggaggaactatgatggtagtgatgatggggatgatggcaatgatgagattctccacttagggaatagaagttcatgtaactttggtgggattataagtgtcgagttggcaatggatcgaactgtcaatcttccaaaagggtatggatatgtgcagttcaagacaagaggggatgctgaaaggcattattctacatgggtggcccaaatagatggcaatgtcatgaaggcaagatatactctacctccaaggcagaaagtttcaccacccccaaaggcttttgctgttgctccaaagagagacacccccaggactgataatgctagtgcagatgttaacaaggatggaccaaagcggcaaagagaatgtatatatgtggaagttagctctatgctgttggagaagcttgttgctgctggaattgggaatcgtcctgttgtttttgttactcacagtgcttctcggccatgttcatgtgccagtgatgagtttttaaggattataagacattataatgtggcctatagattcatgatagtcaggttaggactcatagtagctgcttccattgcagccctcacagttgagcagctgaatgtgaataacacaagatcagcaacagacttagttctaactgtgactcaaattctcagaaagcatggtgttgtggggaaatttgttgaattttatggtgatggtatgggtgaattatctttggctgacagggccactattgccaatatgtctcctgaatatggtgccaccatgggcttcttccctgtggatcatgttacattacagtatctcaagttaacgggaagaagtgatgagactcttgagcaccaagctattagtgaccacttatgcatgatatgttttctggcctttgaaaaagtcaagactcgttcgctcttgtctatgactcatgttcctatttttgcaagactttgttctggggaccttaacagcagcaatgatgtcaaaatgagtgtttgggagatccatgtaaatgactttgttctggggaccttaacatcagcaatgatatcaggatga

SEQ ID NO: 24755 - DNA, 297 bp, Glycine max
  Peptide Sequence Number=SeqID_116440
atgattcctgctcaggaagtctgggcaaggcatccgcaacttgattatgagttcttgaacgataatgaatctgataatcatagcccattaatcttgttaaagcctcggactgaaaggctagctaataccgatgcgtttgtttccacggtaaagggaagctcgaaatctggtaaggctaatatcgatgcgtctgataaagcttgcttcaattgttcaaaagttgtttgtgccggagtcgttcattggaaacgctctagtgtagtgatcttgactaagggtgccgcaatggtggcatag

SEQ ID NO: 24756 - DNA, 240 bp, Glycine max
  Peptide Sequence Number=SeqID_116441
atggcaaggaggaagcatagcaggcagcaacaacgaggaagaagttgcaacaccgacaaagaagaagatgctgcaaccgatagtggagaggccataggagaagaggagggtgaagggcatttttgccctttcacccatgttgctggtgccccagcaaaaatactgggtgccccaagcaactgtcgggacattgttcaaatggctcctcgtgtgaattggtttggattagaggtgggatag

SEQ ID NO: 24757 - DNA, 267 bp, Glycine max
  Peptide Sequence Number=SeqID_116442
atggcagctcgcccaagcgagctgagacttactcctgaagtaactggctcgcccaggctagctggttccttcaccttgaagataaaggcaaggactttgagtcctgtgaaagataaaagcaaggacattgagtcttgtaaaattaaagggaggactttgagtcctgtgaaagataaaagcaaggacattgagtcttgtaaaattaaagggaggactttgagtcctgtgaaagacaaaagtgaggactttgagtcctatgaaagataa

SEQ ID NO: 24758 - DNA, 297 bp, Glycine max
  Peptide Sequence Number=SeqID_116443
atgtcggcttggtggctccaacaaaagacttccctccaagtcacctactgctgctcatctactcctgcgaacgaaagtttgagatcatcacggacgccaatcacatggaaagctaggcagcaagtgtcgaggtcaccctatcgtgcacaggcaacttccccctatcgtgatctacctgagtttcaaggaagttcaaaactgggtgacatgtcccaaagtacaagtatttttcctcatgaaaaactacgagtacttactaacaaagtttatactatttccatgcaatatgaagtatga

SEQ ID NO: 24759 - DNA, 174 bp, Glycine max
  Peptide Sequence Number=SeqID_116444
atggagaggagtatggttgatgctgccagtggtggagctcttggttggaggaatcatccaaatctgagatggacaagtcctccacaaaaacaacaacaacctgtccctcttttccagaatgctgctggtctaagcaagccatatgttcctcctccaatacagcagcagcaatag

SEQ ID NO: 24760 - DNA, 222 bp, Glycine max
  Peptide Sequence Number=SeqID_116445
atgataacaaaagatgatgacaaaggagatgacaaaaagctcaaaggtcaatcaaagaatgagtacaagatattcaagatagaatcaagaatacttcaagattcaagaggaaagttgaattcaagaatcaagattcaagagatcaagattcaagactcaagaatcaagattcaagagatcaagattcaagactcaagattcaagaatcaagagaaggcttaa

SEQ ID NO: 24761 - DNA, 441 bp, Glycine max
  Peptide Sequence Number=SeqID_116446
gatgtgcgcagcaaggcacaggccatccagaagcagaatactgccccccacgttttgtctcgtgggggttatgattatttggagcagaagctcctggttgagaagaccaagaagaagctgcaggaagctgcacagtcaggaaacgttgatggcgtcatcgaccctccatccccagtcagacgccacgtgaagtggaagatggcccgcaccaagaagacagaggagatgacgactgaggccacaaaggaaatcgctgagaagattggatcgttcgtcccccatggacgtcaggatgttctggccgctgctattggatgtccagagcaccctggacgtgtccgtgctgctggagccggtgtcaccatcaagcaaactttggatcggctccacgaacatcccgcagcgcttcctcccagcctcctaacgaattacagcagctga

SEQ ID NO: 24762 - DNA, 960 bp, Glycine max
  Peptide Sequence Number=SeqID_116447
aggatccccatcagagggctgcacgccctcaccttcagaggactacacgtcctcggcatcagagggtcgggtacccacaccttcagagggctacacgcccttgcattcagaggactacatgtcctcgccttcagaggactacacgtcctccacttcagaggaccatacgtcctcgcctttagaggaccatacgtcctcgccatcagagagctgtacgcccccaccctcaaaggactacacgtcctcgacattagagggttgcccaccctcaccttcagaggactacacgtcctcaccatcagagtgttgcacgccctcaccctcagaggactacacgtcctcgccatcagagggctgcacaccctcaccttcagaggactacacgtcctcgccatcagagggctacacgccctcgcattcagaggacgacatatcctcgccttcagaggactacacgtcctccactttagaggactagatgtcctcgcctttaaaggactagatgtcctcgccatcagatggctgtacgccctcaccgtcagaggactacacatcctcgccattagagggttgcacaccctcaccttcagaggaccacacgtcctcgccatcagagggcggcatgcactcacctttagaggactacatgtcgtcgccatcagagggttgggtaccctcaccttcaaagtgctacacgccctagcattcagaggactacatgtcctcgcctttagaggactacacgtcctccacttcagaggactagatgtcctcgcctttagaggacaatacgtcctcgccatcagagggctgtacgccctcaccctcagaggactacacgtcctcgccattagagggctgcacgctctcaccttcagaggactacatgtcctcaccatcagtgggctacacgccctcaccttcagaggactacacatcctcgccatcagagggctacac

SEQ ID NO: 24763 - DNA, 111 bp, Glycine max
  Peptide Sequence Number=SeqID_116448
atggcctttgtggataactgggtggaatggcagtcacagcatgggtttctcgctcatcctcaccctcttcatttgccccagttttctcattcgtccaagcaggatgattaa

SEQ ID NO: 24764 - DNA, 932 bp, Glycine max
  Peptide Sequence Number=SeqID_116449
agggatccccgggctgcacgccctcgccttcagagggctacacatactcaccatcataggactacacgtcctctactttagagggctacacgccctcaccttcagaggacaacatgtcctcaccatcgaaggactacacctcctcgccattcagagggctgcatgccctcgccttcatagggctacatatcctcaccatcagaaggctgcacgtcctcgccttcagaggactacacgtcctcgccaagagagggctgcacgccctcaccttcagaggactacacgtcctcaccttcagaggactgcacgtcctcaccttcagagggttgcacgccctcaccatcagaggattgcacggcccagccttcagagggctacacgtcctcaccttattggactagacgtccttgcctacataggactacacttcctcgccttcaaaggactacacgtcctcgccattagagggttgcacaccctcgccttcggatggctacatgtcctcaccttcatagggctacatgccctcacctttagaggactagaattcctcaccctcagaggaccaaacgtccttgccttcaaagggctgcacgccctcgcctttagagggctgcacatcctccctttcagagggatgcacgccctcgccatcagagggttgcacgccctcgcctttagagggctacacgtcctcgtcatcagaggactacacgtcctctccttcagagggctacacgtcctcaccttcataggacaacatgtcctcacctttagagggctacacgccttcgccttcagaggaatacacgtcctcgccatcagagtactacacgtcctcgcctttagagcactacacgtcctcaccttcagaggactgcacgtcctcaccttcagagggctgcacgtcctcccaattcagaggactacac

SEQ ID NO: 24765 - DNA, 312 bp, Glycine max
  Peptide Sequence Number=SeqID_116450
atgagtatagtagtgcaatgcacatcattcacaaaattaaaggcaacttcccccccccccccccacggtgatcagcctgagtctcaagggagttccaaatcgagtgacacaccccctagtacaagtatttctcctcacgagaaactacaagtacttgctgggcaagttacactatttccgtgtcaaatgaggtacgaaacatgggcaccatcaagtgcaatgaccatggataaactaaagatcctaagccatccccctcaagagatgcttagactatttaaccgctctatttcccccactagggacatctga

SEQ ID NO: 24766 - DNA, 327 bp, Glycine max
  Peptide Sequence Number=SeqID_116451
atggagcgcgacggagcaggcacaaaaaacgccgggctgcgcccggcgttttcccagttcatgtgccaaccaacggttggcacccaccggtcaggtggccgatcagctggccagcgccagatcgtccatcatcgcgcgcaggaagcgggcggcttcaccacccgtagccgcgcggtggtcgaaggtgaccgacaacgggatcaccttgtgcgcttccacgccgcccatcaccggggtcatctggtggcgggcacggccggcaccgacgatggccacgcacggcggtaccacgaccggggtcgcatagcggccggcgaacatgccgaa

SEQ ID NO: 24767 - DNA, 537 bp, Glycine max
  Peptide Sequence Number=SeqID_116452
atgtggatggatcggtttgctcttaccttgaacgggagtcaagaacttccccgattgttagccaaggccaaggcgatggcagacacctactccgcccccgaagagattcatgggcttctcggctattggaaaaacaccataactaaacgcgccgcaagggatccctatcgcaccagatccaaatctagaacgatgggtgatcaagaggagacgcaggaacagatgaaagccgacatgtcggctctgaaagaacaaatggcctccatgatggaggccatgttaagtatgaagcagctcatagagaagaacgcggccaccgccgccgctgtcagttcggctgccgaagcagacccgactcccttggcaactacgcaccatcctccctcaaacatagtagacggggaagggacgcactggggcacgatggcagccctcacctgggatacaactgagcggcttacccttatggattgccgcccaactattcacacccatcttgcaagaagatgcgggccacattgcttctcccgtccatga

SEQ ID NO: 24768 - DNA, 153 bp, Glycine max
  Peptide Sequence Number=SeqID_116453
atggaaaaatctgagaggaaaatcttcaatgataagaaaacaaagaaagcttacatcacttgggaagataacgatatgaattcatctgaagactcagaaaatgaagtcatgaatctaagtcttatggccaaaaaatatgaaagcgaagaagag

SEQ ID NO: 24769 - DNA, 408 bp, Glycine max
  Peptide Sequence Number=SeqID_116454
gggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagaaacagctatgaccatgattacgaattcgagctcggtaccccacctagaaaagccttagagattctctcactctcaaccaaaagctctgaaatgcggcgagctctattcaagtacgaaaaccctaatttcacagcaatattcttggagcaaaacgcaaatataaacattcagaatcaatttcctacgaatctatcttttccggcgatcaagccgctggggatcctctag

SEQ ID NO: 24770 - DNA, 168 bp, Glycine max
  Peptide Sequence Number=SeqID_116455
atgttttccaagaaggagggaatgatgagaatcctgaaactggccaaatacaggacttatcaaggtaatccttgtggcgtctaccctcacttatcttccttcaccggaagtggcgtctaccctgacttatcttccttcaccggaaggggcatcatccaaactctataa

SEQ ID NO: 24771 - DNA, 722 bp, Glycine max
  Peptide Sequence Number=SeqID_116456
atgtatttaaaattgcctgtttattttgatctagtcaaagccttctattcaaacttagaaatccaagaaggcaccctaatgtctgatgtttatgggattaagatggtcattgaccaatccctattctatgatttaacccaattgccaagtgaaggtgtaccatttgaaggtgcactgattgacgattggaagtttgatttttctatgcatgattcccgccggttggtttgcaccaaccaagcggatatgaccggaaggcttcttgccagttcattggcttttgaaagcaacatccttcattatctaattgttcacatcttgcttccgatatcttcaaaccttgcacaggtttttgaagaagatctcattgttatgtgggcctttcataaaggtctacaaattgattgggcacatcttgttagatatcgcatgcataaggcattgcgattgaatgctccattaccatatcttcatctagtcacccttttccttcaacactttaacatccctcttgattctgaaccctatgttccaatcaagagatccttccttataggcgcttcagtcatagcatcctttggttatcaaaaagagcatgatggctcttgggtgaaaaagggtgctcgacatgttggtgaagacggacatgatggagaagattcatctcttctttcaaagattttggacaggtttgatggtcttcaaacctttgttggtaaaag

SEQ ID NO: 24772 - DNA, 378 bp, Glycine max
  Peptide Sequence Number=SeqID_116457
atgaggcagattgccctaggaaggaggagaagaagcatgggccagctacaagggttgctagtgaaaagggttcccttgtgtcacatcaacaagagatttgtcagtgcgggttggatgtgcgaggggcggatcaccatgatacacaaagaaacccctcaagagcaaccaaattgggtgcggccgtgccctccggagttcgaattgggaaattggcgaatcgccaaacaacccggaatttccgtggcgagctcaatatccaacaatgagtcttgtgaaggtaatgataccgaggacctagatgttgattttgagcaactgatgaatcaagctgaggaagtggaagacaaggattggggccttcctccagagctaaagtga

SEQ ID NO: 24773 - DNA, 159 bp, Glycine max
  Peptide Sequence Number=SeqID_116458
atgagctcacttagcgcgtgcggtgcgctaagcgagttcacactcgctcagcgcctctgtgcagctcatccttcttctagattcttctgtgcgcttagccagaggatggtgcgcttagcggatggctggcccagcgagtggcctggctcagcgggttga

SEQ ID NO: 24774 - DNA, 753 bp, Glycine max
  Peptide Sequence Number=SeqID_116459
atggatatgaacattagcgccctgatctcaggtcaaatctattatattgctcagagtaactcctttaggctcggatttccagtcttgatcactgccctctgtagagctagaggagttacctctgacagactgacttatgagagcctaagcctggccattaacatggcctacattaagaaaaactgttggaatgtggatgatatgacagttaacttcagaggggcaatgaaggcaagggctcagctagctgatgttccttctttttctactccaccagctccttccacttctgttactcctacaccagctcctccaggcccatcttcccaggactttcagcactttgagttcatgcttcagagtctttatcaaagacagatattattaatgttgagcatgcagttcattgagaaggtagcctggccaggaactcggccttctcttgtgagggaaggtggaggtcccagttctcaggaggctactactccagaaaggtcaccacatattacaccagatccaccctcgccagtggtggatcattgttctcctcagcaactagcagaccatccttcaccagtgcatgagatgccagcagacccttctactccattactgaagattccagaggaccctgccacactagtcctgggactaactaccactcctccagccactcctgtgctacattttacagatgaggagggcacccaggatcaggatacccagcaggatgaccagtcgcaggagttttaa

SEQ ID NO: 24775 - DNA, 992 bp, Glycine max
  Peptide Sequence Number=SeqID_116460
taccgactgttgaagaatttgaggagattctaggatgtcctctcgggggaaggaaaccgtatcttttctccgggtttcttccctccttgagcaagattgcagttgtggtcagggattcggcgagaggattggatcgtgtaaagcaaactcgaaatggcgtagtgggcctaccacagaagtacttagaatgcaaggcaagggatatagcgaatcaagaggagtgggtcccgtttatggacgtattagcattgctaatctttggggttatcctctttccaaacatggatggtttggtggacctagccacaattgatgctttccttgcatatcaccatagcaaagaaagcccagtggtagctatcttggcagacttatttgacacatttgaccgaagggtaccccatgagggagcaccgatggaagaaagcctctctcctttccttgtgagatatttcagcgcgcaaagtttcaagattatacaaagagtccataaggcgtgggaaagcccgttaaggaaagataaagaacttaggggcattcataatggcatcattggtggttatcatgaatggctgaaagttcatacacaagggttagattggctctccaagttaaagattatcaacgaagagaacttcgaagctccagaagaggatgaagaagtccgagctctaaaaaccgaactaggaaaagcgagacttgccaaagaaaaattcaagttggtcgctacagacgtccggaaagagtgtgccggcaacaatgagctcaagcttcgaagggaagagagagaccaatcacgagcacatagcatggtcttgaaagaggagttaaccgcttgctcaaggtccaaaagaaatttgtctcagcgtttatgcgagacagagaccaacatgttagccattgtcagcaagtaccaagaagaactaaatctagccacgacccacgagcataaagtggcggacgagtatgcccaagtgtacgcggaaaaggag

SEQ ID NO: 24776 - DNA, 381 bp, Glycine max
  Peptide Sequence Number=SeqID_116461
atgtcagtgccatcattgaggtcggaaagcagtattgtcaaggaactcaaccgtgaatcttcttccacagaagtaattctgatttgcagaagcagcaattccccctcttccggattccctgccaaggaggcagtattcaacaactcagtggagagagcctgtatgaagaagtatgaagatgctgccagtggtggagcccttggagacatgactcctgctgaagccagaaatttaattgagaaaatggcttccaactctcagcagtttagcgccagaaatgatgccatagtcattagaggagtgcatgaggtagttacaaactcagctgcatcatctgagactaagaagcttgaaggcaaactggatgcattggttaacttg

SEQ ID NO: 24777 - DNA, 177 bp, Glycine max
  Peptide Sequence Number=SeqID_116462
atgagaagcgcacgcttcccgaagggagaaaggcggacaggggggcggagcctatggaaaaacgccagcaacgcggcctttttacggttcctggccttttgctggccttttgctcacatgttctttcctgcgttatcccctgattctgtggataaccgtattaccgcctttgagtga

SEQ ID NO: 24778 - DNA, 324 bp, Glycine max
  Peptide Sequence Number=SeqID_116463
atattgcataccctgatcataactctatgtgccctcctccgtcaaaggtcaacactaaaggtgcaacgaagaaaccgatgaaaagaagtcaaagatccacaaagcgtgatccgtcttactgggagtatgttgatgctttatattctgttcaaagcagtaactcttcagtgaaacatagtgcatcatcttttgaactgccgaagccaacaaggatcatcccaatgttggatcaatttgtgccatttatacaggatttcattcacaacgttgtggatgtgaaaacgggcgataactatggatatcagtccattgccgctttattag

SEQ ID NO: 24779 - DNA, 497 bp, Glycine max
  Peptide Sequence Number=SeqID_116464
ctgtccctcctgttcagctactgacggggtggtgcgtaacggcaaaagcaccgccggacatcagcgctggcaagtgtagcggtcacgctgcgcggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgaattcgatccacagaatcgcttacggaagcgttacggaagcacctcggctaggattttcttcacagaaacaatttttttcaccaaaacagctgaaatgcacaaccaagggggttagggaccctttagaacagcctcccttagcctatttatcggaaaagggggaggaggttgccgcccagctcgcccaggcgagttgggttgcttcctccataagcaaccccgcttccaaaatgttctggaaggcccaaatttga

SEQ ID NO: 24780 - DNA, 414 bp, Glycine max
  Peptide Sequence Number=SeqID_116465
atgacccgcaccaagaaaattgggcagatgacgtctaaggcaataaaggaaattgctgagaagattgtaagattctttggaggagcaggcatcacagggttcctttgtccccatggacgtgaggatgtcctcactgctgccattgggcgaccagaacaccctggtcgtgtacgtgttgctggagccgatgtgaccatcaagcaatactttggatcgactccacggacctctggcacttcttcctccatggctccagaagaactagagcagcttactcaacaaattagggatcaactgaaggagttgatcacaaaaaaaagtgactcggaagctgatggcatccttcaaccagatgcagtccaagtttcagtcacagatggaatcacagggacttgcactacctccagagtttaa

SEQ ID NO: 24781 - DNA, 459 bp, Glycine max
  Peptide Sequence Number=SeqID_116466
atgaccatgattacgccaagctcgaaattaaccctcactaaagggaacaaaagctggtaccgggccccccctcgagagagagcatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 24782 - DNA, 761 bp, Glycine max
  Peptide Sequence Number=SeqID_116467
atggtgaaagttggaacctcttacgtgccgatcaacgtctcattttcgccaaaagttggcccagggcttcccggtatcaacagggacaccaggatttatttattctgcgaagtgctccagtggcttctgtttctatcagctgtccctcctgttcagctactgacggggtggtgcgtaacggcaaaagcaccgccggacatcagcgctggcaagtgtagcgggcgcgtcccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaccatgtaaaggctcaggcggtatatttcctagctgctatcaagcttatcgataccgtcgacctcgagggggggcccgtcgggaaacctgtcgtgccagctgcattaatgaatcggccaacgcgcggggagaggcggtttgcgtattgggcgctagcggagtgtatactggcttactatgttggcactgatgagggtgtcagtgaagtgcttcatgtggcaggagaaaaaaggctgcaccggtgcgtcagcagaatatgtgatacaggatatattccgcttcctcgctcactgactcgctacgctcggtcgttcgactgcggcgagcggaaatggcttacgaacggggcggagatttcctggaagatgccaggaagatacttaacagggaa

SEQ ID NO: 24783 - DNA, 360 bp, Glycine max
  Peptide Sequence Number=SeqID_116468
atgccgatctccccctgcggaagcatcagttggtctgtgtcgtcccgacatagggatcatgcccacaagacacccagtagaccaggagaagtccaacagggccctggggtctccagctttggttacgggcatctggatcgcacccgcaagacacccagtggacccagagaagtccaacagggtcctggggtttccagctctgattacgagcctctgtcagttttacagagtgcctgtcaccccccaacaaggtcattaggccccgcattaactgggctttcatcaagaagtactgtgcccccaggcaggcatagggcgagacaccacagcagcattgggatggccggtagcgggcaatag

SEQ ID NO: 24784 - DNA, 348 bp, Glycine max
  Peptide Sequence Number=SeqID_116469
atgggtgaagtagaggaggtgcaagagaagatgaaggccgacatggaggccatgaaagagcaaatggccacaatgatggaggccatgatgagcatgaagaagataatggaagccaatgcggttatagttgccgctactagcgctgtcgctaaggtgaactcgatgctcccatctggcctcaagcaaatgaatcatccaacctcaaatatggtaggcaaagatttaggaagtacgggcggcccccatgatgtgcaaattcaaaacgagcacgccttcccgtcatatggcttgcctctcaactatgcgccacccaatgtggcgtacactcccaataagaatgtcaaataa

SEQ ID NO: 24785 - DNA, 331 bp, Glycine max
  Peptide Sequence Number=SeqID_116470
atgggtgaagtagaggaggtgccaaagcagatgaaggccgacacggaggccatgaaagagaaaatggccacagtgatggaggccatgatgagcatgaagaagataatggaagccaatgcggttgcagttgccgctactagcattgttgctaaggtgaacccaatgcccccatctggcctcaaccaaatgaatcatccaaccttagctatggtaggcaaagatttgggaagtatgagcggcccctattatgtgcaaattcaaaacaagcacgccttcccatcatatggcttgcctcccaactatacaccactcaatgtggcatacactccca

SEQ ID NO: 24786 - DNA, 249 bp, Glycine max
  Peptide Sequence Number=SeqID_116471
acacttgttagcactaccacacctcttgggcttgaggttattcctcaagtaaaggagttgttggatgagggtttggttcgtaagagcttaaatccttgtgctttgttggtgtccaaaataggtattattaggcaccaaatcgctaaaataggtggtgttgaggaaagaatccctgagtttcaagaacctctggatttaaggtcaaatccctttcaagggggagggaatgatgcaatcctacccccctaa

SEQ ID NO: 24787 - DNA, 687 bp, Glycine max
  Peptide Sequence Number=SeqID_116472
atgtctggcctactgaggagggggttcgggacatgcgctcacgggaagaccagcagtgtgaattcagccagaggaggagctaggcagatggtttcgatgagaaagcgatcgcccaactactgtgcataccaaggcaatgtcttgccgagcgaccacaactttgacctccctctgcctaagtgtcagttggtgtatgccatcctgacgcagatgagcgttcacatggcccaagtgattgctgatgccatttatttgtttacaggaatggcgcctactaggcaccttctggacccagagaagtccaacagggccttggggtttccggctctgatcacgggcctctgccagtcctacggagttcctatcacccccagcaaggtaatccgaccactgatcacccgagcctttatcgagaagtactgcacgcctaggcaggcgcagggcaacgcacatcaggacgcgggcgcaccgccaccacctcggcaagccgattcggttgggccactacgcgtggagcggtatatatatcatttggttcgccagcaggcggccaaacaccatggacaggtgcagatacatgagtgtctctaccggttcagcctcagtcagcagggccagggttccgccccttttgtatgccgtaccctagagcagtttggggctgaggtcgcatggcctggtgactag

SEQ ID NO: 24788 - DNA, 348 bp, Glycine max
  Peptide Sequence Number=SeqID_116473
atgacgttgctacttagcaacattctgcccaactaccgcaatgccgatctccccctgcggaagtatcacgcccacaagacacccagtggtcccagaagagtccaacagggccctggggcttccagctctggttatgggcctctgttagtcctaccaggtgcccgtcccccccagcaagggatcgtgcccgcaagacacccaatggaccctaagaagtccaacagggtcttggggtttccagctctgatgagtgcctgtcgcccccagcaaggtaggcacagggtgaggcaccacagcagcctggggatgcccggcaacgggcaacaggcgcaccaccaccacctctag

SEQ ID NO: 24789 - DNA, 522 bp, Glycine max
  Peptide Sequence Number=SeqID_116474
ggtgctgggaccttcctcgtgcgtaaatacgggtcccgaaccattcacttaaagttcgtagaccacgtctttttccggtttttccgacgttttcctcaaataaacgttggtggcgactccgcgcattttcctttcttggaagacgcacccgtgagtctcgcgccgccctcccgccgaaggggatcgcgcccacaagacacccagtggacccggaggagcccaacagggccctggggtttccagctctggttacgggcctctgttagtcctacagggtgctcgttccccccagcaaggatcgcacccgcaagacacccagtggacccgaagaagtccaacatggtcctggggtttccagctctgattactggcctttgtcaattctacagagagcccgtcgccccaacaaggtcatcaggccccctattgaccgggctttcatcaagaagtattgtgcccccaggcaggtgcagggcgaggcatcacagtagcgggcaacaggcgcaccgccaccacctctag

SEQ ID NO: 24790 - DNA, 222 bp, Glycine max
  Peptide Sequence Number=SeqID_116475
atgacggggttaagtcgccactgtggctgcctcactggcttagctccatcctctaaaagtatcctatgcatgcaggtagataggctaataccaggaatgtctgctaaagttcatccgatggctttcttgtgcttcttgagcactagcaacaacttctcctcttgctcaacagcaagggaggcagagatgatcactggaaatttttcattgtcctctaagtaa

SEQ ID NO: 24791 - DNA, 285 bp, Glycine max
  Peptide Sequence Number=SeqID_116476
atgttccttatattcaacactagtgctttgaaaggacttgatgatactccacaaccgaaatccaaggctgctgctaggtggattgttgttaagtgtaatagacaaaaaggaatcactgaatgtggctactacgtgatgcactggatgtccaccataatcttaggatctttcaggaataattgggagacgtattttaatgaagttagaccattggaagcagagagatttaaggcacttcgcatacagtgggcacaatattatctaaaagttagaaatcaaacatag

SEQ ID NO: 24792 - DNA, 345 bp, Glycine max
  Peptide Sequence Number=SeqID_116477
atggacatagaatatgctataaggaaagatgaaccacctcatgaaaaggtccgagatttgcttaaggccattgatgaccagttcattacttcagataagactttagcaagcaccctgatcatgaagttctcctctctttggctcaccagtgtgaaaggtgtgcgtgagtacataatgacaatgcaagatatttcaactcaacttaagaaactagaggttgatatgtttgagtcattcctggaagaagaaaggcttgacatgaagattgtggaagcaaagtttcatgatgaatcaacaatgattcaaaggtgttttgatgataacaatgatgacaacaaaagataa

SEQ ID NO: 24793 - DNA, 342 bp, Glycine max
  Peptide Sequence Number=SeqID_116478
atgcgtccaaatcttaagggcaaaaactacaatagccaactccagatcatgggtgggataattcctctcgtaagtctcgagttgtctagaagcataggtgtcgcaacctacccttcggcgggagggcgacgcgagactcgcgggattcgtgttccacgaaaggaatacgtgcggagtcgccaccaacgtttatttgaggaaaacatcggaaaaaccggaaaagacgcgatctacgaacttttaagtgaaaggttcgggagttgtatttacgcacggggaagggtgtttccctttgctcctacgtattcctcaatttgggatgagaaaatcagccctacgtag

SEQ ID NO: 24794 - DNA, 234 bp, Glycine max
  Peptide Sequence Number=SeqID_116479
gtcgactctagaggatcccctccttctacctataccgctgttgaagcacctaaaggagaatttggtgtctttctggtcagtaatggaagcaatcgtccctaccgtcgtaaaataagagcacctggctctgcccattcacaaggactcgattctctgtccaaacatcacatgccagcagatgtggtcaccatcataggtactcaagatattgtgtctggagaggtggatagatag

SEQ ID NO: 24795 - DNA, 135 bp, Glycine max
  Peptide Sequence Number=SeqID_116480
atggagggaggaattggagcttctgtgacccggaatgccgctaactccgactcgaagttcctttctgctttttcgatggttccgccatttgaagagttttttcgggatttcaatcggtgtagggacgcgtcgtaa

SEQ ID NO: 24796 - DNA, 207 bp, Glycine max
  Peptide Sequence Number=SeqID_116481
atggggggtcaggtccaactcaacaatggtgctggtaacggctattgcagccgcactgacttccattatcttcttcatgctcatcgtggctccatcattgtggtcattttctctttcatggcctccatgtcggccttcatctactcttgcacctcctctacttcacccattactctaactctagcacaggttcggacatggggttga

SEQ ID NO: 24797 - DNA, 651 bp, Glycine max
  Peptide Sequence Number=SeqID_116482
atgggtgatcaagaggagtcgcaggaacagatgaaagccgacatgtcggctctgaaagaacaaatggcctccatgatggaggccatgttaggtatgaagcagctcatggagaaaaacgcggccactgccgccgctgtcagttcggctgccgaagcagacccgactctcttggcaactacgcaccatcctccctcaaacatagtaggacggggaagggacacactggggcacgatggcagccctcacctgggatacaaccgagcggcttacccttatggattgccgcccaactattcaccacccatcttgcaagaagatgcgggccacattgcttctcccgtccatgaaaaagagcctcctcagcagcccgacgaagtccataaagaccctcaagattatgctcggagggatgtcgagttttatcccccgatccccgaagggccggcaccaggcacgttgccccaacccaacatcgcagcatcgccaatagttttgtctatggaagggccgcccccggcaattgaagaaaggaggaagctcgatctccttgaggaaagattgagggctgtggaaggatttggggactatccgtttgcagacatgacggatctttgcttagtacccgatgttgttattcccccgaaattcaaa

SEQ ID NO: 24798 - DNA, 252 bp, Glycine max
  Peptide Sequence Number=SeqID_116483
atggtgaagaaaccagctcacctgggcgagctcattgcttcagcactaagtttcagttcgcctgggcgagctgcaactgccccaaagggttccaagggtcagaaggtgagggaattgagagaagagagaaaggagaagaagaaagaagaggaaacaaggccgaagcgctaccgaatcgcaatcgcgatcatcccttacttcgtttcatgttccatgttcttcgtgcgagcgccgattagttttattttttag

SEQ ID NO: 24799 - DNA, 774 bp, Glycine max
  Peptide Sequence Number=SeqID_116484
atgggtcaacttcaacggcaagccttccgcaaagccaatggtaagatttgggacctagctagggtagaagtctccatggaaccgattgcatccctttcccagtattatgaccagcccctaaggtgtttcacattcgaggacttccagctagtgccgactatgaaagagtttaaagaaatcctgggatgcccactgggaggaaagaagccatatcttttctctgggaaagggcaaaggccttggaaaatcaaggcgaatgggctttcttttattgacatcttggcgcttttgatctttggagttgtcctctttccgaatatggaagggttagtggacctagcagtgattgacgctttcctcgcctttcattatggcaaggaaagctcggtcgtcgccattttggccatgtatgacacgcccgtctatccgctacaaggtcaccgctcgtgcgtcgaaaaaggaaaggcgaattgggaccaactcttggctagcattgaggggcgtctgggttgtattaattataatcccgtcctcgccataagacagcttggctaccccatgagaggagtgccatcaaacgaaagcatcacgcctttcatcgcacggggtttcggtgaccacaacgcgagggacagagagcttaggggaagcagtaatgggatcatcgacggctatcataagtggctgagagtccagacacaaggattggattggctcccaaatctaaagactgtgagagacaatgaggttaatgcttcggaagaaagtgatgag

SEQ ID NO: 24800 - DNA, 228 bp, Glycine max
  Peptide Sequence Number=SeqID_116485
atgggtctccgaataagattggagaatggagaattggcgaacagcgctaggcaatcaattcgcggggctcgagactcgatgggctccagactcgatggtggcggacgcatgaatagcgctaggcaatcgattcatgggtctctgaataagattgagaatggagacttggcgaacagcgctcagcaatcaattcgcggggctccagactcgatggtggaggacgcatga

SEQ ID NO: 24801 - DNA, 198 bp, Glycine max
  Peptide Sequence Number=SeqID_116486
atggcgaccaactgtgcgagcacaaccagagggggaggctatcgcgcagctactgtgcataccaatgaggatcgcgcccacaagacacccagtggacccggaggagtccaacagggccctagggtctccagctctagttatggtcctctgtcagtcctaccgggtgcccgtccccccagcaagggatcgcgcccataa

SEQ ID NO: 24802 - DNA, 453 bp, Glycine max
  Peptide Sequence Number=SeqID_116487
atgtcaaatcataaaagcactgagtcagcattgaaaaaccttaaggtccaggtgggacaactggccaagcagatagctgacaagtcatccaacagttttgtggcgaatacagaaaagaatcccaaggaggaatgcaaagttgtgatgacaaggagtaaaaggtttatggaggcgaaggatgaggatagtgtagtgtacaagaagaaagatgctgaaaagaaaggtactgatgaaaagaaagatgatgtgattggtgaaagcaatcaggaaaaagaaaaaaagtgcggaagtaccatatcctgtggtaccttccaagaaggagaaggaccaccatttggcgagattcgtagatattttcaggaaactggaaataaccatgcccttcggagaagctttacaggagatgccactctactccaagttcttaaaggatatgttgacaaggaaacataa

SEQ ID NO: 24803 - DNA, 114 bp, Glycine max
  Peptide Sequence Number=SeqID_116488
atgggaaagaagaagctagaaatgggtattgaagaccaaaagaatgtttgtctagaggtgaaggagagtgaagagaaggttctgaaggagagaaccaagcttgatccttgctga

SEQ ID NO: 24804 - DNA, 756 bp, Glycine max
  Peptide Sequence Number=SeqID_116489
atgtcctccacatcgaaggactacacgttctcccctttggaggactacataggattacacgtcctcggcttcagaggactacacgtcctcaccttcagaggactgcacgttctcacctttaatcggctacaagccctcgccttcagaggactacacgtcctcaccttcaaagggctacacgtcctcgccttcagtgggctacaagctctcgccttcgtagggctacacgcccccaccttaaaaggactactcatcctcaccttcagaggactacacgtcctcaccttcagtggactgcacgccctcgccttaacaggactgcatgttctcacctacagaggactacacaacctcgcctttcgagggctagacgccctcgccttcagaggagtacacatcctccccttgagagggctacacgccctcaccttcgtagggttacatacccttaccttcaaaggagtacacatactcaacttcagaggactatacatcgtcgccatcagagggctacacatcctcgcctttagagggctacacgtcctccccttcagaggacaacatgacctcccctttagaggaatgcaagccctcgccttaacaggactgcatgttctcatatttagaggactacacaacctcgccttccgagggctagacgccctcgccatcagaggagtacacatcctccccctgagagggctacacgccctcgccttcgtagggttagacacccttaccttcaaaggagtacac

SEQ ID NO: 24805 - DNA, 588 bp, Glycine max
  Peptide Sequence Number=SeqID_116490
atgtcggctttaaaagatcagatggcttctatgatggaagccatgctaaaaattcaaaaatcaatagaagacaatgctagggaagcggaaccggtgctacagcccgcaatgaactcgggctgggacagaagcgcgacggacttcactccccgtaccgctccagatgatttgagccaagcccctaccttcgaggggcaactccctcctcatgccgactatcatctggaggaagatgatgaaggagatgcccatttaggccctctacttcccccaagggaatcgaccccccatgagttaccccagccaaacataatccgccatgccccgtctcaatctgcacccgttaaggaacccattcccatttcaaaagacaagggaaagatcgatcttcttgaagagaggttgagagcggtggaaggcctcggcaactatcctttctcggatttagtcgatatgtgtctggtacctgacatcatcattcctcccaagtttaaggtaccagattttgacaagtacgaagggacgacgtgtccaaaagagtcatcttcggatgtattgtcaaaggatgggggcatattccatggatga

SEQ ID NO: 24806 - DNA, 306 bp, Glycine max
  Peptide Sequence Number=SeqID_116491
atgacacagaccaaccgatactttcgcaaggggagatcggcattgcagtcgctgggcagaatgtttctaagtagcaacgtcatctatatctgtgtaagagtggtcatgttggtgcgcatgatccgcactcgtctctttgcagcggcatgggtggaatcttgccccagtatgcatagtagctacgtgatagcctccctctttggttgtgctcgcacagttggtcgccctccattatcagggtgtggccctggaactgataaaaggaaattactggcccccttaactgggagcgcaagtctcggttaa

SEQ ID NO: 24807 - DNA, 207 bp, Glycine max
  Peptide Sequence Number=SeqID_116492
atggcatcaaagaagagaaaggcacctgccacaccttcccaagttcgatatggccaatccaggttcacttctcctaaggcctgggaaaggtacactaacattgtggtacccaggaagatactcccagaaagaaatgtggtaatctaccacactgagtttgagagttcaaagaaaaattggagagaagaaaatgggacaaggagttaa

SEQ ID NO: 24808 - DNA, 614 bp, Glycine max
  Peptide Sequence Number=SeqID_116493
gggcaagcgagcccgttgacacgcagagactaacgtcatcttctacacctttgtcatccagagacgacgaatccgaggacatgcgggggtaccttatggttatccgcaccttttgtcatccagagacggtgagaccgatgacatgcgggggggcaagcgagcccattgacacgcagagactaacgtcatcttctgcacctttgtcatccagagacgaagagttcgatgacatgcgggggtactttgtggggtaccttacggttatccgaaccttttgccaaccagaggaaagcgagcccgttgacaagcagggacaaacatcgtcatctgcaccttttgtcaacctggggcaagcgagcccagacgacgagtccgatgacatgtgggggtaccttatggttatccgcatcttttgtcatccagagacgacgagtccgatgacatatgggggggcaagcaagcccgttcacatgcagagactaatgccatcttctgcacctttgtcatctagagacgacgagtccaatgacatatggggctacctttcggttatcggcacctcttgtcaactagaggcaagcgagtccattgacacgcagagactaacatcgtga

SEQ ID NO: 24809 - DNA, 504 bp, Glycine max
  Peptide Sequence Number=SeqID_116494
atgcagattattatttctgttccaccaataacttgtgatttttgccgaagggagcattaccaggataattgttatatgtactccacaaataactctaggtggagacaggagttaactccctataatcagtatgaagaggaaagagccctcgatcttgacattgtgtttgcagaattcatggcatatcatgctagttgtaaagctaatcataatgcaatacaaaagcaggagattcaatgggaaccagaatcacaattcttctaccaaaatgaagcgaaaaagagtttcaatctggagattttgttcatgcaattcaaggatacaattggatttattcaacgggcatttaaaagtgcagaaattcaggttggtaagctggtagaagaagtgactcaagctatgagcagaagagaagaagaaattgtaaaggttgacactcaagaggagagccctgtgaatgagcatgatttagaagaagaagatgaggagaaagcgcaacaatga

SEQ ID NO: 24810 - DNA, 135 bp, Glycine max
  Peptide Sequence Number=SeqID_116495
atggaggcctcaatccctttttctctccgacgttttggaattctatcagagcaatcgaaggaaaaaattgagaaatctcaggaaaccgttaaagatgctgctattgttgtcacaatgcatacttgtgagctatga

SEQ ID NO: 24811 - DNA, 72 bp, Glycine max
  Peptide Sequence Number=SeqID_116496
atggcttgcttggaccagcaacattctggaaaagagggaaaggctgttcataagcttcaggttgctcattga

SEQ ID NO: 24812 - DNA, 302 bp, Glycine max
  Peptide Sequence Number=SeqID_116497
atgatcgttttaagcaatagtcaaataccgcgccaaatccaagacaaagacgaatcgaggtacttggggatgggcacgaatggaggccaggcccatgatcaacagatcgtcgtcccacgtccagctccggacaagcgagaagcgctactgggaggcagcctagaaatggctccaaagaaactctccacgaagaggtctagaagagacgccacaggggaaggatccagtggtgcctcagagtttgatagtcactgtttccagagtgccgaacaccaacagcgtttcgaggccatcagggggtg

SEQ ID NO: 24813 - DNA, 188 bp, Glycine max
  Peptide Sequence Number=SeqID_116498
ctcccttggaagtgttggtgcactttcacatgggccatggggtaatctcattggtattggatgcatcgttaggagatcccttccccccgctttcaaaaatgatgaagatgaagtccgcggggctgcaggtactatggatcctctgactcccaatcgggtagccttcccaggtctcgccggtcttgcct

SEQ ID NO: 24814 - DNA, 588 bp, Glycine max
  misc_feature (15)..(15): n is a, c, g, or t
  Peptide Sequence Number=SeqID_116499
atgcccattacaatnttcgacggcatcgtcatcgccgttgttcttttctccgccattctcgcgatggtccgcggtttttcccgcgaaatcctgtcgattgcgagctgggccggttcggtcgccgccgcctattatctttatccggtcctgctgccctatgcgcgcaactataccgatgacgacaagatcgccattgccggttccgcaggcgtcgttttcctcgtctcgctgatcgtgatttccttcatcacctcgcgcattgccgatttcatcatcgacagccgcatcggcgcactggaccgtacgctcggattcctgttcggcgcggcgcgcggcattctgcttctagtggttgcggtcgccttctggaactggctggtggatgtgaagacgcagccggaatgggtgacgcaggcgaagtccaagcccttcctcgacgggctggtgggcaagctggaggcggttctgcctgacgatatcgagccgcagattcgcgctcgcatccttggaaaaccgcaggaacagacgaccacgcaggcgcctgccgaagatgtgccggcaacaaatccgccggcaacgaataattga

SEQ ID NO: 24815 - DNA, 195 bp, Glycine max
  Peptide Sequence Number=SeqID_116500
atgttagccctgcctcatgagcatggacgttccatgcttagtaggcgggcttctaaactaacaggtattcaattatctataaggtccccccctcttgtcctcttaacaaaagctactctcagtccgatgtgcgagatcttagagcctaccttagctacgtccaccctgacgagggacaactctagattctactaa

SEQ ID NO: 24816 - DNA, 243 bp, Glycine max
  Peptide Sequence Number=SeqID_116501
atgggtgccaagtacctcgaagtggtcaaacgagggtcgcatcccaacaaacagatggcacagaatgaccataatttgtctccgagtgccctcggacacgatcgagcctgggtggcaaggcgcagaatgaccataatttgtctctgcgtgcaaccgaacacgatcgcctctggatggcgaaaaggtgtggggaatgaccataatttgtctctgcccacctctcgacttattgtccctgaatga

SEQ ID NO: 24817 - DNA, 246 bp, Glycine max
  Peptide Sequence Number=SeqID_116502
atggtgttttttggtgggaaatttggatccgagtgttttggcctttccctttttctgtttttgtttagtgcgggacgagaaagtcgccagcgcacaggattttggttggcaatcaaagggaaagggccacttcaattcgtggtcttggctcaaaaggcttgcataacgaccggacgtgatgtatgtcagggtgttggtttggccagcggttcagggataaaggaatgtcccacattgtttccatga

SEQ ID NO: 24818 - DNA, 144 bp, Glycine max
  Peptide Sequence Number=SeqID_116503
atgggcgaggaagagaaaaaaccagaggaaaacaaagtggaggagaaaaaagcaaatgaagaaaaaaagaaagaagaagagaaaaaatcagaggaatcaaaagatgacaaggaatccaaggagaaatctgcgcggccagaaatc

SEQ ID NO: 24819 - DNA, 155 bp, Glycine max
  Peptide Sequence Number=SeqID_116504
atcagttcagggctgaggttgcatggccgagagattggcttgaggcccaggcaggggaggcgcctgcagaggctcccggcgacgcggatgaggcctgcatggatgaggagatgtcagatttactcggtttcttgggagggagtggagccacatga

SEQ ID NO: 24820 - DNA, 645 bp, Glycine max
  Peptide Sequence Number=SeqID_116505
atggaggccatgaaagagcaaatggccgcaatgatggaggccatgatgagcgtgaagaagataatggaagccaatgcggttgcaattgccgctaccagcgttgttgctaaggtgaacctgatgtccccatccggcatcaaccaaatgaatcatccaaccttagatatggtaggcaaagattttggaagtagggacggcctccatgatgtgcaaaatccaaacaagcacgccttcccgccacaaggcctgcctcccaactatacaccacccaatgtggcgtacactctcaatgaggatgtcaataactccactcctatacccattgagagccgacaaccccaaactgttcatgcacatgtctctcaacccatgggtgagacacatgaaatgccccaccacaatcaagccgacttcgagccttgcctcggatatgccactaaaaggcagacaattgatggtatacccctacaaaaccctttggagggccctcagtatcacccccagctacacctcttgcattccacaacaaaggaaaggctcagggcttttaaaggaggtgaagattatgcctttgctaacctagaagagtcgttcctagtgcccaatatcatcacccctcccaaagttcaaggtgttggactttga

SEQ ID NO: 24821 - DNA, 324 bp, Glycine max
  Peptide Sequence Number=SeqID_116506
atggtgatgcagtggaatgatggtgacgatgatggtggaggtggtggtaaaaatgtgatgatgatagtgacgacggatgaaaagaacattggagctctgttcacactgcctgctaaggttgatagtatgattggacagaggactagaataggagagcatgaggccatgaggaagagaatgaaagacatggaaaagaagcaaagagaagcagaaggccaaagctcccaagatgcttcaaacaataaagacaaggaagaacaagaaattaaagcgaggcctttaaacatggaagacatgagacaggctaagagtcaggtagggtga

SEQ ID NO: 24822 - DNA, 269 bp, Glycine max
  Peptide Sequence Number=SeqID_116507
atgacactcactagagatgtacacttcaatgaaggtcagaaatgggattggaacaactcacaaatagatgggtccttcctcaacaatggagacaatcatcccggagagcaaacaatagagcttatgcagaatgaattagaagatgaccttccaatcagaggaaaaaggcctgaagatagaaaagtcattggagttaaatggattttcagaataaagcttaatgtagattcctcagtcaacaaacacaagacgagactcgtggttaaagg

SEQ ID NO: 24823 - DNA, 228 bp, Glycine max
  Peptide Sequence Number=SeqID_116508
atggtggatgagagaaaagaagaagaaggctgcctatgccacatgtctccatttgagtggagcaaaaagggcccacctttttctcttgatgtgactcatactcagccacatgaagagaaaaatctgaccttttggaacgctaaaatcctgcctcggtttgcgtgccgtttctctggttccagttcattgtgtttctctgcgcccgtcgatgccagttttcgaaagtag

SEQ ID NO: 24824 - DNA, 175 bp, Glycine max
  Peptide Sequence Number=SeqID_116509
agcacaaaatttcgtgctcttctctccctctcccttcattcatctccttcttcctccaagctcttatccatggcctcctatggtgaagcaaaggaatccattgatgaagaagatcctaggcctacaagctccaatggagcttacatcatgtggtatcaagagcatcttcatctag

SEQ ID NO: 24825 - DNA, 420 bp, Glycine max
  Peptide Sequence Number=SeqID_116510
atggtggagcgtggccatggaatgtattacacgccacaaacatttgctcagtatccaacgcagatgtatcagtatcattttcagggtcatcacactgatacttctgcaagccagcattcgttcgatggtgttgcggaaacccaacctcatttttcatggcccactatgaccccttcacagcaatattatggcccaattccaacacctaatgccccatcaggaacacaatggaatgtaccgggaccaatacctaatatgagtgacttattaggtgttgatttgcgccacgaattttctgctgaggctgacgaagaagaagcggggaggcatcggggcagaagaaatcctgattgccaagcacgaagatgggatcgaccatgtggcacatcctcacgacatcacggacaccaaaatgaatga

SEQ ID NO: 24826 - DNA, 704 bp, Glycine max
  Peptide Sequence Number=SeqID_116511
atgccggccatcggcaagcagagctaccgcgccagcccgaccttcagcgaatccaccgctgccatcgatccggccttccgcgccaaggtcgccgccgattcgatcgctccttgccgtggccacggcctgatcgccgccgggttccttgaagacggccagggcttccaggccaccgccaacagcaacggcaacttcgcctaccagcgcacgaccaacttcgactacacctgcaccgtgcgtaccgaagatggccgtggttcgggctgggttggccgcaacctgaaggatgccgccgacttcaaggccgaccaggacatccgcatcgccatgcgcaaggccaccgaatcggccgaagccaaggcgctggaaccgggcaagtacacggtgatcctggagcccgccgcggccgcgggcctgatcagcttcatgatgaacttcttcagcgcacgctcggccgatgaaggccgcagcttcctgtcgaagaagggcggtggcaacaagctgggcgagcaggtctacgacccgcgcgtgaccatgatcgccgacccgtggcatccggacgcaccggtgctgccgtgggacggcgaggccatgccgcgcgagcgcttgaccatcatcgagaacggcaagatcgccaaccaggactactcgcgcttctgggcacagaagcagtgcaagaccgccaaggcaacaccgggcaacct

SEQ ID NO: 24827 - DNA, 528 bp, Glycine max
  Peptide Sequence Number=SeqID_116512
atggggacaaatcaaaccggcaagaggttttaccaagtcaaggttaaaggcctagataccaccaacatcaaggaattagggcggttgatggaacctctccaaatgcaagccttccgtaagacttacggaaagatcttagagttgaccatagcagaggtatccatagaagccattgcatcactcacccaatactacgaccagcctttgagatgcttcacgttcggagacttccaattgggaaagaaaaccatacctttcctccgggtgtctcccctctttgagcagaattgcaactgtggtcaaggattcagcaagaggtttggaccacataaaacagactcgaaacggcatagcgggcctaccacggaagtacctagaagacaaggcgaggggtatggccaatcaaggagattgggtcccgtttatggatgtgttagctttgctaatttttggggtcgtcctctttccaaacgtagatggtttggtggacctagcagcaatcgatgctttccttgcataccaccatag

SEQ ID NO: 24828 - DNA, 456 bp, Glycine max
  Peptide Sequence Number=SeqID_116513
atgggtgaagtagaggaggtacaagaacagatcgaggctggcatggaggcgttgaaagagcaaatggcctcaatgatggaggccatgatgagcgtaaaggagataatggaggtcaatgcggtcgcaatagccgctaccaacaccattgctgaggtggacctgaccccccccccatatggcctcaaccaaataaatcatccaaccttagatatggtaggtctggaaggcaaagaattgggaggtacgggtgaccctcatttagtgcaaaaaacaagcatgccttcccgccatatagcttgcctcccaactatacaccacccaatgtggcgtacactcccggtgaggatgtcaataactccactcccatactcattgaaagccgacaacctcaaactgatcatgcacatgtctctcaacccatgggggagacgcatgagataccccaccgcaatctag

SEQ ID NO: 24829 - DNA, 375 bp, Glycine max
  Peptide Sequence Number=SeqID_116514
atggtcaaggaggagtgtaaggagacacttgttcgcattgccacacctcttaggcttgagtttattcctcaagtaaaggagttgttggatgagggtttggttcgcaagagcttaaatccttgtgctttgttggtgcccaaaataggtattattaggcaccaaatccctaaaatgggtggtatgatgaatgctttgggtggtgcaacactcatttgtaaaatcactcgtgcacccaacatcttcatgatttgtgtacattgggactcattaggggttcccatgaaccctaagagaataaaagtcattcctgagtggcccgctccaccaagtgtgttgaggaaaaaggcccagagtttcaagaacctcgggatttga

SEQ ID NO: 24830 - DNA, 420 bp, Glycine max
  Peptide Sequence Number=SeqID_116515
atggaaatccatgtcaggcacccatttgccgtggcacatggggaaatccatgcaggcaagagccgcgtaattggtgctgacccagccgcccagcgtcacctggatcagcagcaggatgaagccgccgaccacccagggcctgaaacgccgcgccgcggcggccaccgcatggtgcgggcgttcacgcgccgacaaccaggtcatcagcgccagcaccgacaggccgaacaccaggtgcgccgtgaccacggcgggcatcagcttgtgcgtcacggtccaggcgccgaacgcgccctgcacgcacaccgccaccagcgtggtcaccgccagggccggcgagcggcccagttcgcggcggtagcgccaggccatgtagacgatgccgatgatcagcatgcccaggatcgagccgacgtagcg

SEQ ID NO: 24831 - DNA, 261 bp, Glycine max
  Peptide Sequence Number=SeqID_116516
atggtgaattccatgttatcctattcgggtttaagtgaaggattttggggtgaggctatgttgacaacctgttacttgttgaaccgaattcctaacaaaaggaataagagattggaacacatcttgaaagtatcccaaaaggtatgtgttcggttctgtgcaagaaagaaaaggactacctatataagcataaagtttagccgcttcaagaagctgggacttggctttgatatgcttatgaaggatagggacacaggctag

SEQ ID NO: 24832 - DNA, 291 bp, Glycine max
  Peptide Sequence Number=SeqID_116517
atgatcatgaggggtcaagacatttatagtagtcaagaggagactacttctttaccttcctctagtggaagtgaagatgaagtaaggggtgaagagtctagtgaggaagtctacccccatgaagaaggtgacctcttaatggtggccaaagatcaattaactacgaaagataagatggatgaggaagaaaaacaaaagaaaaagaaggatagtaaggccttgtcgtcaaaggccaaggggaaggaaaaagaggaaaaaaattcctccaagaagattgttgtcataccctaa

SEQ ID NO: 24833 - DNA, 174 bp, Glycine max
  Peptide Sequence Number=SeqID_116518
atgcccaatttcagtgcgctaagcgcgcatccaccgccaagtgcggctttagcgcgcttagcgcaaaggggaatctggcaaagcatccgcatcaaggtcgcgcgcaatgcgcgagatcagtgcgctgagcgcaacaattgtcttcagctaggctcagcgcatgactggcgctaa

SEQ ID NO: 24834 - DNA, 774 bp, Glycine max
  Peptide Sequence Number=SeqID_116519
atgacacctttgaccgaagacgtgagaagagcagtacaaggattgtctgctgtactcctgctctttatctatggttggtttcacaccttttttgccaagagagaaggagcatttgtcaactggttccctcaatggaaagaaggaagaatcggagttcttatctcatgcggaggatttctaaatgttcccttgatggggacaaggggttgcatcaattacaatcccgttcttgcgataaggcaactgggctacccgatgaaaggggcaccactagaggaagagctcgcacctgtcatttcacgaggtttcaataagaccaacatggagacacttcagaaggtccgcaaggcatgggaggtggtacaaaagaaggacaaagagaagttgagaaccgcggaggaagttgagagcccacgtgcaaggacagaactcgagcaagctcaaacagccaaagaaatgttcaaatcaatggctcttaggatccaaaaggagaatgccaaactgagggatgtaaatgtagctaccaccaaggctttggaacaagagatcaagagggctcgtagggaagagcacggccggaacaagttccgaggggctctgtggggtagtaacaacgagcttaaactccggagggaggaaagggaccaatcgcggaccaacatgttagccatcatcagcaagtaccaagaggaactaagtctagccatggcccacgagcatagggtggcggacgagtatgcccaagtgtacgcggaaaaggagactagaggaagg

SEQ ID NO: 24835 - DNA, 417 bp, Glycine max
  Peptide Sequence Number=SeqID_116520
atgattttgtcacttgaggacaaaagtgctaaagttgatgtctcactaagcaagctcaatgtgcttagcgagtgtcatctgctaagcgaggcatcgacacgcttagcggataggaggaatctggaagggaatatgtcacacagacacacactcagcgcgtcatcagctcgctcaatgagtcatttgtcaccttccaggcttagcgcgagtttggcgctcagcgaaaattcacttactcgcgctaagcacgagaatggcactaagtgcgaccttgagtactttattattgcatgcttgtggcttgatcacccatatgtgtgtactgttaggggctttagcattgaaagatgtattgtctccttagaacttgatagagcaggattaggttaccgtatgtctggacacggagtgcggtaa

SEQ ID NO: 24836 - DNA, 375 bp, Glycine max
  Peptide Sequence Number=SeqID_116521
taccctcgtcttcagaggactgctcgtcctcgccttcagagggctacacgccttcaccttcagaggactacatgttctcaccttcacagggttacacaccctcatcttcagaggactatacgtcctccccttgagagtgctacacgccctcaccctcagaggactacgtcctcgcctccagaggactatatgtcctcgccttcagagggctacacgccctcaccttcagagggtcatgtaccctcaccttcagaggactacacatcctcgccttcagaaggctacacgccctcgccttcaaaggactacacgacctcccctttagagggctacacactctcgccttcagtggactacacgtcctccacttcatag

SEQ ID NO: 24837 - DNA, 838 bp, Glycine max
  Peptide Sequence Number=SeqID_116522
atgctgggaatgaaacaactcatggagagtaacgcggccaccgccgctgctgttagttcggctgccgaggcagactcgactctcctaactgctacacaccaccctattccaaacatgatgggaggagagagaagcacatcggggcacatcagcaacccccatccggggtacaaccgaggaacttacccctacggtttaccacctaattacacaccaccagccatacgtgacgacgcgggtcacgttcctcccctcatcctcgaaggggagcctcctcgacatcctgacgaggtccacgaggatcatcgagagcatgctcagggagacgtcgactcctactccccgtttcctaccgaggggccagtgcccaacgcactacctcaacccaatatcacgggagaacctcgaagccacccaactcagccaatgtttctgtctgtgggagggccacccccggcagcagaaggaaaggggaaactcgatctcatcgaagaaagattgagggctattgaagggttcagcgattatccgttcacagacatgactgacctatgcctggtgctggatgtcgcatccctccaaagttcaagggacgagaagttattgatgcatttctttcaagatagcttggctggggcagcattcatcagcttcgcggacttggtcttcgccgaagaaaggatcgaggtgggtttgaaaaggggaaagtttgattacgtctccccggtaggtgccagcagtaggaggaccagaatagctggggcaaagaagaaagagggagatgcccataccgtcactttaacacctgcgtggcccaagccaccgcaaaccccccacg

SEQ ID NO: 24838 - DNA, 677 bp, Glycine max
  Peptide Sequence Number=SeqID_116523
gatggacccttgggtactaacgccctcaccttcagaggactacacgtcctcgccatcagagggttgcacgccctcacctttagaggactacacatcctcgtcatcagagggttgcacgcctttagaggactacacgtcctcgccgtcagaggattacaagtcctcaccatcagaggactacacgtcctcgccgttagaggactacacatcctcaccttcagagggctacacgccctctccttcaaagggctacatgtcctcgccatcagaggattacacgtcctccacttcagaggactacacatcctccatttcagaggactacacatcctcgcctttagagggctacacgctctcgcctttatttctgggccaccccctgatattgaagggcgaccaactatgcaagcacaaccagagagggaggctatcacgcagctactatgcatactggggcaagatttcacccatgccgttggaaagagacaagtgtggatcatgcgcaccaacatgaccactcttacacaaatatggatgacgttgctacttagcaacgttctgctcagcgaccgcaatgccgatctccccctacggatggatcgtgcccgcaagacacccagtggacccggagaagtccaacagggtcttggggtttccaactctgattacgggcttct

SEQ ID NO: 24839 - DNA, 407 bp, Glycine max
  Peptide Sequence Number=SeqID_116524
ttaacttcagaggggcgaggaaggcaagggtgagactagctgatgttccttcttcttctactctaccagctccttccacttatgctactcctacaccagctcctcgaagctcatctactcaggactctcagtgttatgaagccatgcttcagagtattcatcagggacaaattttattactgcagagcttgcaggtggtagctcctccagggtccattgtgttggtagagcagttcattgagaaggtatcctggcctagaaccttgccttttgttgtgagaaaaggtgagggtcccagtgctcaggcaggcagggcacaggtaaggcatgaggctactacttcagagagatcaccacagatttcaccagatccaccctctccagtggtggatcaatcttctctttag

SEQ ID NO: 24840 - DNA, 589 bp, Glycine max
  Peptide Sequence Number=SeqID_116525
atggacgttgataagatccttccatctagcagcaccttaggatggcatagccttaaagttaagggcgaggttcaaacgaagaaaggcttatggtggatacctaggcacccagagacgaggaagggcgtagtaagcgacgaaatgcttcggggagttgaaaataagcgtagatccggggattcccgatataggtcaacctttcgaactgctgctgatccacgggcaggcaagagacaacctgagctatacaagtgtcgtgctgctaggcgaagcagcagagaatgctgcaccctagatggcgagagtccagtagccgaaagcatcactagcttacgctctgacccgagtagcatggggcacgtggaatcccgtgtgaatcagcaaggaccaccttgcaaggctaaatactcctgggtgaccgatagtgaagtagtaccggaaaccaccggagccgtagcgaaagcgagtcttcacagggcaattgtcactgcttatggacccgaacctgggtccgaaccgactgatgttgaagaatcagcggatgagttgtggttaggggtgaaatgccactcgaacccagagctagctg

SEQ ID NO: 24841 - DNA, 647 bp, Glycine max
  Peptide Sequence Number=SeqID_116526
gactacacgtcctcatcttcagagggctacacgtcctcgccttcagaaggctacacgtcctcgcctttagaggactgcacgtcctcgccttcaaaggactgcacgtcctcaccctcagaggattgcacgtcctcgccttcagaggactgcacgtcctcgccttcagaggactgcacgttctctcgtttagagggctacacgccctcgccttcaaaggactgcacgccctcgcctttagagggctacacgtcctcgcctttagaggactgcacgtcctcgccttcagaggactacacgtcctcatcttcagagggctacacgtcctcgcctttagaaagctacacgccctcgccataagaggactacacgtcctcgccttcagaggactgcatgtcctcacctttagagtactgcacgtcctcgcctttagaggactgcacgttctccccttcagagggctacacaccctcaccttcagaggactacatgtcctcgccttcaaagggctgcatgccctctccttcagagtgctacacgccctcaccttcagagggcaacaagtcctcaccttcagagggctgcacgtcctcgctttcaaagggctccacatttgtgcctttagagaactcaaggtcctctgcccttaa

SEQ ID NO: 24842 - DNA, 69 bp, Glycine max
  Peptide Sequence Number=SeqID_116527
atgacggatgatgtcgtttaccacggctactgtgctaagtgtcatcacccggctgcagatgatgagtag

SEQ ID NO: 24843 - DNA, 372 bp, Glycine max
  Peptide Sequence Number=SeqID_116528
atggatgaaatagagaaggtgcaagagcagatgaaggccgacccggaggccttgaaagagaaaatggccccaatggtagaggccatgatgagcataaaggagatagtggtggtcagcgcggcttaccaaacccgtgctagagctaaaataatgggtgaagtagagaaggtgcaagagcagatgaaggccgacatggaggccatgcaagagcaaatagcccctcctgctatggctaaaaagggaaaggtggatcatctaaaggaaaggctcagggccattgaaggagatgaagattatgcctttgctaacctagaagagttgttcctaatacccaaacatggtcatccccaagttcaaggtgccggactttga

SEQ ID NO: 24844 - DNA, 394 bp, Glycine max
  Peptide Sequence Number=SeqID_116529
ggctctcagccacatggatagtttaatgtgctcatcggcgcctgaccctgagatgtggatcatccaaggcacattagcatggcgtacttctcctgtgagatccaatgtagatccaactttctcttcactcgtgggatccgggcgatccgggggggaccaccacggctcctctcttctcgagaattcatacatcccttatcagtatatggacagttatctctcgagcacaggtttaggtttggcctcaatggaaaaaaacggagcacctaacaacgtatcttcacaggaccaagaactacgaagatcgcccctttcattctggggtgacggtgggatcgtaccattcgagcctttttcatgctttcccgggggtctggagaattgcaatcaatag

SEQ ID NO: 24845 - DNA, 510 bp, Glycine max
  Peptide Sequence Number=SeqID_116530
atgagaggggcaccactagaggaagagctcgtgcctgtcattacgcgaggtttcaataagaccaacgtggaggcacttcagaaggtccccaaggcatgggaggtggtgcaaaagaaggacaaagaactcagaggcagtaataatgggcccatcggtggctaccgtaagtggttgaaagcccacgtgcaaggtttggattggctcccgagtttgagaaccgctaaaggggaggaagttgaggcaccggaggaagacgaagaggtgcaggcccttagggcagaactcgagcaaacccaaactgtcaaagaaaggttgaaatcagcatctcttaagatccaaaaggagaatgccaaactgagagatataaatatagctaccaccaaggccttggaacaagagaccaagagggctcatagggaagagcacggccggaacaagtttcgaggggctctgtgggcagtaacagcgagcttaagctccggagagaggaaagggaccaatcacaagtag

SEQ ID NO: 24846 - DNA, 582 bp, Glycine max
  Peptide Sequence Number=SeqID_116531
atggagaccgaaaacacatacttttcacatgagatgcggagagtgtactattactcttcaagatgtctctgttttattaggtctccgtgtagatgggtcaccgttaataaccttagttgggttgatttatgtgaagaattgttaggagtcaaatcagaagaaggtgaacttcaagatttaaataaccataatgataatttagaacaggtagaaaggtttacccgtgcatggatccttcgattcattggaggtgtcttatttgttgacaaaagcagtaacaaagtttcgtttgtctgggagccttactcagcaaatgttatgttagtgttgcctccaatttgtttagttggaagtgttgcgtggtgcgcggtggtgccactaatttacttcctagtcattgagtggcaccaacccgatagagttttgagacaatttggcatgcaacaaccaattccaagttctccttcgcaaccatttaatattcatggcataactttgagaggaaaacatgaggaaaattgggggcaactattaggcccaatgatcaatcaatggaacaatcatgctgattttagggcgtaa

SEQ ID NO: 24847 - DNA, 688 bp, Glycine max
  Peptide Sequence Number=SeqID_116532
aggagtgcatgaggtagctacaaatccatctgcatcatctgaaactaagaagcttgaaggcaaactggatgcattggttaacttggtaacccagctggtcttgaatcagaaatttgttcctgtcgcaagagtttgtggtttgtgctcctctgctgaccaccatacagacctttgcccttccatgcagcaacctggagcaattgagcagcctgaagcttatgctgcaaacatttacaatagacctcctcaacctcagcagcaaaatcaaccacaaccatacattcctccaccaatccaacaacagcaacaaccccagaaacaaccaacagttgaggcccctccacaaccttccctcgaagaacttgtgaggcaaatgactatgcagaacatgcagtttcagcaagagaccagagcttccattcagagcttgactaatcagatgggacaattagctacacaattgaatcaacaacagtcccaaaattctgacaagctaccttctcaagctgtccaaaatcccaaaaatgtcagtgccgtttcattgaggttgggaaagcagtgtcaaggacctcaacccgtagcaccttcctcatctgcaaatgaacctgccaaacttcactctactccagaaaaaggtgatgacaaaaatttacctaacaatttctgtgcaggtgatcttcttccacag

SEQ ID NO: 24848 - DNA, 791 bp, Glycine max
  Peptide Sequence Number=SeqID_116533
atggctacctcaccaaaagaaacttcagctcctggttcaccctctgtaccatcatctccatcatccaccaaagcaccatcaaaccaggaacgacctgaattcaatatccagcccatacaaatgattcctggttcagcccctgttcctgaaaaattggtccccaaacgacaacagggtgtgaagatttctgaaaaccctagccttgcaacaagtcctagggaagtagacacggagatggacaagaagatccgcagtattgtgagtagcattttgaaaaatgcttctgtccctgatgctgatgaagatgttccaacatcttccaccccaaatgtttctgtgcctgatgttgataaagatgttccaacatcttccgccccaaatgctgaaaggagactctctgcaccaagggcaccagaacctgctccaggtgacctcattgacctggaagaagtagaatctgatgaggaaccccttgccaacaagttggcacctggcatcgcagaaagattacaaagccgaaagggtaaaacctccattaagaggtctggacgaatcaaaactatggcacagaagaagagcactccaatcactcctaccacatccagaaggagcaaagttgcaatcccttccaagaagaggaaagaaatttcctcatctgattctgatgatgatgtcgaaccagatgttcccgacatcaagagggccaagacatcagggaaaaaggtgcctggaaatgtccctgatgcaccagtggacaacatctctttccactccattggaaatgttgaaag

SEQ ID NO: 24849 - DNA, 612 bp, Glycine max
  Peptide Sequence Number=SeqID_116534
atgattatgaggagccaagacatttatagtagccaagatgaggctactacttcaccttcctctagtgaaagtgaagaagcaaaaggggaagaatctagtgaagaaatctacccccaagaagaaggaaaacctttaatggttaaggaggagtgtaaggaggtaagtgtctcctccaagaggttagctaagaaggaaagacattttgaaataaagacaaatattaaagaaatttcccctcttaaacaacctccacattttctcctttataaaaagacacttgttcgcattgccacacctcttaggcttgagtttattcctcaagtaaaggagttgttggatgagggtttggttcgcaagagcttaaatccttgtgctttgttggtgcccaaaataggcattattaggcaccaaatccctaaaataggtggtatgatgaatgctttgggtggtgcaacactcatttgtaaaatcactcgtgcacccaacatcttcatgatttgtgtacatagggactcattaggtaggaataatcaacatgaaaatacagaaaaaggggttcccatgaaccctaagagaataaaagtcattcctgagtggcctgctccaccaagt

SEQ ID NO: 24850 - DNA, 414 bp, Glycine max
  Peptide Sequence Number=SeqID_116535
atgacgtcatggtcggggatgtgcggcagctcggtgcgctgcttcgagaagcgtcgagcatactctcgaagagtttctcctgacttctatttgcacttgctgaggtcccatgaatttccgggccgtatttcctcgagccatcggcgggcagtgtcggagaggaagagcggtaattgtctgatgatggcccgatcatcccctcaagcgccacctagctggcaggccaacctaaaatcggccagccataattctggtttggtctcaccattgtacttcgcgatgctggtcgggggtcggaacggactgggcaggggcgtgctgcggattgccctgctgaacactcgtgggcccggtggctcgggggccacccgatcttcgtcgctgtcgtacctcccaccgcgatgtgcgctgtaa

SEQ ID NO: 24851 - DNA, 192 bp, Glycine max
  Peptide Sequence Number=SeqID_116536
atgactcaatctccacctcgtgagaggactcttagggagatggttgcacctgacttcacttatgaaagcttgtgcattcaatatcctgatgaggatgttccatataaggctaaatcaaagcctagattgatcaggtggatgctttggttccaagagtttgatttggagatccgtgatcagagtggtgcatag

SEQ ID NO: 24852 - DNA, 318 bp, Glycine max
  Peptide Sequence Number=SeqID_116537
atgtgtcctccaccaacgagtctgaagcccgcgaattcattgcctagcgctgttcgccaattctccattctcaatcttattcggagccccagaattcattgcctagcgctgttcatgtgtcctccaccatcgagtctggagccccgcgaattgagcgctattcgccaattctccattctcaatcttattcggagccccatgaattcattgcctagcgctgttcatgtgtcctccaccaacgagtcgggagccccgcgaattgattgcctagcgctgttcgccaattctccattctcaatcttattcggagacccatga

SEQ ID NO: 24853 - DNA, 492 bp, Glycine max
  Peptide Sequence Number=SeqID_116538
atgaccaccctgacccagatatggatgacgttgctgctcagtaacatcttgcccagcgatcataattccgacctccctctgccgaagtgtcagctggtgtacgccatcctgacacggatgagtattcacatggctcagttgatcgctgatgccattgatctatttgcaggtatggcgccgaccaggcaccctatggacccagataagtccaaccgggccctgggatttcccgcgctaatcacaggactctgccagtcgtttggagtccccgtggcacctaccaaggtaattcggccacccatcacccgggcttttattgagaagtactgcacccagagacaggctcagggtgatgctccacaggccgcaggcgcaccaccaccacctcatcaggctggcccggctgggtcgtttgacatggagcacgcatacatttttgtttggattgttgcgttaatgcttatatcattattatcgatgatgtttatttga

SEQ ID NO: 24854 - DNA, 276 bp, Glycine max
  Peptide Sequence Number=SeqID_116539
atgtcatcaagtcaatcaatatcgatcaatacacaagcgttatgcaacatatacactaagactcaatcctatatgcaatgtggtaccatgtcagtgaaaaaccacgtcgagcacctaggagtacatgacaagacaaaccacacactagcaagtcaagtcactctcaccaggaatgctccaaccatatgggatcaacataggcttaaaggagcactcaaaccacgtgacccccaaggcctacacttcaaagagtccgtcagggcctctccctcttga

SEQ ID NO: 24855 - DNA, 249 bp, Glycine max
  Peptide Sequence Number=SeqID_116540
atgaaggttcattgtaatcaagcaagtcggagacctagcatgaccacagattcacctccactccttatgttcccatggactcagtcctcagtggagtcaccaactgtcacagcctacccttcggcgggagggcgacacgagggctcacgggtgcatcttccaaggaaggaaaacgcgcggagtcgccaccaacgtctattcgaggaaaacgtcggaaaaaccggaaaaggcgtagtctatgaactttaa

SEQ ID NO: 24856 - DNA, 596 bp, Glycine max
  Peptide Sequence Number=SeqID_116541
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgtttcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggactataaagataccaggcgtttccccctggaagctccctcgtgcgctctcctgttccgaccctgccgcttaccggatacctgtccgcctttctcccttcgggaagcgtggcgcttttctcatagctcacgctgtaggtatctcagttcggtgtaggtcgttcgctccaagctgggctgtgtgcacgaaccccccgttcagcccgaccgctgcgccttatccg

SEQ ID NO: 24857 - DNA, 324 bp, Glycine max
  Peptide Sequence Number=SeqID_116542
atgccatatcctgaggatgctgattgcacgtcctatttagacaatagcttgatattagcagagctaaattacaacaatgataataccatatcagaatttctgcaacttttttcatccatgacaggtacaggaaaaaccttcatatggagaacattggcaacttcattgagagcaaacaatcaaattgttattatagttgcttccagtgacatagcttctctattgttgccagacggtaggactacacattcaaaattcaaaatatctgtacccatttatgaaaactcaacatgcaacattcatcaaggaagtgaattagcttaa

SEQ ID NO: 24858 - DNA, 345 bp, Glycine max
  Peptide Sequence Number=SeqID_116543
atgatcatgaggggtcaagacatctatagtagccaaaaggaggctatttattctccttcctcaaatggaagtgagggtgaaaccaagggtgatgagcatattgaagaggtttacccctatgaagaaggtgttttgatgataacaatgatgacaacaaaagatgatgacaaaggtgacgaacaaaaagctcaaagatcaaataacaactcaagtgaatcaggaacaagtcaagagttcaagaatcaaggagaattcaagactcaagaagaaatcctagaatcaagaatcaagattcaagatctcaagaatcaagatcaagattcaagactcaagattcaagaatga

SEQ ID NO: 24859 - DNA, 704 bp, Glycine max
  Peptide Sequence Number=SeqID_116544
cggatgccgggagcagacaagcccgtcagggcgcgtcagcgggtgttggcgggtgtcggggctggcttaactatgcggcatcagagcagattgtactgagagtgcaccatatgcgggcgatcggtgcgggcctcttcgctattacgccagctggcgaaagggggatgtgctgcaaggcgattaagttgggtaacgccagggttttcccagtcacgacgttgtcgactctagaggatcccctcgttgaaaccccgatgctgcactggccggacagcatgatgacctacatgaccggcgacgcggtattgttcagcaacgacgcctttggccagcactactgtgacgaacgcctgttcaatgatgaagtggatcagaccgaactgtttgagcagtgccagcgctactacgccaacattctgaccccgttcagccgtctggtgacgccaaaaatcaccgagatcctcggctttaacctgccggtggacatgattgccacctcccacggcgtggtgtggcgtgaaaaccccacccagatcgttgagctgtacctgaaatgggcggcggattatcaggaagaccgcatcacgattttctacgacaccatgtccaataacacccgcatgatggcggacgccattgcccagggcatcaacgaagtggatccgaacgtagcggtgggtaccgagctcgaattcgtaatcatg

SEQ ID NO: 24860 - DNA, 80 bp, Glycine max
  Peptide Sequence Number=SeqID_116545
atgagaagaatacaaatctggggatcccacggtcatgtggctccgcatgccaccgaactcttaggtcacagtaacaaaag

SEQ ID NO: 24861 - DNA, 826 bp, Glycine max
  Peptide Sequence Number=SeqID_116546
atggagagaagtatgatagatgttgccagtggtggagcccttggagacatgactcctgctgaagccagaaatttaattgagaagatggcctccaactcccagcagtttagcgccagaaatgacgccatagtcattagaggagtacatgagctggccttgaatcagaaatctgtacctgtcacaagggtttgtggtttgtgctcctctgctgaccaccatacagacctttgtccttccatgcagcaacctggagcaattgagcagcctgaagcttatcctgcaaatatttacaatagacctcctcaacctcagcagcaaaatcaaccacagcagagcaattatgacctctccaacaacaaatacaaccctggatggaggaatcaccctaacctcagatgttccagcactcagcaacaacaacagcagcctgctccttctttccaaaatgctgctggcccaagcagaccatacattcctccaccaatccaacaacagcaacaaccccagaaacagccaacagttgaggcccctccacaaccttccctcgaagaacttgtgaggcaaatgactatgcagaacatgcagtttcagcaagagaccagagcctccattcagagcttaaccaatcagatgggacaattggctacccaattgaatcaacaacagtcccagaattctgacaagctgccttctcaagctgtccaaaatcccaaaaatgtcagtgccatttcattgaggtcgggaaagcaatgtcaaggacctcaacccgtagcaccttcctcatctgcaaatgaacctgccaaacttcactctattctagaaaaag

SEQ ID NO: 24862 - DNA, 1210 bp, Glycine max
  Peptide Sequence Number=SeqID_116547
atgaacctgaacgccctgttttcccgtttctcgatccgtacgcggattttctccacgctcggcctcgtcgccgtgctgctcgtcgtatcggggctgatcggcctcgcgggcatgcagagctcgaatcgtgcgctcgacgaggcctatacgcggcaactggccgcgaagaccgcgctgtccgcggcgagcctgaacctgacgatcgtgcgcaccacgctcgaccgtgcgctgctgcatccggaagcgccggacgtatcggaactcgtgaagaaggccgagggctatctcgcgaaggccgacacggcgtggcgcagctacgcggcgatgccgcacggcgacgacgaaggcccgctcgcgagccgcctcgatgccgcgcgccaggcgctgatcgggcaggcgctgaagccgatgatcgacgcgatccgcggaagggcggcgcgacgaagccgaccgcttgctgatgaccgtcgcgccgccgttgtcggtcgcgctcacgcaggcgaccgacgcgctcgatgcgtaccaggccgcgcgcggcaaggacgtgtacgacactgcgcagacctattacggctggatgcggatgggcgcgatcgcggggatcgcattcgggctggccgcgtgcctcggctgcgcgatcggcctgcatttcgcgatcacgcagccggtgaatcgtctgctgtcgcatttccgccgcctgtcggaaggcgacctcacgtcggaagtgcgctggtcgtcgcgcgacgagatggccgaactggtcaacggcgtgaccggcatgcagcgcagcctcgcggacaccgtgcgccaggtcagccagggttccgaggcgatttcgacggcgacgcaccagatcgcggccggcaacaccgacctgtcgcagcgtaccgaggaacaggcgtccgcattgcaggagacggccgcgagcatggagcagctcaccgcgaccgtgaagcagaacgcggacaacgcggtggaggcgcaggcctgcgcggacaccgcgagcgagatcgccacgcgcggcgcgaccgtggtcggcgaggtgatcggcacgatgaacgagatcgaccagagctcgcagaaggtcgccgacatcatcggcacgatcgaggggatcgcgttccagaccaacatcctcgcgctgaatgcggcggtcgaggccgcgcgtgccggcgagcaggcccgcggcttcgcggtggtcgcgggcgag

SEQ ID NO: 24863 - DNA, 231 bp, Glycine max
  Peptide Sequence Number=SeqID_116548
atggcagcggaatggagaaggaagagagagaggagacgccacttcaaggagaagatgagtctagaagaagctcaccaccataggaggccatggataagagcttggaggaagaaggagatgaatgaagggagagggagagaagagcacgaaattttgtgctctaaaagagctctgaaatctgaactcactaatccaagatcaattccaagattctccactaagtgtgcttag

SEQ ID NO: 24864 - DNA, 385 bp, Glycine max
  Peptide Sequence Number=SeqID_116549
gggatccccccccccaaagacccctagtgggccccggagggagccccaacagggcccctgggggtttccagggggggagatcgcgcccgcaagacacctagtggacccggagaagtccaatagggtcctagggattccaactctgattacgagcctttgtcagttttacagagtgcctgtcacctccagtaaggggcagggttccgcctcttttgtatgccctaccctggagcagtttggggctgaggtcgcatgccctggagactggcccgatgcccaggcaagggaggagtctgcaggatcccccgatgaggcggatgaattccatatggatgaagatatgactgacctactcggtttcttgggagggagcggagccacgtga

SEQ ID NO: 24865 - DNA, 195 bp, Glycine max
  Peptide Sequence Number=SeqID_116550
atgcctataggttggaccttccacaagtgtggagctaatattgaggaggaggaaccaacagatttgaggtcaaatcctcttcaaggggaaggggatgatgcaatcctccctaggaagggaccaatcactagagccatgagcaagaggctccaagaggattgggctagagctgctgaagaagacactagagactag

SEQ ID NO: 24866 - DNA, 923 bp, Glycine max
  Peptide Sequence Number=SeqID_116551
ggtaaaactaacctgtctcacgacggtctaaacccagctcacgttccctattggtgggtgaacaatccaacacttggtgaattctgcttcacaatgataggaagagccgacatcgaaggatcaaaaagcaacgtcgctatgaacgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtggtttcgctggatagtagacagggacagtgggaatctcttgactgttcgacgcccggggaagaggccccgaagggcccgttcccaatccgtcccccgaccggcacgcgacgacccgctctcgccgcggaagcagctcgagcagtccaccgacagccgacgggttcgggactgggacccccgtgcccagccctcagagccaatccttttcccgagtacgaccgggcgtgggaggcactcggtcctccggatttccaagggccgccgggggcgcaccggacaccacgcgacgtgcggtgctcttccagccgctggaccctacctccggctgagccgtttccagg

SEQ ID NO: 24867 - DNA, 300 bp, Glycine max
  Peptide Sequence Number=SeqID_116552
atggctaccctcgacatcacccttcatcaagatgttactcgaagagtttcaccagtcacctgtggggggccatatgggagtacagaagacattacatcgcctacacgaaaacttcacttggagttcaattcgagaggatgcatgcaagcttggcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctga

SEQ ID NO: 24868 - DNA, 249 bp, Glycine max
  Peptide Sequence Number=SeqID_116553
acttatcaaggtaatccttgtggcgtctacccagacttatcttccttcaccggaagtggcgtctacccagacttatcttccttcaccggaagtggcgtctatcctgacttatcttccttcattggaagtggcgtctacccagacttatcttccttcaccggaagtggcgtctatcctgacttatcttccttcactgaaagtggtgtcatccaaatcttcgtaacctgtatcaagcgatccactccgtaa

SEQ ID NO: 24869 - DNA, 326 bp, Glycine max
  Peptide Sequence Number=SeqID_116554
ttcttccggaagagcgcgtcttccggaaagttcccggaagaggttttccgggagtcttccggaagaagtgttcttccggaagacgtttggttacttccggaagaacacttcttccaagggttactaccctaaggtaactatcctaaggttccactgctacaacaatgttgtatcatacaagcaaaggggagttagggagactaacctcgttcacggagaagaagaagacaaggttcgtgcttgccttgcggagaagaagaagcagttcgcggagaagggagaagaagcagttcgcggagagggagaagaagtttcgcggaaggaaa

SEQ ID NO: 24870 - DNA, 726 bp, Glycine max
  Peptide Sequence Number=SeqID_116555
atggctacctcaccaaaagaaacttcagctcctggttcaccctctgtaccatcatctccatcatccaccaaagcaccatcaaaccaggaacgacctgaattcaatatccaacccatacaaataattcctggtccagcccctgttcctgaaaaactggtccccaaacgacaacagggagtgaagatttctgaaaaccctagccttgcaacaagtcctagggaagtagacacagagatggataagaagatccgcagtattgtgagtaacattctgaaaaatgcttctgtccctgatgctgataaagatgttccaacatcttccaccccaaatgtttctgttcctgatgctgagaaagatgttccaacatcttccaccccaaatgctgaagtcctctcttcctccagcaacgagagatcaacagaggaggatgatcaagccacagaggagacccctgcaccacgggcaccagaacctactccaggtgacctcattgaccttgaagaagtagaatctgatgaggaacccattgccaacaggttggcacctggcattgcagaaagattacaaagcaggaagggaaaaacccccattactaggtctggacgaatcaaaactatggcacagaagaagatgcagcagaagatacagaatcagatgatgatgattctgaagccaccccatgatcatcagacctttatttttgcttctcacttttactggctatag

SEQ ID NO: 24871 - DNA, 486 bp, Glycine max
  Peptide Sequence Number=SeqID_116556
atggataacattttaggaagacacatcttacctgagaggaaggtggaaatataccacactgagctggacaagtttaaggctgaattggagaggcgtaacttccataaacgcctcaccaatttagttgacaacaacatagacttagctttagtgaaggagttttatgctaacctttacaggtctgaagaccctccaccaaagcatgccaaggtcagaggccacctggtgaagattgatgcagacaacctcaacacattcttggagacacctgtgatattagttgagggtgagactttaccagcatattctagatattgtaggttgctcacaaattataaagagattgaggctgccttatgtataccaggccgagggtttgttttgaactctgagggccatcctgggaagattctcaggaacgatttgatgactcttgctcaggtgtggaaggggttacttctgacagcttggttttcgagcgcctga

SEQ ID NO: 24872 - DNA, 616 bp, Glycine max
  Peptide Sequence Number=SeqID_116557
atgtctgggatggctgagctgcagggggacaacaggcaagccgggtgtcagctcctctgtatggacatgaataatatgaaaagaaaaacgcttcccctggttctcggttgtaccctctcgttatccacgctggcggcgcagccgccaaccgaacgctatagcgtcacttttcctcaggggacgcgcgtcagctacagcggtgcgttcgccagcgcgtttccggagggtttgccggtaggcatcggttccggtttgctgtttaccggcaggcagggagatacgctcaactttgtgaccgtcaccgaccgcggaccgaacgccgactcgcctgacatgggtaaacaggagtcgaaaattttcgtcacgccggacttcgcgccgctgctgatgaatatccaggtgaagaacggcaaagcgcaggcgacggacgcccgaccgctgcacgacgcaaagggcaatattaacggcttgccgctgcagaatggcgtcatcgggtcaaccaatgagatcgcgctaagcgataagttgaaagtactgcagggcgataaccggggtctggatacggaaggcattacgctggacgggaagggcggatactggctgtgcgatgagtatg

SEQ ID NO: 24873 - DNA, 165 bp, Glycine max
  Peptide Sequence Number=SeqID_116558
atggataagcatgaagaactccaccgaccaaagctgcagagagtattggttattaagcacaatgcaaaccagcgctatgctactagtggaatcacaccttttctttttaaagaagctggaaaaatccataaccttccaactcagcagagaccttttgggaattaa

SEQ ID NO: 24874 - DNA, 490 bp, Glycine max
  Peptide Sequence Number=SeqID_116559
atgactactatatctgacaagtcgcactatatatcaacccaagatgcatcttcttccccagggcttcgaaagggtactcttggaacaccaatgggcataaaatggagaaataataaaatcatatatctaactttagtgtggaaacgaatactaaatataaaaaaaggaatactaaataaagtaaagttgttacgaatgggtcattggggtgataagggtattttcatgggtttaccttggtatcgtgttcatactgttgtattaaatgatccaggccgtttgctttctgttcatataatgcacacagctctggttgctggttgggccggttcgatggctctatatgaattagcagtttttgatccctctgaccctgttcttgacccaatgtggagacagggtatgttcgttatacctttcatgactcgtttaggaataaccaattcgtggggcggttggaatatcacaggagggactataacgaatccgg

SEQ ID NO: 24875 - DNA, 768 bp, Glycine max
  Peptide Sequence Number=SeqID_116560
atgtttggaagcaaggcgagaaccttggcaagtcaagacgaatgggctcttttcatggatgtcctggtgctcttgatcttcggagtggtcctctttccaaacgtagatgggttggtggacttggcagcaattgatgcttttctcgcctttcacgatcgcaaggaaagcccggttgtcgctatcttagccgatctatatgacacattcgaccgaagatgtgagaagaacagtgcaaggatcgcttgctgtacaccagccctctacgtatggttggtttcacaccttttctgccaagaggtgaaacacgtttgcccgctagaagatcaccgctcatgcaccgagaagaaggaggcaaattgggaccgactcttagcaagcaaagaaggagcgtttgtcagttggttcccccgatggaaagaaggaagaaccaaaattcttatttcgtgcggaggatttccaaatgttcccttgatggggacgaggggttgcattaattacaataccgtcctttccataagacaacttggctaccctatgaggggggtaccattagaggaaggcctcacaccttttattgcgcaaggtttcaatagcaccaacgtcggggtgcttcggagggtctgcaaggcatgggaaatggtgcaaaagaaagacgaagaactttggggaagtagcaatgggcccatcggtggttaccataagtggttgaaagcctacgcacaaggtctgggttggctcccgaatttgagagccactaaagaggtggag

SEQ ID NO: 24876 - DNA, 261 bp, Glycine max
  Peptide Sequence Number=SeqID_116561
atgatacatgtttatgaaggacaagaatttgaggttagactatctcaagctaggtatgatgttgcgttaagtgttggtgaatcacaactcactcctttaaatcctattgaagaacaaagacttatgactcggtgttgggttgcagctgcgggaccaaagcataagggatgcctttatggtattggagatcttgcttatacttataaatgtggagatgacaacttcatgcaacatacacaaggatcttcccgtcacacttaa

SEQ ID NO: 24877 - DNA, 315 bp, Glycine max
  Peptide Sequence Number=SeqID_116562
atgaggtcctttaatggtgattttccaccatggagatgcagcggaagacaaaggagaagaggtgagaggaggcgccatccactagggaataagccatggaagaaggagtttcaccaccaagatgagccttggataagaagcttggaaggatgctttaatggaggaaaagaaagagggagagaaagagggggggagcacgaaattgaaggaataaaagagggagagaagtggaactttaaagtagcttcctttagaagctttcttgagaaaacttccttgagaagcttctttgagaaaacttccttgagaagctag

SEQ ID NO: 24878 - DNA, 771 bp, Glycine max
  Peptide Sequence Number=SeqID_116563
atggcatccttcagccaccttcagtcgcagatgcaatctcagggacttgcagtgcctcttgagcctctggttggtcttggtccctccggtcctcgagtgagcacaaaggggagttgtgttgatccctcaggaaatgatcctgagaccggtgactctgacaggtgcggcttgtacatagaagcagatcctgcccgcctggtttccatcgggagagtttatgagggatccactgttgttcataacactcctttgttgcttggccaagtaaaggtgagtgtggaggaggttagagatgtagatgctccagttcctgtacccactgatgaggtttccttagtggggcaggcacttcacaccttccttgcttggccgacacatctggtcaagtctttatcacagcaggttacatgggatgccaccgtgttcggggtctttaatctagatttcccctcgtacataaagtacgaagatctctccgaaatcgcacacggtggtcaatgtcttagcatatcactgttacagttgtggattctgcatctcactgaaacaagtatgcgagcggggaattctgatatctatggattcctcgagccacagtccattcagaggtctgggcaatcgcagtttgagtctgaaagttacataaagacttggatgcagagctcacccatgcgatgtctatcttggagcctacctaaatggcggacactggcagatggtggtcatcctgcccaaggaacacctagttgtctggttttgttcattgcataa

SEQ ID NO: 24879 - DNA, 207 bp, Glycine max
  Peptide Sequence Number=SeqID_116564
atggcacatttcatacccttgtatggttttaatcctttgactcctcttgatttgttaccattgcctaacatttctgattttaagcataaggatgcacaggctaaagttgcaaagaaggtgatgattctaaacattgaagggcaaatgctttccaagaaggagagaatgatgagaatcgtaaaactgcccaaatacaaggacctatga

SEQ ID NO: 24880 - DNA, 273 bp, Glycine max
  Peptide Sequence Number=SeqID_116565
atgactgcagaacaagtcacgtacaacattctcatccttcatcctatgtcagtgaatacattgatctcggtcaagcaacatcatgagttgttgcatttcagtgttactccttatgaaagaacggcctatactcaccactcctttcgcaagctattaacaaaaatgaggcccttctgtcgcaacctacccttcggcgggagggcgacgcgagactcgcgggatgcgtgttccatgaaaggaatacgcgcggagtcgccaccaacgtttatttga

SEQ ID NO: 24881 - DNA, 408 bp, Glycine max
  Peptide Sequence Number=SeqID_116566
atggcgagagatagattgacacatagtgaagtacataatatcaggctgaaattgattgctgaccgtgaaaaagatggtcgtatatataatgtgcctactgtttcagaagtagttgcacttattacaggtgattttgatacacattcaaaaagagatattattcttgagactcaaaatggccaatcacaaaggatagatgaattgcattctagttatctaggtcaaatgaagcacaaactttgttgcactctaggaaactcttccagcaatttgtcgttgaagggtatactatggttgaatccaaaagactttccttcatcagacacaactaaaaaaaacttagagttgacaagttttccagcttgcaacagtcattggatgctagtaccaccaaaggcttacaaaaag

SEQ ID NO: 24882 - DNA, 117 bp, Glycine max
  Peptide Sequence Number=SeqID_116567
atgacgagtagggtgtttcctcctgccggggatagtttttccctagtccggtcctataagaatacgttcttagcatcacaaccctttcatggactccccggagacctccctctctaa

SEQ ID NO: 24883 - DNA, 497 bp, Glycine max
  Peptide Sequence Number=SeqID_116568
atgagagaagtgccatcagacgaaagcatcacgcctttcatcgcacggggtttcagtgaccacaacgcgagggtactccaaggagtttcgcaagggcataggatgcggcgtgaagaaaggacagagagcttaggggaagcagtaatgggatcatcggaggctatcataaagtggctgagaatccgaacacaaggattggattggctcccaaatctaaagactatgagagacatgagggttaaagcttcgaaagaaagtgatgaggtacaagccctaaaggcagagcttgaaagagcctgggtagtcgaagagaagttcaagtccatagccatcaaaggcagcaatagtaagctcaagctccgaagaggtgagactgaagggtatatgtgggccatcatcgataagtgcaaagagaagctaattctagcggcgactcacgcccaaaggctagaggatgagtacgccaagatatcagcagaaagggaagcaagggaaag

SEQ ID NO: 24884 - DNA, 1247 bp, Glycine max
  Peptide Sequence Number=SeqID_116569
atgcgccagaagtgagcaaaacaccaaaataccgcgtatttaacggcgtgaacgaactgcctaaagaggaagcctatctgctggagccttacgataccgtgagcgtcagcggtttctaccgcagccagccggacatcaacgacgctatctccaaagaagcgaagaaaaaaggcgccgcctcgttcttcatcgtgcgccaggttgacgccaactccggcggcaaccagttcgttaccgcctacatctataaggccgatgcgccaaaacgccgcgtgcagagcccggatgccattccggccgattctgacgccggccgcgccgcgctggccgccggcggcgccgctgccgcgaaagtcgaaattcctggcgtcgcgtcttccggttcgccaagccgcgaagtgggtcgtttctttgaaacccagtcttctaccggccaacgctataccgtcacgctgcctaacggcaccaagatccaggaagtgaacaacgtgaccgccgcgcagatggtgccgttcgattccgtcaccttcaccggccacttcaacagcatgaccgatgtctccaccgaagtggcgaaacgcgcggccgagaaaggcgccaagtactaccacgtcacccgccagtggcagaacaagagcggcggcaacctgaccgatccgtcattggaaaaaaaactcggtcttaccgcgctaaccgctttggtgctcagctcaatgctgggcgccggcgtgttcagtctgccgcaaaacatggcgcaggtcgccagccccgccgcgctgctgctgggttgggggatcaccggcgtcggcattctgtttttggccttcgccatgctgttgcttacgcgtttgcgtccggatctggacggcggcattttcacctatgccaaggaagggttcggcgagctggtgggcttctgctccgcctggggttactggctgtgcgccgtgatcgccaacgtctcgtatctggtgatcgtgttcgcggcgctgagtatcttcaccgatcgcggcggcagcgtgattctcggtgacggcaatacctggcaggcgctgatcgccgaatccgccctgctgtggatcgtgcacgcgctggtgctgcgcggcgtgcaaaccgccgccagcatcaatctggcggccaccctcgccaagctgttgccgctgggaatgttcgccgttctggcggcgatcgcctttaaaatggacgtgttcacgctggatttcaaaggcatcgccctcggcaagccg

SEQ ID NO: 24885 - DNA, 327 bp, Glycine max
  Peptide Sequence Number=SeqID_116570
atggtggcgcgggtaatgctcaggcacggttatgagcccggaatgggtctgggcaaggacagccacaggaatgccgatgtggttgacattaggggtaacccgcacaaatatgagttggggtatgagcccgggaaacctggaagaaggaatgcaccgtcaagactccgggaagatagggcatggcctgatcatgaagaggtggcagcaataggagaagaggctccacaagatccgccgagtttcgtgcgaccatgccatcccaatttccaactggggaactggcacgtgacgagccagtcaaaagtctataccgctgattcaatgtaa

SEQ ID NO: 24886 - DNA, 456 bp, Glycine max
  Peptide Sequence Number=SeqID_116571
atggattctctcatcactaggcttctccgtgtgcctcacttatcgaaggatgaaaatcctactgatagtgtggagacgtcagcaatggttgcatcacgtggtagaggaggcggtcgcaacagcagaggaggccgcaatggaaggggtggacgtcctcattgcacctactgcaagaggatgggtcacacccaagagaattgttattcgttgcatgggtttcctgacaaggttgcacaggtttctagatcagagaaagcagagtctaagttctctgatgaggagtatcaggagtatttgaagctcaaatctgagagacccagcaaccaagctcaatcctcatctgtaccatgtttttcaacagcttgtatctctcaatcaattgaaggtcctagtccttggatactcgactcaagtgcctctgaccatattttctggaacatgggacggggcgactga

SEQ ID NO: 24887 - DNA, 144 bp, Glycine max
  Peptide Sequence Number=SeqID_116572
atgccgcccaggattttgatagtcaccgattccggagcgctgagcaccagcagtgtttcgaggccatcaaaggatggtcgttcctcagggagaggaggaggtagctcagaggcgatggactcaacttgtatcacctatggctaa

SEQ ID NO: 24888 - DNA, 351 bp, Glycine max
  Peptide Sequence Number=SeqID_116573
ggcaaagaaggcctccttctgggggggccagagccatcagtgagataccactctggaagagctagaattctaaccttgtgccaggacctacgggccgagggacagtctcaggcagaagggagcttgactgcaagacccacccgtcgagcagggacgaaagtcggccttagtgatccgacggtgccgagtggaagggccgtcgctcaacggataaaaggttgggctgttcgcccattaaagcggtacgtgagctgggttcagaacgtcgtgagacagttcggtccatatccggaccgggaaggacgcacctctggtgtgccagttatcgtgcccacggtaaacgctgggtag

SEQ ID NO: 24889 - DNA, 327 bp, Glycine max
  Peptide Sequence Number=SeqID_116574
atgaaagagtcaaggcccaaattgaaaaaaggaatgagagctatgctagacaagcaaacaaaggcgcaaaaaggttattttccaacccggagattgggtttgggttcacatgagaaaggagaggtttccagagcaaagaaaatccaagcttcaaccaagaggggatggtccatttcaaatggagaagctgatttgaggacaaatccttttgaagagggagagagtgatgaggacatggcaaggactaagggcaaagaacctctagaaagacttagaggacctatgccaaggactagtacaaagaaggccaaggaaactcttcaataa

SEQ ID NO: 24890 - DNA, 313 bp, Glycine max
  Peptide Sequence Number=SeqID_116575
atcaccggtggatgctaaaagggtcaacaatgagtcagtttggtggcaggatttgatggcggtgatccatgaccaacaattcaataatgtacttcaagagggaacaatatggaggcccctatttgacaatgaggtagcctcagctgtaggttttttggaagatatatctcatactgcactacaacaacacgcagcagacagctcggtatggaaacctgaacccaatggttactactcttctaggagtgcctacattctgctccaagggaactcagaggagggaaacatggatgatatattcaaggacttatga

SEQ ID NO: 24891 - DNA, 661 bp, Glycine max
  Peptide Sequence Number=SeqID_116576
atgggtggtggtgcatggccgttcttagttggtggagcgatttgtctggttaattccgttaacgaacgagacctcagcctgctaaatagctatgtggaggtctgtgatgcccttagatgttctgggccgacgcgcgctacactgatgtatcaacgagtctatagccttggccgacagatcattgcaattgttggtcttcaacgaggaattcctagtaagcgcgagtcatcagctcgcgttgactacgtccctgccctttgtacacaccgcccgtcgctcctaccgattgaatggtccggtgaagtgttcggattgcggcgacgtgaacctgcggaaggatcattgtcgatgcctcacaatcagattgacccgcgaacttgtttattcatctaccgtcgggagggaggggatgaccacggcgccccgaactcaaatctgttaagtgcgactcccgggggcccggagacggtgtcccgcgggagtcgtcacgacacaacatttacatacaatgactctcggcaaacggatatctcggctcttgcatcgatgaagaacgtagcgaaatgcgatacttggtgtgaattgcagaatcccgtgaaccatcgagtctttgaacgcaagttgcgcccgaagccattaggccgagggcacgcctgcctgg

SEQ ID NO: 24892 - DNA, 579 bp, Glycine max
  misc_feature (401)..(401): n is a, c, g, or t
  Peptide Sequence Number=SeqID_116577
atggataacgaagagggagtgaaagaacagatgaaggccgacctatcagccgtaaaagatcaaatggcttctatcacgaaggccatgctaaaacttcaaaaaattatagaagataatgctacggcgaccgcttccaatacagctagggaagcggaaccagtgctacagcctgcaataaacttaggccgagacagaaacacgacgggtttcaatcggaggtatagtcctcaagcctacccttatggtttgcctccggacttcactccccgtaccgctccagacaatttgagccaagcccctaccttcgaggggcagctccctcctcatgcagactatcctctgcagaaagatgatgaaggagatgcctatttaggccctctacttcccctcaaggaaccggncccccatgagttgccccaggcaaacatagtatgccacgtcccgtctccatccacacccgttaaagaactcgttcccattgcaaaagacaagggaaagattgatctacttgaagagaggctgagagcggtagaaggccacgacaactatccgttctcggatttagcgaatctgtgtctg

SEQ ID NO: 24893 - DNA, 534 bp, Glycine max
  Peptide Sequence Number=SeqID_116578
atgggatgccaccagttcgggctctttaatccagacttcccgctctacataaagcatgaagacctctccgaaatcgcacacagtgatcaatgtctcagcatatcagtgttacagttgtggattttgcatctgactgaaacaagtatgccagcagggaattctgatatctatggattcctcgagccacagtccattcagaggtctgggcaatcgcagtttgagactggaagctacataaagagttggatgcagagttcaaaacgcaatgtctatcttggagcctacctgaatggcggacactggcagatggtggtcattatgcccaacgaacacctagttgtgtggttttgttcattgcataacaagccagacaactaccttaagaggataattaatagtgctttaaaaggtcttgatgatgctccacagcctaaatcaaaggctcctgctaggtggattgtcatcaagaccattggagccagagagattaaaggcgttgcggatctagtgggcacagtattatctccgagttag

SEQ ID NO: 24894 - DNA, 176 bp, Glycine max
  Peptide Sequence Number=SeqID_116579
atgtccgaagaagttgatatggattttcaagatgaacaagattatggtgtgaatgaaagacatgttgattgctcagatgcttttaatacttctcaggtctttgcaacccgagaagatgttttgaagtgggctcgaacggttgcccatgaaaacggttttgttgcagtaattatgag

SEQ ID NO: 24895 - DNA, 222 bp, Glycine max
  Peptide Sequence Number=SeqID_116580
atggcgcctcctctcacctcttttcctttgtcttccgctgcatctccatgtgatcaaggggttcccacggaccctaagagaataaaggtcattcctgattggccccctccaccaagtgtcgagggaaggagcctagagtatgaagaacctcaggatttgaggtcaaatcctttccaaggtggaggggatgatgcaatcctaccccccaagggtattggatag

SEQ ID NO: 24896 - DNA, 1821 bp, Glycine max
  Peptide Sequence Number=SeqID_116581
atggccgagcgttcacgccaggtgccgggtatcgaccctctgcgcgatgccgctctgtccttcgccgccagcgcggatgatccggccagcggtggccgccacaaggtgtggggcagcaagccattgtgggtgctgccgcagacctcgacgattgcttcgcacctgccgaaggcgctgggcaccgcgctggccatcgagagcggcaagcggttggggcaggcgctgccgctgccggcgccgatcctgttcgtctgcgaggacaacgggctgggcatttcggtgaagacgccggacggctggattgccgagcgcttcagccggcagccggggctcgactatttcttcgccgatggcctggacctggccaccgggcacgcccaggtgcaggccgcggtggaacattgccggcgcacgcggcggccgaccttcctgcatctgcgtaccacgcgcctgatgggccatgccggcaccgactttgaagtggaatggcgcgcgctgccggagctgtgcgcggccgaggcgcaggatccgctgctgcgctcggcgcagatcgcgatggaatcgggctggatggatgcagccgccatcgaagtggcctacgaaacgatgcgcgcgcgctgcatggcggcggccgccgacgccgaaggccacccgacgctgcagtcgctgcaggacgtgatggcgccgctggcgccgtacacaccggcggcggtgcaggccgaagcatgccgcgaggtgcccgccgagacgcgcgaagcgctgtatggcggtgcagagaccctgcctgagcggcaggcgccacggcacctcgccatccagatcaaccacggcctgcaggaactgctggcgaagtatccgcagagcctgttgttcggcgaggacgtcgcgcagaagggcggtgtctacaccgtcaccaaggatctgctgcgccgcttcggcccacgccgggtgttcaacaccctgctggacgagaccatgatcctgggcatggcgcagggcctggccaacatgggcatgctgccgattccggagatccagtacctggcctacctgcacaacgccatcgaccaggtgcgcggcgaagcgtgttcgttgcagttcttctccaatgaccagtaccgcaacccgatgctggtgcgggtggccgggttgggataccagaagggtttcggcggccacttccacaacgataattcgatcacggcgctgcgcgacattcccggcctggtggtcggttgcccgtcgcgtggcgacgatgcggtgatgatgctgcgcacgctggcggcgctggcccgggtggatggacgtgtggcggtgttcctggagccgatcgcgctgtacatgagcaaggacctgcatgagccgggcgatgtccagtggctgttcgactacccggcccagggccaggcgctggtaccggccgaggggcgggtctatgcgccggaggcagtcgacctggtggtctacacctatggcaacggcgtgccgacggcgctgcgcgcggcgcgggcgatcgagcagcagctgggctggcaggttcgggtggtcgacctgcgctggctgctgccactggatgcggggttcatcgccagccaggcggccagtgcacggcgggtgctggtgctggacgagggccgccacagtggcggggtgggcgagggcgtggtgaccgcactggtcgaggccggtttcggccatctgccgctgcgccgggtctgcggtgccgatacctataccccgctggcgggggcagcaatgttcgggcttccaagcgacactgccctgattggcgccgcccttgaactggcgcaggaaccttga

SEQ ID NO: 24897 - DNA, 441 bp, Glycine max
  Peptide Sequence Number=SeqID_116582
atggcatcgttcagccagatgcagtcccagatgcaatctcagagacttgcactgcctccaaagcctctggttggtcccttaggtcctcgagtaagcacaaaagggagttgtgttgatccctcaggaaacgatccaaagatgggtgactcagataggtgcagcttgtacatcgaagcaaatcctgaccgcctggttgccctggggagagtttatgagggatccactattgttcataacactcctttgttgcctagccaagtaaaggtgggtgtggaggaggttaaagatgaagatgctccagttcttgtacccactgatgaggtttccgtagtggggcaggcaattcacaccttccttgcttggtcgacacatctggtcaagtctttatcacagcaggtagttgtgtctccggcaaaaccagctccaaagcccaatccggag

SEQ ID NO: 24898 - DNA, 237 bp, Glycine max
  Peptide Sequence Number=SeqID_116583
atggcatttctaggagaaactagcactcagacgattgtcaactcaaggttggctttcatttatccaaatggatcgattattcacaatgatactggggtttacttccaaacttcaactccggtgcccatttcgagtacccaaatagctatcccgacaaacaatttttggatgaaattcactaccggaagccattcaccgatacaagtaatcaaattcgctttgagtgtatcaaattga

SEQ ID NO: 24899 - DNA, 630 bp, Glycine max
  Peptide Sequence Number=SeqID_116584
atggcagaggtctccacgaaggccattacctccctcgcccaatattatgaccagcctttgaggtgcttcacctttgaggacttccaggtaacacccacggtggaagagtttaaagagatcctgggatgccctctgggaggaaggaaaccgtatcttttctcaggcttctatccctccttggctagaatttacaaaatagtcaaaatctcgacacaggaattggaccggggaaagcaagtcgaaaatggggtggttggagtaccaaggaaatgtttggaagcaaaggcgagaaccttggcaagtcaagacgaatgggccccgttcatggacgtcctgaagctcttgatcttcggagtggtcctctttccaaatgtagatgggttggtggacctgacatcgattgatgctttgctcgcctttcacgaccgcaaggaaagcccggttgtcgctatcttagccgatctacatgacacattcaaccgaagatgtgagaagaacagtgcaaggatcgttggctatacaccggccctctacatatggttggtttcacaccttttccgccaagaggtgagacacgtttgcctgctagaaggccaccgctcatgcaccgagaaaaatgaggcaaactag

SEQ ID NO: 24900 - DNA, 384 bp, Glycine max
  Peptide Sequence Number=SeqID_116585
atggcaagagctggtgacaatggtggtgtatatcatcaactggacgaatctcagcgcttatttctggacgcgtggactacacaaatgcaacgtttgttgaaccgtaacaaagaagagccctacagacgaatagccaaatcttcctcgtttactcttaaacctctatcccctagagaagtgtgtgatgaccaaatcagaatgagagaaaagagagaacaagagaaagaaaatagtgaggcaccacaaaggaatatgaaaaagaaaagtgatacacccgaggaaaagagtgatacgcaagagagagagagtgataattctaatcagaatttaaagatgtctttcgcaaggagattcctcatggactgccaccttcaagaagcatag

SEQ ID NO: 24901 - DNA, 966 bp, Glycine max
  Peptide Sequence Number=SeqID_116586
atgataggaagagccgacatcgaaggatcaaaaagcaacgtcgcgatgagcgcttggctgccacaagccagttatccctgtggtaacttttctgacacctctagcttcaaattccgaaggactaaaggatcgataggccacgctttcacggttcgtattcgtactggaaatcagaatcaaacgagcttttacccttttgttccacacgagatttctgttctcgttgagctcatcttaggacacctgcgttatcttttaacagatgtgccgccccagccaaactccccacctgacaatgtcttccgcccggatcgaccggccgaagccgaccttgggtccaaaaagaggggcagtgccccgcttccgattcacggaataactcccacttatcctacacctctcaagtcatttcacaaagtcggactagagtcaagctcaacagggtcttctttccccgctgattccgccaagcccgttcccttggctgtgagcactgggcagaaaatcacattgcgtcaacatccgcagggaccatcgcaatgctttgttttaattaaacagtcggattcccccttgtccggtaccagttctgagttgactgttccgacgcccggggaagaggccccgaagggcccgttcccaatccgtcccccgaccggcacgcgacgacccgctctcgccgcggaagcagctcgagcagtccaccgacagccgacgggttcgggactgggaccccccgtgcccagcccctcagagccaatccttttcccgagaggctgttcaccttggagacctgatgcggttatgagtacgaccgggcgtgggaggcactcggtcctccggattttcaagggccgccgggggcgcaccggacaccacgcgacgtgcggtgctcttccagccgctggaccctacctccggctgagccgtttccagggtgggcaggctgttaaacagaaaagataa

SEQ ID NO: 24902 - DNA, 276 bp, Glycine max
  Peptide Sequence Number=SeqID_116587
atggcttccatgatggatgccattctaggaatgagacaactaatggagaataacacggccactgccgccgctattagtatggctgccgaagcagacccaactctcccagctgccgcgcaccaccctatcccaaacgtggtaggacgagaaagaagcacactggggcacatcagcaacccccatccgggatacaaccgagtggcttacccctatggattaccacctaattgcacaccaccaatcatacgtgatgactatagaagcaaagcttcatga

SEQ ID NO: 24903 - DNA, 357 bp, Glycine max
  Peptide Sequence Number=SeqID_116588
atggacttgtcgttcccggattttcacaaattgcctaatgatgggtgccaagcacctcacaaggaccaaagaaaggtcgcatgtcatcaagcaaagcaaaagaatgtttatacggataaccactcgggtatttccgcgtatcatcgggcccgccgcctctggatgatacaagggtgcagaatgaccaaatttggtctctgcttgtcatcgggcccgccgcctctggatgacaaaagggtgcggataaccgtaagatatctccgtgtatcatcgggcccgccgcctctggatgatacaagggtgcagaatgaccaaacttggtctctgcttgtcatcgggcccgccgcctctggatga

SEQ ID NO: 24904 - DNA, 201 bp, Glycine max
  Peptide Sequence Number=SeqID_116589
atggcaaaggggtgcggaatgaccaaattttgtctccgcatgtcacatgacctcagggtcagtgcggataactgtaaggtgtctccgcgggttaccagctcttgggtcatggcaacaaaaggtggtgtggtcgacaaaagcgaggctcttgctcctacgtatcctccaatgaggaactcagacctacgtagttctggataa

SEQ ID NO: 24905 - DNA, 165 bp, Glycine max
  Peptide Sequence Number=SeqID_116590
attgtgcagccaagcaggaaagattggagtaccaggcttgatgatgctctctgggcacatcggactgcctacaaagcacccataggaatgtctccttatcgggttgttcttttggaattagggtctggacttccagtggaaattgacaaaggaacactctcgtaa

SEQ ID NO: 24906 - DNA, 303 bp, Glycine max
  Peptide Sequence Number=SeqID_116591
ccatcgacaactctcgtgcaagcacaaggaggagtagcccgatgcttgccttacaatctgaagttttacgcttaggggaagaaatgttcttggtggatgcaggacctgggacccccagaatttgtatgcaagatgagcctacaggagtgccaatcaaccgagccaccaggtttgagaataaggtgggatccctggatctagtggccgatgtagtggctggtgaaccgcttcttcttcttcacgaagattcagacaaacctagcttggatggaactgaacaagatttggcgaacgaatacaaag

SEQ ID NO: 24907 - DNA, 406 bp, Glycine max
  Peptide Sequence Number=SeqID_116592
gactctgccagtcgttcggagtccccgttgcccctaccaaggctcagggtgatgctccacaggccgcaggcgcgccaccaccacctcatcaggctggccaggctggggcatttgacatggagcagtatttacggcatttggttcgccagcaggcggccaaccaccgagcacatgtacagacccatgattgtctgtaccagatgagccttagcatgcagagccagggcttcgcttctttttcatgccctactccagaccagttcagggcagaggttgcatggcccggagattggcccgaggcccaagcaggagaggcacccccagaagctcccggcgatggagaagaggcccacgaggacgaggagatggtcgatttgcttgacttattgggagggagtggagatac

SEQ ID NO: 24908 - DNA, 276 bp, Glycine max
  Peptide Sequence Number=SeqID_116593
atggcggtgagtggtggaattgacggtggtggtggttgttatggcaatgatggtagtagtggcgacggtggtggtggagacaatggtaagagtggtggctcaaacggtgacggtgatggtggtggtgatggtggtggcgacgacgatggttgtggtggtggcagcaacgacaacgacggggttgtggtggtggcaatggcaatagtgacaatgatgatgatagggttggtggcgataacaatggtgatgactacaatgatggtggtggtggcatga

SEQ ID NO: 24909 - DNA, 237 bp, Glycine max
  Peptide Sequence Number=SeqID_116594
atggagaattcatccctaacagtcaaccacttaattcaaccctatttcaatttactaagcgaaaatcaacttagggttgtcaatacgcgattaggcaccacatacaccaggaaaactgccaggaaaccacattacaagcgaaacctcaaagagagttgggcttcatcctcaaaaggaaacaacaccagaaaatctagccttccatggattcaaacagaaaacgcaaatgaaacatga

SEQ ID NO: 24910 - DNA, 510 bp, Glycine max
  Peptide Sequence Number=SeqID_116595
atgttggtgcgcatggtccgcactcttctctttgcagcagcacgggtgaaatcttgccccagtatgcatagtagctgtgtgatagcctccctctctggttgtgctcgcacagttggccctcctccaatatcagggggtggcccaggaaccgtgtggatgtcgagcacactgaaaatgaggacacgtagccctctaaaggtgagggcgtgcagctctctcaaggcgaggatgtgtagtcctctggaggtgaaggtgtgcaaccctctgttggcgaggacgtgtagtcctctcaaggtgagggcgtgcagccctctgttggtgaggacgtgtagtcctctaaaggtgagggcgtgtagccctacgaaggtgaggacatgcagtcctctgatggcgagggcgtgtagccctctgaaggtgaggacgtgtggtcctctgatggcgagggcatgtagccctctgaaggtgaggatgtgtggtcctctaaaggtgagggcgtgtagccctacgaag

SEQ ID NO: 24911 - DNA, 434 bp, Glycine max
  Peptide Sequence Number=SeqID_116596
tgagaggactacacgtcctcgccatcagagggctgcacgccctcaccttcagaggactacacgtcctcgccttgagagggctacacgccctcaccttgggtactagttaccctcaccaaggactacacgtcctcgccttcaaagggtcatgtaccttcaacgtcagaggactacacgtcctcgccgtcaaagggtcatgtactttcacctttgtagggctacacgccctcacattcagaggactacatgttccccattttcaagggggcatgccctcacctttagaggattgcacgtcctcccatcataggactacactccctcgctttgaaaggcggacacgtcctgaacttcgagggctacacgccctcgctttagaggactacgcgtcctcactttcagtgggctccatatccacacttaagataatttaa

SEQ ID NO: 24912 - DNA, 417 bp, Glycine max
  Peptide Sequence Number=SeqID_116597
ggatcgcacccacaaagacacccagtggacctgaagaagtccaacagggccctggggtttccagctctggttacgggcctctgtcggccctacagggcgcccgttccccccagcaagttcatgtcgtcgtggcatagggattgtgcccgcaagacacctagtggacccgaagaaggccaacagggtcttggagttgccagctctaaatacgggtctctgtcaggtctagggagtgcctgtcgcccccagcaaggtcatcaggtcccccctaccaatcgagctttcatcaagaagttctgcgtctccaggcaggcgcagggcgaaacaccacagcagcctggggatggccggcagcgggcaacagacgcacatggccgacaccacaacagacgcagggcgaaacaccatcacctctag

SEQ ID NO: 24913 - DNA, 357 bp, Glycine max
  Peptide Sequence Number=SeqID_116598
atggcagcacagttgatccatgatcgcgtcgtgatggattcgactcactgctacttcgctagtacatccggagcaacccgcacgcctgtggagtggatactacctacgcctactccatatcgactagttgagcatgttcaattgatagaggtgtcatcctctgaagaggatcttgaagaggacccaaaggagttatctcctgaacctgctatggatgcccttgacttaccagaggatgatgaggacccactccttgatgttgattctccagaggatattatgccagcatctgaggcagactctacagaggagagtgaccctggagggacaatgaatagtgacgactcttcatcatag

SEQ ID NO: 24914 - DNA, 168 bp, Glycine max
  Peptide Sequence Number=SeqID_116599
atggaccacattcattcacaatgtataaagaatcttgaaaagtcttcaatggttgactgttttgactggtgggttggaacttggagagttggaggtgttcttgttatttttcgtgcgtttggtgatagactcctgaagcagtatgttgttgctgatccagaaattcag

SEQ ID NO: 24915 - DNA, 141 bp, Glycine max
  Peptide Sequence Number=SeqID_116600
atgaagaaacaacaatggaagagaagattctatggaggctggatctttgagctccaattaggtccttcaatggtgatttttcaccatggagatgcagcggaaggcaaaggagaagaggagaggggaggtaccatccactag

SEQ ID NO: 24916 - DNA, 846 bp, Glycine max
  Peptide Sequence Number=SeqID_116601
atggggttcgaacatcttctgctggtcacgggcgagcatcagggaaaagtgggaatggactatttccgtcagcaccttccggcgatacgtcgcgagtttgcgtcgttgcagatggaggtacagcccctgtcgcaggacgagtacgcggagttaaaatcgctcgggctggatggggtcatggtttaccaggaaacctaccacgaggcaacgtacgcccggcaccacctgaaggggaagaaacaggatttcttcttccggctggagacaccggacaggctgggccgcgccgggatcgataaaatcggtctcggggcgctgattgggctctccgacagctggcgggtcgattgctacatggtggcagaacatttgctgtggctccagcagcactactggcagagccggtattctatctctttcccccgcctgcgcccctgcgcaggcggaatagaaccggcatcgctgatggatgagcgtcagctggtgcagactatctgcgcgtttcgcctgctcgccccggaggttgaattatcgctttcaacgcgtgagtccccggcgtttcgcgatcgcgtgatcccgctggcaattaacaacgtcagcgcgttttccaaaacacagccgggcggttacgccgacgatcacccggagctggaacagtttgcaccgcatgacgggcgacgtccggaggcagtcgccgccgccctgacggcacagggcctacagccgacactacggaaagataaaaccggacgattgtcagcgatcgtccggttttttattgtcatccggtcagcaagggatgctggccagggcgaaaagcttcttcctcgtttcgccctgcctccg

SEQ ID NO: 24917 - DNA, 700 bp, Glycine max
  Peptide Sequence Number=SeqID_116602
gagaagcctcagctgcttgttgtctttgttgtgattgctgctgctgctgttgcattggaggaggaacatatggcttgcttggaccagcaacattatggaagggagggacaagctgttgttgttgtggaggacttgcccatctcagatttggatgattcctccaacctggattgtatatgttgcttgaaagatcataattattctgctgttgttggttttgctgctgaggagattgctgcaaagagtgacaaagatctgtatgatgaagatgaatctgtggccacctcatggactcctctaaggacaatagcatcatttcttgcattgaattgttgggagcgcctgagcccggtcattaacttagcctacattaggaagaattgttggaaccccgaggatctaacagtttctattcgaggggctaggagggcgggggcaaggccagctgagcttccttctacttctgcagctcctactccaacatccactttagtagccccttctgtcccagtggtggagccttcaggatctattccttcgatggagcagttcactgagatggcgaggctcacgagtgcgctttccaaaggaggaaagatgcacggagtcgccacaaacgaaggtattagcacctctcacgtcgacaaaagcggggctcttgctcctacgtaccctccatcgaagaggaaatcagacctag

SEQ ID NO: 24918 - DNA, 603 bp, Glycine max
  Peptide Sequence Number=SeqID_116603
atggcagaaccattaaagaagcgaaagggttcttcgagtcaaagccaacgacattccgagactcaggaaatgcagattccttcctccatttcctcttcctcattgttctcatccgaagaacaacggatacggtacacaaatcttttctctttcggttccattattgatccaaaattcattgacatggatttcttttccaatgagatttttgaatgcattcaggcatttgaaaactccaatctcattcctttcatgtctttaaaattgcctgtttacactgaattagttaaagccttctattctaacttagaaatccaagaaggcactttaatttctgaagtctatgggataaaaatggtcattgaccaatccctattctatgacttgacccaactatccagtgaaggtgtaccatttgaagcggatatgaccggaaggcttcttgccggttcattggcttttgagagtcgcatccttcattatctcattgtgcgtatcttgcttccaagatcttcaaaccttgcacaggtttttgaagaagatcttattgtcatgtgggcttttcacacaggccgacaaattgattgggtacacttagtctga

SEQ ID NO: 24919 - DNA, 162 bp, Glycine max
  Peptide Sequence Number=SeqID_116604
atgtatattgttgtggtacttaaggatgaacgcaagcggggatggggtcacgaccgaccgatcgttgcccttctctgtgcgaaacaagcagggaatgtcgctgcaaggcagccccgtatcctttgtattttgcagctttcttttactatttgtttgttttaa

SEQ ID NO: 24920 - DNA, 291 bp, Glycine max
  Peptide Sequence Number=SeqID_116605
atgcaaagaagatctactgtaggtgatttgattcccattaatttggagattaacgccacttgtagaagtcgtaattcagcgagaattagaaaatttttgcaggatttagaagcagcagcaactccagaagaagaacctcaatcttccgaggcatcttctagttttcctattgcagggcattctcatatagaacctattgaagacacaatcatggctgaagagccaagaaaagtaacactggaggattattcaagttctactgtgccacaatttttcactagtattgcatag

SEQ ID NO: 24921 - DNA, 336 bp, Glycine max
  Peptide Sequence Number=SeqID_116606
atggaggccatccctcacctgggatacaaccgagcggcttacccttatggattgccgcccaactattcaccacccgtcttgcagagaaggagtcgcgagcacatagcatggttctccccagaaagagagcttcagatgcttgttccgacgaaggtccaaaagaagattgtctcggagcgtctatgcccccgacccgacagagaccagcacatgttagctcacccaatcatcgcagtaccacagatagagctgggtctgccacggaagcccccgagcaatgaagaaatcgggatgaagctgatgcccaagtatatgacggaaagattagaggcgtag

SEQ ID NO: 24922 - DNA, 426 bp, Glycine max
  Peptide Sequence Number=SeqID_116607
atgctgatctccccctgcggaagcatcagttggggtcgcgcccacaagacacctagtggacctggaggagccaaacagggccctggggtttccagctctggttatgggcctttgtcattcctacaaggtgcccgtcccccccagcaagggatcgcgcccgcaagacacccagtggacctggagaagcccaacagggtcttggggtttccagctctgattacgggcctctgtcagttctacggagtgcatgtcgcccccagtaaggtcaccaggccccctacaaaccgagctttcatcaagaagtactgcgccctcaggcaagcgcagggcgagacaccacagcagcccgaggatagccgacagcgggcaataaacgcaccgccgccacttctagagttcacctcagctcatccacaaaaaggttag

SEQ ID NO: 24923 - DNA, 147 bp, Glycine max
  Peptide Sequence Number=SeqID_116608
atgttgcagttgaggttcttgacactgctttcccgacctcaacgtaatggcactcacatttttgggattctggacatattgagaaggactcgaccatctaaggttgggatgattcctccacccgggattgtacctattgctagagag

SEQ ID NO: 24924 - DNA, 306 bp, Glycine max
  Peptide Sequence Number=SeqID_116609
atgccacctaccaggcaccctctagacccagataagtctaacagggccctcggttttccagcgttgatcacgggtctctgccagtcattcggagttcccgtcacacccagtaagagccagggtttcgctccttttgtgtgccctactccagatcagttcagggcagaggtcgcatggcccggagattggcccgaggcccaggcaggggaggcgcccgcagaggctcccgacgatggagaggaggccggcatggatgaggagatgtcagatttactcggtttcttgggagggagtggagccacatga

SEQ ID NO: 24925 - DNA, 78 bp, Glycine max
  Peptide Sequence Number=SeqID_116610
atggcaatggatggttacactttggtatatgaccaaaaaacaaatatgctttggctcggaggaggtagcaaaggataa

SEQ ID NO: 24926 - DNA, 540 bp, Glycine max
  Peptide Sequence Number=SeqID_116611
atggaactactctttttaagatctggacttagggaggaggaaagaacaagcatagctaggttccttagtgggcttaatatggaagtgagggacaaggttgaactccttccatatagggacctagatgagctagtccaactttttaaagataaactaactatgaaagataagagggatgaggaagaaaaactagaaaaccaaaagaaaaagaaggatagtaaggccttgtcttcaaaggccaaggggaaggaaaaagaggaaaaggattcctccaagaagattgttaagaaggaaaatcattttgcaacaaaatgtgatatcaaaagagcactccttcttaaacaatctttctaccttctcctatcaagggcaacatcccttagcaccgccataactcttgagcttgaggttattcctcaagtaaaggagttattggatgaaggaattaatgaagcattgggcttgaatctagcattgggcttgaatctagcattgggcttgaatctagaattgggcttggacttgaagagggcagactaa

SEQ ID NO: 24927 - DNA, 300 bp, Glycine max
  Peptide Sequence Number=SeqID_116612
atggatacagccaggtgggcactcaagcatcctgtttatggcattgtgatactacggttgggaatttacacagacagacccaacgacgacgttcctaaatggaaaactctacatgactccggaatttcaaaaaacactattgacaacaacgaagtaaatactaacgtaacagttcaaacgacatcttcgcatgccaccggtctcttgggacacggtaacaaaaagtggggtggtcgacaaaagcagggcttttgctcctacgtatcctcaatgtgtgatgaggaactcagacctacgtag

SEQ ID NO: 24928 - DNA, 303 bp, Glycine max
  Peptide Sequence Number=SeqID_116613
atgaagaaacaacaatggaagagaaggagaagaggagaggggagacaccatccactagggaataagccatggaagaaggagcttcactaccaagaatgtgccatggataagaagcttgaagaggatgctttaatggaggaaaagaaagagagaaggggggagcatgaaattgaaggaataaaagagggagagaagtggaactttgaagtgtgtctcataagactttcattcatcaaagttacaacaagtgttacacatgcttctatttatagactaggtagcttccttgagaagcattcttga

SEQ ID NO: 24929 - DNA, 360 bp, Glycine max
  Peptide Sequence Number=SeqID_116614
atgcatattcatggagaagatcacaaaggcaaaggagatggaaataatgaagattttcacattgatgaaattaaagcaaatgttgatcttccaagagaatggagagcttctagatatcatcctcttgacaacatcattgatgatatatcaaaagggcaaaccaagaatggaatatttgttaatcaatcaaagtattgcaaggaattgattcacagatttgggatggagaatgctaagcatatggctacaccaatgaatactgcttgttatttggataaagatgaaaccgatcagtcaatagacattaagcaatatcgaggtttatggtatcctaaaaattccatcttagtgttattctaa

SEQ ID NO: 24930 - DNA, 711 bp, Glycine max
  Peptide Sequence Number=SeqID_116615
gatctaggcgcacaaagtctcaaggcgatacaaagagtccacaaggcgtggagaagcccattgaggaaagacaaggagcttaggggcatccgtaatggcgtcatcggaggttatcatggatggctaagaattcacacgcgggggttagattggctctccaagttgaaagttatcgatgaggaggactttgaagctccggaggaagatgaagaagtccgagctctaaaattagagttagggaaggcaagactcgccaagcagaagttcaagtcagctgctacacacatccggaaagagtgcaccgagttacaagaggaaaacgcggccactgcaaaagcccttgaacaagaaaccaaaagggcccgaaaggaggaatatggtcgagagaaattccgaggagcattgtccaaaaggagtttggttcaacacttggaagccacggagcaaagcatgctagctatcatagggcaatacaaggaagaattgaaccagtctgtggcccatgaacaaaagctagtggaggattttgcacgagtgtatgccaaaaaagaagcaagagggagggtgattgatgcgttgcatcaagaagcgactttgtggatggataggttcgccttgaccttgaatggaagtcaagacctcccgcgtctgttagccaaagcaaaagccatggccgaagtgtgtactgcccctgaggagatcatgggctaa

SEQ ID NO: 24931 - DNA, 411 bp, Glycine max
  Peptide Sequence Number=SeqID_116616
atgccgcagcagaagggtccagtgccacccccgagtttgatagtcatcgtttccggagcgccgagcaccaacaacgcttcgaggccatcaaaggatggtcgttccacaaagaggcgtgtccagctcagggaggatgagtatacggactttcaagaggagatagctcacagacgttggacgtcgctggtgactcccaaggctaagtttgaccctgagatagtcctagagttctatgctaatgcttggcccacagaggagggagtgaaggtcagcagtgtgagttcagctagaggaggaacagggccgatgggttcgatgaggaagccattgcccagctgttgtgcacaccggggcaggatttcgcccggaccgccacagggaggcgggtgcggatcatgcgcaccagcatga

SEQ ID NO: 24932 - DNA, 287 bp, Glycine max
  Peptide Sequence Number=SeqID_116617
gttgtaccatctgtggtgaggctcatgaaacaggccaatgtattcccattgaagaaaacactcaagaaattcattatatgagaaatcaacagcgacaagggtatactccgggaggattttcaggcttccagcatggtccttataatcaacaaggacagtggaggtcacaccctggcaatcagttcaacaaagaccagggtggactttcgaacaggccaatccaacaagggcctaacatctttcagaggactactaagctggaggagactttgactcagtttatgtag

SEQ ID NO: 24933 - DNA, 504 bp, Glycine max
  Peptide Sequence Number=SeqID_116618
atggcgggcaaactcttttccttacgcaacgcggcgctgttggcgctggcgctcagcgcagccagcgcctacgcggtggacgtgaccgtggcgtaccagacgtcggcggagccggccaaggtggcgcaggcggaaaacagcttcgccaaacggtccggcgcgaccgtcgactggcgtaagttcgacagcggctccagcgtgctgcgtgcgctggcctccggcgacgtgcagatcggcaatatcggctccagcccgctggcggtggccgccagccagaaactccccatcgaagtgttcctcatcgcctcgcagctcggcagctccgaagcgctggtgcctgctggcctcgctcaagcattggggcatcaagccgcaggaggtgtggcaggcgaaagcgctgatggtggtgctggaaaacgaggcgcaggtgcgtgcgctgcggccggacatcccggcgctgatcgcgctggccgggcgtgcggtgatcgtcactgcgccgggtga

SEQ ID NO: 24934 - DNA, 499 bp, Glycine max
  Peptide Sequence Number=SeqID_116619
atgggtgaagtagaggaggtgcaaaagcagatgaaggctgacatggaggccatgaaagagcaaatggccacaatgatggaggccatgatgaacatgaagaagataatggaagctaatgcggttgcagataccgctactagcgctgtagctaaggtgaacccgatgcccccatctggcctcaaccaaatgaatcatccaaccttagctatggtaggcaaagatttgggaagtacgggcggcccccattattcgcaaattcaaaacaagcacgccttctcgccatatggcttgcctcccaactatacaccacccaatgtggcgtacactcccagtgagaatgtcaataactccactcccatactcattgagagccgacaaccccaaactgatcattcacatgtctctcaaaccgtgggggagacacatgaaattccccaccataatctagccgacttcgagccttgcctcggatatgccactgaagggcaagtagttggtg

SEQ ID NO: 24935 - DNA, 303 bp, Glycine max
  Peptide Sequence Number=SeqID_116620
atgcatatgacacagatgcaatttacgaatacgggagcccgagaaattgtcccctttctgggatacaatgtttgggcggcatggcacccaacgtatgtttttaagaaggcgacacggaccctccgtcggtttgctaaagtgaggggatcaagacagaacccatgtgcgatgcatatgcgcaaggcacaacacggggatgtctctagaggtatcatccccttcgaagaacatattgcagcagtagggactactagcaacgatatattttcaaagaggaaaactctagatgagggttcactgtaa

SEQ ID NO: 24936 - DNA, 406 bp, Glycine max
  Peptide Sequence Number=SeqID_116621
atgagtggagttcgtggcgggcgcggcgtcggtcgcgggggcgggcgcatagccgccgcccagcgcgttggccagattggcgtcgagttggtaggcacggatgcgcaggtcggtgtcaagtctcgcctgcgtcagcacgccggtctgcgcgatcagcacggtcaggtagttgcccatgcccgccttgtagcgattgacggccagttcataggccgcctcgatggcttcgcgcgcctggcgctgctgcgctctttcctgttccagcaggcgcaggccgtcgagcgcgtcggcgacctggtgcacggcatcgagcacggtctggttgtagtcggacacggccaggtcggcgtcggcgcggcggctggccaggttggcgttcaattctccgccgtggaagatcggcagg

SEQ ID NO: 24937 - DNA, 228 bp, Glycine max
  Peptide Sequence Number=SeqID_116622
atgacggtgaaaacctctgacacatgcagctccggagacggtcacagcttgtctatgcgtaaggagaaaataccgcatcaggcgccattcgccattcaggctgcgcaactgttgggaagggcgatcggtgcgggcctcttcgctattacgccagctggcgaaagggggatgtgctgcaaggcgattaagttgggtaacgccagggttttcccagtcacgacgttgtaa

SEQ ID NO: 24938 - DNA, 135 bp, Glycine max
  Peptide Sequence Number=SeqID_116623
gaaaatgagggaggagcttgccacccagctcgcccaagcgagctaggttgcttcctccagaaggcagtgccttctggagaacttcctggaaggcccaagtgggcgtggttgctatttgcaccctctgtttactaa

SEQ ID NO: 24939 - DNA, 277 bp, Glycine max
  Peptide Sequence Number=SeqID_116624
tgtttgcatacatagatcttcagcaggtgaattggttccgtttgatttagatattgaagccacttttagaagaaacaacgcaaagagaaaaagaaagcttttgcacgacagaacagtagcatcgatccttgaagaggctcacttttctgagtcatcatcttctaattcacctacatccagggaatctcaaacaacagaatttgaagccgaagtcatggctaaagagcaacctaaccagtgtgaccttggaaatcactcaagtacttcggtgtcgtaa

SEQ ID NO: 24940 - DNA, 246 bp, Glycine max
  Peptide Sequence Number=SeqID_116625
atgcacgagattagaaggcctaactctctaaaaatagtccccagcggagtcgccaacggtcgcaacctacccttcggcgggagggcgacgcggggctcgcgggtgcgtcttccatgggaggaaaatgcgcggagtcgccaccaacgtttattcgaggaaaacgtcggaaaaaccggaaaggtgtggactacgaactttaagtgtgaaaggttcgggagttgtatttacacacggggaaggtattag

SEQ ID NO: 24941 - DNA, 171 bp, Glycine max
  Peptide Sequence Number=SeqID_116626
atgatgatgataattatctgtgtgtcaaactcatacgttgaaaagtctttagatgaagatgatagtgttgatggtatatctgatacagatgatgaattcaccgacataattcaactagttacaattgttcacccaacagaaggtgccgaaggaattcaaaatccattttga

SEQ ID NO: 24942 - DNA, 3015 bp, Glycine max
  Peptide Sequence Number=SeqID_116627
atgcgtttaaagcggctaacggtgttctctcttccttccgtgtcactgttacgcttcccttcgtcggtcctcgcttgcgctccgagagctatggactctgctcttgtgatcaaggtgaaatatggagataccctcaggcgcttcagtgctcatgttgatgagaataataggctggatcttgacatggttggcttgagggcaaagatatgttctatcttcagtttcagtgctgatgaaaatttaattctgagatatgttgatgaagatggcgacctggtgactctagttgatgatgatgatttgcgtgatgtgatgaggcagcaattgaagttcttgagaattgatgtacatatgaacaatgacggtggtgataaatcaaatgctggctctagtggaagtgccaccccctcagaaacttgtcctgtcacaagcccatttctgcttagaaatgctatggtacgtgaacatctttctaaaaaagcagcatcttcaagtcctgtggttgataatcttgccaattcaattttgaaaatgggactaaattcccatttccagcctcctgatacagctggtaaaagctcaaaaactggtgttcctgaagaacctatcactaaagcaatgggtccacaatcttcacatgtggactcagcctccaatgctagtgtcaatagtgatagtgctacccccataagatctccaattccaaacccttatctaagtggaaatgctgttaaagttgacgtctcatgttctgtgcccgaaccagtacgccagtttttttccaaatcatcaagttcaaatgctgctgcgtcttcaagtcagctgcctgcaaatctcgctgatttaatttccctagtgcctgaaccagtacgcgagtttctttccaatttatcacattcaaatgctgcatcttcaaatcagctgcctgttaatctcactgatttagtttccctactgggacaatctattctaaattctcattgccagcctcatgttgcaactggtccattcgcaaaaaatggtgttactgaagaacctatcacttctgaagcaagaggtcaacagatcccatctgcagactcggcttccaatgccactcaacaggtggaggcaggagttgccactattgatctcaatgcccctccttttgatccctttttagctcagttcacttgtgaaaataaggctccactttcatcagaagctcctaatggtcatggcaagaagggtaaaatgccgactgtcgatagttctgctggtaagggtgacagtagtgggatatcctcaagttttgctgctcctaataattcaacccagactacatcattgacttctggtgctttcattgaatgcccatttgctgggacatatattaattcttggacaccacttcctggaaactctcaaatgcccccatttaaaaggagccatagtcacactgatgcaatgtctggtatgttccataagggggtccgctgtgatggctgtggtgtctatccaataactggacctcgtttcaaatccaaagtaaaggaaaattatgatctttgcaacatttgtttcaatgaaatgggtaatgggacagattatatcagaatggaccgccctgcatctgctcgggcccctcgatacttacatggacatacaaaaaactttccaacattaccaccacatatttttaagaaaggtgccattttgaagcatgcaaagccaaaactagatagtaggtttattttggatgttaatgtgatagatggtacaatgatggctccatctactgcatttacaaagatctggcggatgcgcaataatggcactatagtctggcacaagggaactcaacttgtttggattggaggagacaagtttagtgactctcattcagttgacttagaggttcctgaggatggtgtccctttggagaaggaacttgacattgccgttgacttcacagcacctccattacctggtcgttacatatcatattggaggatgacaactccatctggacatcaatttggccaacgtgtttgggtccttatacaggttgatgcctctctcaaggactcattttatgataactctcaaggtctgaacttgaatattcccctcgatatcagtggctctaaaggacctcatattatagatatcaatgtccagcctactgaggatgatactgttcttcaaacccgcaagcctaatgctcccattgagcctttgaatcaaatggttgatgaggaaccaaggttggagctggaaaacgaattccctataaatgaagctacatttgttgcccctgttgcctcagccccagctgcaacctctgtggcatcttcatcagtgccttgtcctataattgatctgtctgaaacaaccccagctgttccatctaatcagcaatccccaaccgtggatgtgccatcgtcatctatgggtactggtggaggaattaattctgtggaggagaatctacttaaagagcttgaggagatgggttttaaacaggttgatttgaacaaggagatcttgaggaagaatgagtacgatctggaccaatccctagacgctctctgtggtgttgatgtctgtggtgtttctgagtgggaccatatgcttgaagagttacaggagatgggttttcgtgacaaagagatgaataagagactgcttgagaaaaacaatggaagcctcaaacgtgttgttatggatttaataaacggcgagactaccacgcccacatatcaaaagctcataggacagagtgttctcactgatgtccctcgctaccccaatggtcacctagccttcaacaaccaacacagccatcacaagatcctttctaatgcaagggttgggtatgatgaaaccactcctgctgagacagagggtggtgaagtcgtggatgttgaaagggatcagtgcaccaacaagaagataagggtcgctttgaattgcacaagtggaagacctattggccttaaaaagcttatagccacaagcctagtttgctattaa

SEQ ID NO: 24943 - DNA, 846 bp, Glycine max
  Peptide Sequence Number=SeqID_116628
atgccgagctcatacagtaattcgtcaatgggcctgatagtcaatgcaacagcgccagcttccgtccttcttcttgacgaggagcaccggcaaggagaaggggctatggctgagacgaatgaggctggagtcaagcatagattgcacctagtgttcgagttccattttctgactgtgcgggtatcgaggtggtggaatttctctaagagaatggtgaggtcaggtggtggtgggtggttatcaggaaggagggggggtgcaagagggacgtctgcgcgtaattggattgggctgcccaggtgggtgaaagtcatggagagggaggtcaatggtgaagctatgcccttgtatctaaagctggacctgcgggtagcggcgggtgcattgaagaacaccactgtcaccaaccattacggggactggagggattggtgtggcggggaggtcgagaaacttggccagacgcagttgcacaaaattgtgcgtactgccaccgtcaacgagaatggtgagacgatggccgcggaccgtgccgtagatatgaaaggctcggtagatggtgggggtgattctggtggtctagggctcagggtcaggggaaggtcctcgtctggaatgaggagggccatttcctcgggtgaaagtcgtcggacagggaatttggaggaaggggaagaaggtgaggttgggaatgaggatgagggttggggtggtggggtcgatggctatggcggcgatctgaaagcttatcttcctagagcttcgccagggccatggcctgaggtaaacacatgggttgcagggcctgcacctcgcggcggaggtcaggggtcaagcccgatatga

SEQ ID NO: 24944 - DNA, 1773 bp, Glycine max
  Peptide Sequence Number=SeqID_116629
atggcgagtacaagacaggctctacgccggccaattcttggcatccgcagtcagaccgatgatgctttctatgttgcacgagttgtgggtgactcagaaaaaatggagcgaaggttgggcagagaaaccaaaggctctctaagcctacaaaaaaggatggcagagacacggcgtagggagaaacccgcaccggacctcaccgacttcatgaacgacatgtttttcggggcagcagacatggaccacaaaacctacgacctcacaggtagtacaggtgtgcacgacgacgactacgacgatgaagggttcgacgacagcactagaagcaacagtgcaaggttgacacaagaatggttacgagaggcacgacaaatcgtcgcttcctctccttcacgctgtgactcgccggctcgccctttagggtccccaaggttcggagctacacaaccaccctcaccccttccctcctcctccgaccgaagagacgctctctctagaactaggtctgcccgaagatacagagcaatggaagggatcagtgatgagatactgtcgaaaacagcaaaacacacacgtaacaaatccgacactttcgctcagccttcatcagatggggacggatcccctgcaacggcggtgcacaactggttcgccaacatcctcaaaccgaccaataacaatagcaacacacaaccatctccttctcctcctgattctcctaaatcttctctccctccacgtcagcctcatcctcgaaagtcccgcttcaaaaccgagccctctgctgcacctcacccgcaggggatccagcctcccaattcgaggcgaaccttcaagacttctacgccgtcgccggagaattctccgtcggattctgctcctctttcgccgccgaggaacctcgtggagtccgctcaccggagaacgatatcgtcttcgacatgctcgcgggagaggatcgcgccaaggcatgcttttccgaagggagaggaagctagcctcaacgggttcctcaaagagcagagaattttgcttcagaaaatctcgagaggagagttacatgctgcaaatgcgcaaatcgtgctttctgggccttccaacagcacggcgtccatggtggctgccatttgccacgcgtggctcttaggttataggcagaaggagaacgacggtggaagcgagcgtgtggtggtggttcctgtgatgaatgtgaagcgaggctccatgtggaagctgaagcaggctgcgtggctctttcaccatgctggtcttgatgccaattcattgttattcattgatgaggtggacatggaaagccttttgatgactggccaactgagcgtcctcgtggttggacaagatgtcttgaacactactggcgaggttggatcacaatgcacagttgttactgataattactgtgaggatgcctatgatttactacaaaactatatgctgaagaaactattgcttgctggtattctgttagacacacagaacctaaaagcatctgcagcaatatctatgacaagggatgcagaggcagtccagttgttattggttggctcagccccaaattacagatatgcattatttgatcaattgatgcaagaccaaaaaactgcttcttttgttgaagctttgaaccataactacgggaagcctcatgttgaaagccgtggccacattccttttaatctttcccgtaaccttgttaatgaaattgcaaaatacatgaatcttcgaaacttcattgtgaccagaaatctttag

SEQ ID NO: 24945 - DNA, 1350 bp, Glycine max
  Peptide Sequence Number=SeqID_116630
atggaggtttgggaccggcgcgcgttgaagccaagccaaagtgtcgaacgaacggtgaggagagagagactgaagaaagttaataatgtttctgaatatgtcattatcaatcaatcaaaaaggaaaagaaagagagagttagggaaggaagatgagctggcgcagggtattgaattcagcacaggccttggctgcacacactttccttttgtgcttcactctcttcctcgttctcaagctcgatcacaatctctcttcttcttggtggctgcagagtacaaaccgacaatgttggtggtttttcacatgggaaccaatataatagagtgtgcaagcttctgcttcaattggcgttggaatgatggccgtgtgttagttaataagctaccaaagaggattaccagacaattcaaagtggggcccacctttaggttgaagcttgagtgggtaatatttttacctctttggatgttccatggtgttgtggctcgaggaaggttttcattacctgcgccatctgctccacgtaatcgaaattgggctccatgccatgccgttgttgcaacaccattgcttattgcatttgaattgctcctttgtatatatcttgagagcttatatgatcgtggctatgctgcagttggtctaaagatagtgtttcttcccttactaacatttgaaatcattattctcattgacaatttcaggatgtgtaaggctctaatgccaggggatggagaaaacatgagtgatgaggctatatgggaaactcttcctcatttttgggttgctatctctatggtgttcttcgttgctgctacagtcttcacactcctaaagcttagtggtgatgtaggtgctctgggctggtgggacttgtttattaattttattattgccgagtgctttgctttccttgtatgtacaaagtggtccaatcccgtcattcatagaaattcaagagaagctagtagttcatcttcaactacgattggatatcttgactggaacagtggtttagtggtttctacagacgaaaatcaaccccaggggagaatctgtagccttcaagacataggaggtcatttcatgaaaataccaattattgtattccaggttcttctttgtatgcatctagagggaacacctgcttgtgctgtatatataccgcttccagttattttctctccccttttcctactgcaaggagctggtgtactgttatctgcatctaaattaggggagaagcttgtgcttctgctacgaagtggagctggtggaggaatatattttagattttcttcaagagctcatgattgcttggggttcttgtgccatggttctaggtaa

SEQ ID NO: 24946 - DNA, 1413 bp, Glycine max
  Peptide Sequence Number=SeqID_116631
atgttggacgagagcaagttcgaggtacacttcaaactgtgggcccttcgaatcccttgccaacattgcaagctcgccacgcgaatcctcaacggttacttgcttgacaagccccgagttaaacccatcaccgaggacccaacctgtgacaaaaaccgttaccttatactctccgacaatgttcacaatcaagatttatctgatattccaaaacaaaagctagatgagctcaagggcttgtgtgagattgaagttgtgccctattctttgactttagggtattcttactggagtgcagatcatgtgctgaagcagatactgcctactggagtggagaaaaattatccaagaatcaaaactattgttaataaagttggaaccattacaaatgaatttcgtgtgccagagtttgaaattttagcaggagagcataatatgattacagaagtgaagcaatatggtgccacttttaggcttgattacagcttggtttattggaattcgagattggaacatgaacacaaaaggttagtctcaatgttccaagctggagagaccatttgtgacatgtttgctggtattggtccttttgccattcctgcagcacagaaaggatgcatagtctatgcaaatgatttaaatcctgatagcattcactatctgaggattaatgccaaaatcaataaggttggtgattgcatttatgcatacaacatggatgctagaaaattcatctcccagatgatggaagtgccaaatactgaggtcacattagaaaactcacatgaagtccctattttggatacacgagacaatgctgaatcaaattctaaaaatgagttgctaactgttgatacaaaagacctaggagatagcaataatagtgggttagaggatgtaaacggttcaacgaggcacactgctacatctgtaattgctggtaaaagatcttctactagttatcatgaagggaatggagaggctcatggaactgacatccttgaaggtggtaggagaaaaggaagcgcaaacaaaagaatgagaggctctgaaatctctgtcacaaaaacttgggaacatgttgatcatatttatagacagatatctgactcaagatatgccctgccagatgcattcaggggattaatccagaagaaatattggaaaggatgtctaccatggattcactgctattgcttcattagggcaactgaaactcctgagactataatagctgtagcagaatctgctttagacgctcatatacaagactcaagatttcatagggttagggatgtggctccaaacaagaacaccataacttctacaatcccttactcatggcttttgctttttacttactgtgcaggcaatgttttgtttaagcttcaggttgccagaagcatgccttaa

SEQ ID NO: 24947 - DNA, 237 bp, Glycine max
  Peptide Sequence Number=SeqID_116632
atgcaagcaaaaacccaacaacatgacgagaaacaagggaggaggagaagaaaaaggatgagcatgaaagatgaagagaaagtgaacaagctaagggataaaataagcaggataaagagagatgggctagaagaatatgaggtgagaccatgttatcgtagcagtgacattggtcacctaggctgtgtggaatttaaatcatcgcaaaacattttaaaaccttattccataatctaa

SEQ ID NO: 24948 - DNA, 165 bp, Glycine max
  Peptide Sequence Number=SeqID_116633
atgggaagagaaagaaaaaagaagaagaagaagaagaagagggacagaggtgggaaggtgaagagtgaagagagaaaaatggcgtttgatccaaagaagaatgctagatttggaaaatggatggagagggagcattttgatgcatcaagatggatccctccatga

SEQ ID NO: 24949 - DNA, 510 bp, Glycine max
  Peptide Sequence Number=SeqID_116634
atggaagtgacagtgacattgacagtggtagtgaaggctatccaatggtggggatggggcattgggggggctagatcattaagggttgattttcagtttgtgaagaaaggtacaaatggtggtgtgacaaaaagaggacttctagcagctgcagcagctggaagtgtcattggactgtcatttgttcttttgggaatctcagctaccagatgtgagggtaagggtagtacagttcttaagcaactaccggtcatacccgtggccacccttgcaggactgtgtggaagtgtcattgactctctcttgggtgcaacattgcaattcagtggattttgttccattcgcggcaagatggttggaaagccaggatcaacagttagaaggatttcaggtgccaacattcttgacaacaacgcagtgaacttcgtatcaataatgttgtattctcattcatcaattggtaaagtggatttcaccaacattataataaaaactgtatttggttcttga

SEQ ID NO: 24950 - DNA, 1122 bp, Glycine max
  Peptide Sequence Number=SeqID_116635
atggcatgcagcaccactttacttgctgctattctaaaacttctcatcattttcttattcgcaggtcttagcttcgctgtgtacacatttcctatagttgctattgctatacttggacttcttttattggatttgaaagctggatatcaaagaagcagaagcgcaaggagtccatcaaaatcaaacttcttctcaaatccactggtgcatggacctactactcgtatttctgcagacttcaaaaagttgatgccatacaaatcactgaagttgaatacatggcaactcaagtatcacaaaatagcaatccggtttggcttgctagcagaaccttgcatggctctgttgcttcttcctattctaagggggttggctgtgtttcgcatacttggcattcagtttgaagcttcagttagataccacacatgggtcggaactgcaatgattatttttgctacaatacattgcgcaagcactttgttggtctgggggatcagccaccatatacaggatgagcaagtgattagttctctcatcatatttttcaaacagatatggaagtggcaaaagactggacgcaaatatcttgctggggagattgcattatttttcttgtttcatgctggggataggcacttttatccggtcttcccgggaatattcctttttagccttgataaactgatccgaatcatacaatcaagtccaaaaacttgcatggtttcagctagaatttttcccagcagagctgtggagctaattctgcccgaagatccagggtggtgggctaattctctttatgacctgatacatgctgaactagacaaaactgcggatacaaggaagggaatacctgttgccatcgaaggaccttatggacctgcttcattagactttttgaggattttgctccatcactttccttattttccttatctgtttcaaccgtattataattcattctggaaagcactccaaaatggccaaagaaaagactccctcttgggctgtggatcttcttctgatagctgcttttatcctagctttagcttgcagcgcctcggtggcagctattttgagatggagaaggccgaggaaagggattccgcaaagatcgcatag

SEQ ID NO: 24951 - DNA, 588 bp, Glycine max
  Peptide Sequence Number=SeqID_116636
atggcgggaagaaaagttctgataaaatctattgttcaatctataccttcctatgtcaggagctgtttcttgtttctggtaactacttgctctcaaattgatagcatgacaagctgcttcttttggggaggatctctagagcctttgatatggctttgttgtctaaacaatggtggagaattctttgtgttggaaaactcattgttgtctgtcactcttgaagtgaagtattatcctaggactcatcctctctgtgccaaggtcggaagtaactgcagctacattcccggccccaccaaaagtgcttgtaagaaaatcattcctgtcaaagaatctctgtggaagaaatccatttgccaagatgaggacaggaacaaaactggtttcggagtggttttcagagatgccgaaggccgtgttttagggggtgcaacagatttgagacaggttggatatcaacctcatattgctgaagttttatgctttaaatgggctttgaaggtagcttctcagatgtgcttccatatgatcattttgaaactgataatgttcaaatttataatgcttggcatcgcaaggatggcataa

SEQ ID NO: 24952 - DNA, 138 bp, Glycine max
  Peptide Sequence Number=SeqID_116637
atggggcttgtggcatcctcttattttgacccagcgaggagagcagttgttgcaaaaattgtgttcatggatgacgcagcagggtactatttaaaacccaaccagcttttgatcaaaattatgaatgacctcagatga

SEQ ID NO: 24953 - DNA, 1251 bp, Glycine max
  Peptide Sequence Number=SeqID_116638
atgtctttggttggaacagccatggaagcttcaaggcagcaacttcaggcctttaaagtaaaccatggagcaaagccagttctggaagaattcatacccatgaagcacttagcctcagagagctcagagaaggcaacaaacatgtctgacaaggcaaattggatgacatcagcacaactatggagccaagcatcaagcgaaggaaccaaacaacaaccaccaatcacaacccttaaagaatctgatataggcttcagcataagcccaaagttggctcttgacaacaaacaaaggaacggtggaggagccttccttccattctccaaagagagaaactcttgccagggctctacattgcggcctctccctgaacttgttcttgcctctgcggagaaagaaatggaggataagaaacgtgcagaggtagaaattaagggagtttcgtgtcagagtaggaaggagaattcaggaagtgatggagctgtggttgatcaaggaaaaggtggtagcccagttgcatcgtctcatgcacaaacaaccacaaccactactagtgcacaaactcataggaaagctagaaggtgttggtcaccagacctgcaccgaagatttgttaatgctcttcaaatgcttggtggatcacaagtaattaagaagggtcctttggattcagaatctcatgctgaattgatttttgacacagtggcgaccccaaaacagataagggagttgatgaaggttgacggtttgaccaatgatgaagtaaaaagccatttgcagaaatataggcttcacacaagaagacccagtccaagtcctcaagcgggtgcagcagcaccacagcttgtggtcctcggcggaatctgggtcccaccggaatatgccacggcggcacacacagccacccctactctctacggcgcccacccaacctctcacgcgccgccgccacactactgcgccgccactcccatgccacaagacttctacaccgcggcgccgccccagccgctgcttccgccacctccgcagcaccacaacgctttgcaccacctgcacatgtacaaggcggcgtcccacggccatggatcgccggaatctgacgttcccggcggcggggagcggtcggagagtattgaggatggcaagtcggagagtagcagctggaagggggagagtggggagaacgaaggggagaggaaagggattggtgaagagagcaatgggagtgagatcactctcaaattctag

SEQ ID NO: 24954 - DNA, 467 bp, Glycine max
  Peptide Sequence Number=SeqID_116639
ttgaagatcaaccagatttgcgggatccttattaatggaggtgagatgatggtgggccaaagaagagtgagacggagaggaaggggggccacaaaggtgaagggtaggcacggaggtcgtgcaacaaggctaagagtagagtggggtggagaggcctggaggagggtgaggcaggtaaagatggggaagccaaggaaggagaagagaggggaagtcaagaaggaggatagacgacaacgaaggtccaacatagaaggatggtctcgatttgggttttcgtgtaggaattgggaattgggaattggggaaaaaaataaggaaatggaaatgcagggaattagtcggggtgtcaatttggacccgcaaacgaggatcctcgcagggactgcccctgtgtggggtcccgtagacgaggatttttttccctcggggatggggacaaggataaatattcccccgtgggcatg

SEQ ID NO: 24955 - DNA, 732 bp, Glycine max
  Peptide Sequence Number=SeqID_116640
atggctaaacttgcagttccacctttgctttctctgaggcacttcctggtgctatcaattgctttgaatgtgagtttgattctgaggactgtgtattatgagagtgaaaaaggaagcaaagggttttgtttgaacaaaaaaatgatggcagatgcagattctgatagagaggggcatcttatccacaaatcacgtttggccatgtcctctacttcgtctctcgttaattctactcgtgcagatcatccaggaggaagggaaacagtgatcaacttggaccatggagacccaacaatatatgaaagattttggagacaagtgggtgacaagaccacaatcataattccaggatggcaatccttgagttatttttctgatggctcaaacatttgctggtttttagagaccgaatttgcaagggaagtagtgaggttgcacaaagtggtgggtaacgctgtgacagaaggtcgccatattgttgttgggacaggttcctctcagctaattctggctgccctttatgctctgtcctcgcctgatgctgctgaaccaatcagcgtggtatctgccgcaccctattattcggaattctctcatgtgctcattaccgaatctgcctccacttttggtccttctcgttgtttgtcttcatcaatgtctttccctctctcgcatgagcctgaacctgatcacatgaagacttgtggtaaacagtcaaatgtgctgaactga

SEQ ID NO: 24956 - DNA, 2292 bp, Glycine max
  Peptide Sequence Number=SeqID_116641
atggggaaatcacgaaagtactcaaaaggtcatgccaccggttttgttccagattttcgccatgctgttgagactatgggtgaatcagaaggacttggtaacttgggaagggttgataatgagttgacaatgtcagaaatttcatgtgccccaaagagaaaaagggttgatgagagttttgatgtgccatttcaactgttatctttaacaaagatggcccgttctgggagaaaggacttgacactgagattaaaatccgaacttgaagaagtaaggaaacttcaaaagaaaattgctggtatgagttcaatcactactgaattatctccatatagtgacataaggagctgcagtgtgggagagaagaggcctccactggaatcattagcactgcatggtaagaagcgcccactactaaagcataacggtcctaaaacaaagagaagtatttctgggcgatttatatctgcgaaatctgctgcaccagtaactccttcatatgccgtgctgatgaagcagtgtgagacattgcttaagcgcgtgatgtctcatcaatttggtaaagtttttgacaaaccggttgacattgtgaaatggaacattccagactatttcactatcatcaagcacccgatggatttgggtactgtgaagagtaagctgatttcgtgtgaatatacaagtcttatggattttgctgcagatgtgcggctgactttctcaaatgcaatgagttataatccaccgggcaatgatgtgcatgtcatggcagagacactaagtaaatattttgaaacaagatggaagcctatagagaagattcttgccattgatgatgtgccatctgagccttcaaaacccactacttgtattgaaaaatccgaaattgttgatcctcctgtgaaaaaaaagaaaataacaccaaatggcactaatgtcaagccagagcccattaaaagaatcatgactggtgaggagaagcaaaagttgagtatggaattggatgcgtcagttgttgaattgcctgaaaacattattgatttcttgaaggagcaaagttataatgctagccaaataaatgacgatgaaattgagattgatatagatgccctcagtgatgatacattatttaaactgcggaagcttcttgatgattttatgctagagaagcaaaaaaccctggcaaaacctggaccatgtgaaattcagccagccaatgaatctggatttagcaattcattgcaacaatgtgaaggcaatgaaccaattgaagaggaggttgacattgttggtggggatgatcctcctcttccaagttaccctccagcagagattgagaatggtggcaccaacaaaacaagtgaacacagttcaagcagctctagtagtgaatctggctcttcatccagtgatagtgagtcagatagtgaaccaggcattgctaaagcatcagaccattttaatcctatgaaggaaaaggttggatctggcttgtctattgatcaaaaggaggggaatcttgataattcagaaactgaaatcgactccatgaatgcagctggccatgttgagcagagttcccagactgattcagttagtgatgaacctgaaaaccaccaagagggggagaatgctccatctaagaagcaagtatcccccgataagctctaccgtgcagctttattaagaagccgatttgctgacaccatacttaaagctcaggaaaagacacttgaaaagggtgacaagtgggatcctgaaaaacttaggatggaacgaaaagagctagaaaggcggcagaaggaggagaaagctcggttgcaggcagaggcaaaggctgcagaagaggttcggaggaaagctgaagccgaagcagcaactgaagccaaaagaaagagggaactggaaagagaagcagctcgtcaggctttgcaaaagatggagaagacaattggtatcagtgagagtagtcaatttttggaagatctagagatgctgagtggtttactagatgaacatttaccaaatttcacagaggaaagaagtcctgatcatcttgaaaatgggctgggtagtttcaaactacagggaagttgtaatccgttagaacaactaggcttgtacatgaaggctgatgaggaggaagaagaagaagaaatgcctcagagtactacaagagaaacaaatgatagtattacccctggcttggcactcatgaaaaatgtgatagaagaagctagaatgaaagggcataaacattggttttggtttttaggaaaggaaatggtttga

SEQ ID NO: 24957 - DNA, 471 bp, Glycine max
  Peptide Sequence Number=SeqID_116642
atggctcataaaatttgcattagtcattttggttatgctgctattgtttctgggttgattttgggaaactcaatgcgtcgtcgtattacaccgtggttgtggattgtggaggcactggaacacgctttggagcctttgattgtgtgggcagagcatctggtgccgcgagaaatgcaagggaaaactcctgtttttgtcttggctactgctgagttgaggaggctccccagggaggaggcgagccgggtcttgggggacgtcgaggctgttgtgaaagatcataactttatgtttagcaagagctggataaggtttttgagtgggagggaggaagcttattatggttgggtggctttgaaccacaaaatgggcatgttcgatagctacccagggtctcccactttgggacttgttgatttgggtggctcatcgttgcaggttgtggtagagatagatggtgctggggatgat

SEQ ID NO: 24958 - DNA, 339 bp, Glycine max
  Peptide Sequence Number=SeqID_116643
atggagctcatgcgaactgtgtacccaaccaccgctgttcctcttcctctttcaaaccttcccgttaggaccaatttcgccgttcggtgttccaacgttcactcgcaaccgcagctcgactcgcgcaagttagttcttgcagtgaaggaaaagcttgaaaaagaacatcatagtctccctgttggcagaaatggaagggatgacgaagatatgatactgtggtttctcaaagatcgcaagttttctgttgatgatgctatttacaagttgactaaagccattgtatccttcttttcattattatatcattctggaattttattcataatcattgtttag

SEQ ID NO: 24959 - DNA, 4332 bp, Glycine max
  Peptide Sequence Number=SeqID_116644
atgcagggagttccacaacccaagaatgaagaattttctctaagctctggagactttccaacccttggttctgataaagataagtcagttctgaattctgagttgcaagaccacagttctcaagctcaccttgactcgtcttatgaactcaggaaagatataaatgagacccctgttactgatgatgttcctgtaaatgcaaatattaagggtggaactgtaaattcttggaggagagataatctggcttataacgaggaaggtgtgaggtcaggcatagagaaatggcagggaaattcccagccttatccaaatgccggtattcctcctcaaccatatgatgcttggcatggtcctcccgtaaataaccctcaaggctgtgtttggttcaggggtcctcctagtggtcctccatttggaaatcctgttcctcctagtggctttccaattgaaccatttccatattaccgtccacatatgcctcctactggtcttgcgaacccacccccaggtccccctcctggagctggaccaagagggcaccataagaatggagatgtctacagacctcatatgcccgatgcctttattcgtccaggcattcctatgagacctggctttttcccttgtccaatggcctatgagggctattacagtcctccgatgggctattgcaattcaaatgaacgagatgttcctttcatgggaatggctcctggaccccctgtctataataggtacttgaatcaaaatgcccctgaacctgacaattcacaaggtagatctggtgggtatggtaatgctggggagcaattgacctcagagcaagtggaatctggtcatcctcctgatactgctggaccttacagagttcttcttaagcatcatgaatcagatgggaaaaatgaaccaacaaattgggagaattcagagacaaccaatgcaacacatgttgatggcaggggtcaaccaagaatgactgtttgggagaatgagcagagatcaaattacagaaagaatgaggaaagggatttcaggacaagtactcgtggtgaagtttcttctcggtcttcagaaaatcaaatatctagttcttctgtcatgaaggcaaaatttcccgaaagttcaggaaacataaaaaaatctgatgatatttctgcaaggaaattggatggtgttgcctctgatatgctagaaatccccttaaaaccatctgctccaaaagatgccaccctgattcaaaagatagagggtttaaatgcaaaagccagggataattcatctgctagaattagagaggagcaaaggaataaaattcatgccagtaatgctcctataaaccatgtggaaaatgcagttggtgcagatgttgtgtttccagcaagaacccatgccacagaaatcataaatcctgcccatcatgaaatgggcgctgctggtgcagaaaagaattctgaatccttatctttcagtggaacagccacatccaggcaagctgctcatggaatgcacggtagaggcatccatcgtaacaaaggaagatcaaacaatcaagatgctgatggttggcgaaagaaatctgtggttgaagattcttcagcctcatctggtgcacagttggaagcatctaatgttcttgtgggtgatcatcaaatacctgttcagacctacgataggtctggatcctttaataaagccaggcacattggagaatctgttcagaccaggtctgatcctgctgacagccatgcacagcgtgccaaaatgaaagagttagccaagcaacggactaagcaactgcaggaagaggaggaggaaaggataagaaagcaaaaggctaaagctcttgcaaagttggatgagttaaacaggcgttctcaagcaggagatggatcaacagagaaagagtatgctacaaattctgccatccagaataagcaagaggaattacaaccttctgaatctacaactgcagcaggcaaatttgcacctgtcagttcagccgtaaattgtaatgccaatactatctgtcagataaatgaccccagcattagtaaagtggaaaaatcaccagtcttgtttggtgagccaattgtggagacacttaagaattctggcaaagagcctgttctgaatcatcaagcagtagccctgcaccaggatattaataatgctggtgctactaatgtgcataactatgtcacctcgaagcagaagcgaatgaactataaacaaaagcaaaatcttcctttggagaaaacatcaagtgaaaaggttgtttctaccacctcaactgccttgaaagttgagaatgagacaagggttgatgtttctctatcttctggtggtgttacaaacgacgttggttcagcctgtggctctgacttacccatgaattcagctgctttggttgagtcttcagtaaatctgaaaaagaagaatatcaggaatggcaaaaacaaacagaaacatgaagaaagttcatctcaggctgcactaccatcggcaataccaaaagaatccaatctttccaaaagttcagttgaaagtgataagtctaaggcttctgactttgagttagatcagggctcacttcagccagcacccttgtctaaagatccaaatcagttttcagagcaacacaaatatttagcaaatgaggaatcccatggtaaaatgaatagccagtggaaatcacagcattctcgtaggatgccaagaaatacgcaggccaatagaccagcagagaaatcacatgggactgatgctgtgatgtgggcacctgttaaaccacagagcaagagtgagatcatggatgaattgagtgagaaaagtaaagttgaggcagttgatcctgtaaagagtgagcagcaggtgcataatttaaaaaataagagggcagaaatggagaggtatattccaaaacctgttgcaagagaaatggctcagcaaggaaacatacaacaggtagcttcatcaagcagtcaggctcctactgatgatagcattgggagacttgattctgcatcacagggcccccaggtcattcagcagaccaatttagttgttggaaaagtgggttctggaatggagtctaaaaacagagatggaaggcatactaagcagggaaaagcgcatggatcatggcggcaacgaaatataacagaatcaactaatgtgcatgatgtactggaccatgattcaaactctgaaccaaatgttcagagacaaacagagcatcatcatgatcagaagtctgaagtaagctttgtgaaagggcaaacaaagcattttaatgactctggtgatattgatggttcaaacaattctaacaggaatgatacagctgctttggcctcagttcctgttattaaagatcattcagcaacaagtagagggaggcgggcccctttcagaggacacaggggtgctggggggaaccgtgatgttgatgacaaaaaaaattctggggaggcagagaaagttgaaacacgtatttcatcctctgagcacggtcaacctgatgttggtgtggtggcttctaaagaaaatcgagctgtcggggaacgtttgatgtctcaatggcaacctaaatctcaagcatctaataatcacagaggaaacatatcaagtgatcaaaatgttagctcagtagttgttggagctaacaaaaaggatcccactcatgatggggaatctcttccagtgaaccgtggcaagagttccaatgctcacgtctcccaacctttccatgatcaatcagtctctgaaaagagcaaagccggagaggttccccattttgggaatcaagagggtaaaagagagagaaaaagtgctccatcaaagaggcatcaccactccccaaatgaggtatctgttacctcagttgagcaggctccaacaagtgcagatcttttgcatgatcaacgcccatcttctgggtctggcaaaaacgtaaaccataatcggtttcgaagaggacatgaattacatggagattcaaagccaccaacccaagataacagacattataatcaacctacaaaccgggaaaggcagggcccaaacttgcattatgagtatcaccctgttggctcatatgatgatggcaaatcagacaactttgagcgacctaaaaatggtaatcatggtgggggaagatttagggagagagaattccatccatccatcaactgtgctcctatattcagccgtgttttcaggcgcattaattatcttctgatgttcagtatgtattcagcagggcagggaacgatgaagatggtgtccccgtttttgtggggggggggggggagagttccctgcggttga

SEQ ID NO: 24960 - DNA, 726 bp, Glycine max
  Peptide Sequence Number=SeqID_116645
atgaggtcaaagatagtgttgtttggagactccataacggagcaatcgatccgagagaatggatggggtgttcctcttgccaatgcctattctcgcagggctgatatacttgttcgtggttatggtggatacaacactaagtgggctatgttcttactggaccatctcttccctctggactcaactaaaccacctattgctaccacaattttcttcggcgctaatgatgcagctttgttaggaagaaccagtgaaaggcaacatgtacctattgaagaattcaaagagaacctcagaaaatttgttcgacacttaaagcaaatggctggttgtacacttgtactaccttccaaggcaaatattttgaatgctttctgggaatgctcaccaactatggtaattgtgcttattactccacctccacttagcgaggaaggacgcctggcttacgcaagatccgtaaatggtgagaatgctaccaaaatacctgaaagaacaaatgaagtaactggtcaatatgcaaacgcctgtgttgaggtagcaaaggaaatgggcgtgtgggatgggttgcacctgacaacagaaggaaatgcagtagtctacgaagaattgataaaggtgttcgatgaagcaggactttctgctgttaacatgccaatggatttccctcaccactcaaaaattgattccaaacatccagagagagctttccagcagcatgtgtga

SEQ ID NO: 24961 - DNA, 645 bp, Glycine max
  Peptide Sequence Number=SeqID_116646
atgtcacaggtcgcagcattggtgccatcagcattgcaagttgcattcctcagtggcactagcgctgtctccattcagcaccatcttctccaagaagtttcagctaccactcttccgagtccttatatcgccgccagagtcatccaccaacaaaacgacgaggtcgacgttggcgatgccttcgcccgactcctcctcccctgtgtccgccggcgacattttctacaacggccagatcagaccatttaccccgtcgttcacgcttccgttacgtccgttcccgtcgaaacggctcgtcgtccacgtttaaccatgaggacgctgatgttcgaagaggcgcgagagacggcaaacgacagccacgagctagaaggcgtggctgagggaacctactgcgtgtggaccccaccatgcaagaggcaagccccatgtccaagcgctggaagattcgagatcttctgcctcggagagtcacagcgatgggagagtggagcgaggaagagaaaacgagatatggtggtggaaaaggagcggaagcaaaagcataaggtgaaggaagacaaagaggcgatagttgaccaaggaagatgtggagaactaactcatttggagttgttgcttgttgctggtgaaggaaagtcttga

SEQ ID NO: 24962 - DNA, 2193 bp, Glycine max
  Peptide Sequence Number=SeqID_116647
atgccagagatcgttacaaatggagttaatgatgaaagaagagtaaatgaaatgaatgagattgggaacatttcacccttgagggaaaccccaagtccaatcaagaacctgaggagttccttgagtccacaaagaagacaaagtgttggtccaaattttcctgttaatagggtgattgacacttcctcaattgataggcttcatggaaatgtttgtgacaagcaaagttctagtcaatcaccctcaagacaaagttttggatccgatggcaatgagtcaaaaaccgattcagaattgcacaatctagtgaaagagggagtaaagaaaaagacaaaaggggattctagaagtgaagcatcttccaaaatgggcagtttgtcaaatgataagaagttggataggattcggccagcaactgcaagtggtgttgtttcacaaaaactaaagaaagcatcacaatcacagttggcccttgaatttccatcaagatcaagaccaaagggaaaaagccctcctccaaaacctcctgttgataggaagaatgataataaccctttggggaaacaaaatacaagagttatccgcgtgaaaaaaactgttggtggaagatcactgtcacaaagtcacattgagaatttcactggatcagcattggataggcctgatctgggactagctttactaaaccaagcaaggaacatgatttcatcgggagataatccgatgaaagctcttgaattatctcttcaagcaatgaaattgtttgagagagctgctgcttatgggaaaccaagtttggatttggccatgtgtttacatgttactgcagcaatatattgcagtttgggacatttcagtgaagcgattccaattatagagcgctcaattgagattcccactattgaggaagaccaccaacacgccattgctaaatttgccggtcacatgcatctaggagacatatatgccatgttaggccatcttgagaaatcaattaagtgctacactgaagggttgaaagtacaaaggaaggctttgggagaaacagatccaaaagttggtgaaacttgccggtatgtggctgaggctaactttcaagcattgcaatttgatgaagcagagaggctgtgccaaattgcccttgacattcatagagcaaatggttcaccctcatctcttgaagaggcagctgataggaggctaatgggacttatatgtgaagcaaatggaaaacatgaagcagccttggagcatcttgttttggccagcatggcaatggtagcaaatggccaacatgtggaagtagcatctgttgattgcaacattggagacacatacttatccttggctagatatgatgaggccatctttgcatatcagagagcattggcagtttacaggactcacaaaggtgagaatcatccttctgtgggatcagtctttgtacgccttgctgacttgtattgcaggacatggaagataagggaatcaaaatcatattgtgagagtgcacttaaaatctatgagaatcccatgcctggggtccctccagaggaggttgctagtggttttatgaatgtctcagccatttatgagtcaatgaatgagctagaacaggcacttaagttacttcacaaggcactagagatacttaatgaagcctctggtcagcaaaacacaatagctggtattgaagctcagatgggagtcatgtactacgtgttggagaactacactgaatcttacaatactttcaagaatgctgtgtcgaagcttcgtgctactggggagaagaaatctgcattctttggtactgttcttaatcaaatgggacttgcttgtgtgcagcttcatgccttagatgaggctgtcgaattatttgaagaagcgagggtcattctggaacaagagaatggaccttatcaccctgaaacacttggagtatatggcaatcttgctggcacgtatgatgcaattggaaggttggatgaagcaattgaaattcttgaaaacattgtggtaatgagggaggaaaagcttgggacagcaaatcctgatgttgttgatgagaagagaaggttggacgagttgttgaaggaaacaggcagagttcggaacagaaaaaccaagtcactcgagatcctttttgacgccaatcctcgtactataaaaaaccttgtcgttgaggcctga

SEQ ID NO: 24963 - DNA, 267 bp, Glycine max
  Peptide Sequence Number=SeqID_116648
atggttaaatgtcacaattattgtgttgatatatttgttttccgtccttctgttagtgccaggatcactccgatggcgagcaaggaatatggcactagggcagtgctaggagcagcaatttgctttcctcttggttggatccatctgaagctggtaaaaatggctaacgaaggtaatccagctgcacatccacactcagatcagagagaagtgaagagtggggttagtgctgcaattgagaggcttgaaggaaatttaagtaaatga

SEQ ID NO: 24964 - DNA, 1041 bp, Glycine max
  Peptide Sequence Number=SeqID_116649
atgaggtttgtgactggctctcccaaaggcacgtggcaacccattatgactgcggatacaaccacagaaagttactggttgaattggagggttttggtttgtgccattttggttctgttttcagctatcatttcttcactgattgtattgaagtatgaagtttcacggaagaaagcaagaaatggtgacaaggaaggcctgaatttgaaagaaacatcgtcaactttgtacgaggatgaaatttggaggccttgtttgaaaggaatccaccctgtctggttgctcgggtttagagtttttgcctttgttgtgcttttggtgcttctcatactcactgctaccgaggatggaggaagcattttctacttttacactcagtggacttttgccgcagtcaccatttattttgggctgggatctttgctctccatgcatggatgttaccaacatcttaaaaaagctagtggtgataaggttggaaatgtagatggagatgcagaacaaggaatttatgatgcttctacacccccacagggttctaatccatcaaaccatgagaaaggtttaggagctccacaagaacatcttgttcgccaacctgcaagcacctggggttatatctttcaaatattattccagatgattgcaggcgctgtaatgctcacagattgtgtgttttggttcataattgttccgttcctaaccatcaaagattacaacataaatttgctaataatcagtatgcacaccatcaatgctgttttcctaataggcgatacggctttaaactccttgaggttcccttggtttcgaataggatacttttgcatgtggacaatcacatacgtccttttccagtggattgttcatgctatagttaaactctggtggccatacccttttcttgatttgtcatccccgtatgctccactatgtgcctctaagttacttttccatggcattgctgcatattccgtgctatggcatattcgctttgataatgaagctgaagcacagcgtgttgtcgacgcggtaccctga

SEQ ID NO: 24965 - DNA, 141 bp, Glycine max
  Peptide Sequence Number=SeqID_116650
atggagaaatttgaatccagcatgaccaagatcatgtatcatattcccaaagcagttgccagttcacaaagttcactgggagttaacaacatggaaaaagttagagcaaagaaactcaacaaaggagaaaaaagaatttga

SEQ ID NO: 24966 - DNA, 501 bp, Glycine max
  Peptide Sequence Number=SeqID_116651
atgaaagagttctaccacactgttaggcaagtggaggtggaggatgctctccgacaaggagagtcggagagcttgtggtgtaaaattctaagatcaaaatatggggaagggtactctagtggagaagtatcaaaaagagagcaagatacaggcgtgtggtgggtggagggatggggtatggtcatggcagaattggttggagtgggaaaaactgatggtagaaaagttgatggaggaggatttgagatgcccgttctgcaatgcatgcaaggagaatgccaatcatttgttgttcctatgcaggttctcgacaaatatttggaacaagtgctacaattggcagggagtggagatggtacagcacagcgatcctcggaagcgctttgttcaacaccatatgggaagcttcttgaagaaaccagcaaacttggcttcggcagtatggtgcgaaacaacatgggtcctatggcagcaccaaaatgggattatctttcacaatga

SEQ ID NO: 24967 - DNA, 174 bp, Glycine max
  Peptide Sequence Number=SeqID_116652
atgacgaggaggaagagggaaagtgaggtggtggtaaagagtggaaggagaaggaagaggataagggagtggaaaatgggtaaggccctcgaaggagaagtaagtgtgaacattggtactacaccagggaagactgagtgccataatgaggaaaaggctaggtcgcgatcttag

SEQ ID NO: 24968 - DNA, 379 bp, Glycine max
  Peptide Sequence Number=SeqID_116653
atgccaggtcctggtcctcaccttatgtatgccatgggttctggtttgtgtctcacaagcatcagcaatgggaggtttagtccccaccacacactcttctacaccatcaacgccttctttggccctgatgttggttctttcacggagtggcttggttcactctttggtggctctgctcatgcttttggatctgcccttgaagatctcactcaccatcccctcttctacatccttcttttgggacttcctctctcttttctctattctcggatatcctcctatcttctccacacgcagcttcttgattctctctccagagttggtctccctctccctttttcgtttcatttcctcgttgtggaaaattcaggtttcaccg

SEQ ID NO: 24969 - DNA, 276 bp, Glycine max
  Peptide Sequence Number=SeqID_116654
atgacatcttcgtcgtcatgttcatctagtatacagattaagtctggtccaatagatggagacgttttatggatgcaagctaagcatgtttcagaaaatgtttggaatgaggaatcagacagaaaattacatatcagacgagttgtccccatctatcaaggacaagaagaaataccaaagaaaattattcatctgcttcgacaatctaggtttttattggataatgaagatggactacctaaaaataaattcgtcattaattactgccttgattga

SEQ ID NO: 24970 - DNA, 192 bp, Glycine max
  Peptide Sequence Number=SeqID_116655
atggtgtcagcaggcattgagggtggtgtgatgacagcgatagcaatggtgttgggcggcagcaatgatagtgaaggtagcaatggtaaaagggacacacaggcggtgacaagggtggcagtgaaggtggagacaatggcagtaggagcagcaaaaacaaggaaagtagttgcgcaatgtggggtgaggtaa

SEQ ID NO: 24971 - DNA, 1659 bp, Glycine max
  Peptide Sequence Number=SeqID_116656
atggcaggaggtggtggagctccagcacctaagattgatgagccacaacctcatcccccgaaggatcagttaccgaatgtttcttactgcattacgagtcctcctccatggcggacttgggttctaatttatgaaagtgcaatcgaagctgaggccatacttcttggttttcaacattatcttgtgatgctcggtacaactgtgctaattcccactgctcttgttccccagatgggaggtggcaatgaggagaaggcaaaagttatccaaactctactttttgtagctggaattaacacattgctgcaaactctgtttggaactcgattgcctgcagtaattggagggtcttatacttacgttgcaacaacaatctctattattctttctggtcgattcagtgatgagccagatcctatagagaaattcaagaggataatgcgggcaacccaaggtgctcttattgttgcttcaactcttcaaatagtactaggctttagtggcctttggcgaaatgttgcaaggttcttaagtccactttcagcagttcctttggtatctcttgttggttttgggctttatgagttaggctttcctggggttgctaaatgtgtagagattggactgccagagcttatattactagtatttatttcacagtttgtacctcatgtgctacatgcaggaaaacatgtcttcgatcggttcgctgttttatttacaattgcaattgtatggttatatgcttatctgctcactgttggaggggcatacaaccatgctgcacctaaaacacagtcaacctgtcgcactgatcgatctggtttaatagaatctgccccatggatacgagttccttatccatttcaatggggagcacctacatttgatgcaggtgaagcctttgccatgatgatggcatcctttgttgctcttgtagagtccagtggagcttttattgctgtctatcggtatgcaagtgcaacaccattaccaccatctattcttagtcgcggcatcggttggcagggagttggcattctgttatcaggattgtttggaactggcaatggatcctctgtatctgtaggaaacaacttccttgttgatgaggtatttgtttggtttccatatagagaaaatgctggtcttttggctttaactcgtgttggcagtcgaagagtggtgcaaatagcggccgggaaatttggagccgtttttgcatccattccacctcccattgttgctgcactgtactgcttgtttttcgcttatgttggagcgggaggtctaagttttcttcaattctgcaacctcaacagttttagaacaatatttgtattaggctactccatcttcattggcttgtctgtgtcgcagtacttcaatgagtacacagcaattaatggttatggtccggttcacaccaaagcaagatggttcaatgatataatcaatgtcccgttccaatcaaaagcctttgttgcgggttgtgtggcatatttcttggacaacacactacataagaaggaagctgctattcggaaagatagaggaaagcattggtgggacaagtaccgttccttcaagactgacacaagaagtgaagagttttattcactgcctttcaacctcaacaaatacttcccatctgtgtaa

SEQ ID NO: 24972 - DNA, 882 bp, Glycine max
  Peptide Sequence Number=SeqID_116657
atggaaagaaggagagtaatggagcacctaaagacatatcctgcgtttcccgggtggtatgctgatgtttcctggccaggagaagcacacatatataaaatggaaaagatcctattccacgggaaatcagaattccaagagcttcttgtattcgagacatctagacatggcaagattgcaattccggatgggtatatccagctgacagaaaacgatgaatttgcttaccaagagatgctcattcaccttgcactctgttccattccaaatccaaagaaggggggagatggtggaattcttagggaaatatcacgccactcttctgttgagcatattgatatatgtgaaatagacaaaatggtcattcatgtttataagaagtttttcccagatatagctgttggttacgaggatccccgaatgcatgttcatatcagagatggagttgcgttcatcaattctgttcctgagggcgcttacgatgtcattatactggatgcttttccagcaatgggacatagtgcagatgttcttgctgataaatgcttcttagaatcaatagcaaaggctcttcgaccccgtggagtgctgttgtggcatacgaactctgaggttgcagataccatagctaattgcaagatattcaaaggctccgttaattatgcctgggcaacagttcctgcatatgtaagtggggcgattggattcatgctttgctccacggagggtcccccagtgaacttcaaacatccaataaataaattgaatccagagaaaaatggggtagcaaagggacctcctaagttttataactcagagatccatgctactgccttcttttgtggacaaggttggttgatccaacaagatattcataaataa

SEQ ID NO: 24973 - DNA, 336 bp, Glycine max
  Peptide Sequence Number=SeqID_116658
atgcgagacgaagaggcgaagagaaatcaaggctgttgtggcggcgagatacgaagaggcaaagagtggaggcgcgagaggcggagaggcgaagagaaagagagtggagacgaagagaaggagatgaggtgcgatagtgacactaatagtgatgatggtgttgcggtggttgcaatgacaatgacgatgacgatgatggagacaatggtggtagcaatgacaataaggacaaaggtgacgagcagtggtgatgatgtgagtggtggttgttacaataatgacaatgacgataataatgagagtgatgattacatgattgttatgatgacacaatga

SEQ ID NO: 24974 - DNA, 210 bp, Glycine max
  Peptide Sequence Number=SeqID_116659
atgactggcagcttggacaaaagttttgaaggtgttccaagaagtgttagagtggaaagatctgctgatcaggtccaaaccaacaaggtttcaagattattctctggaacacaagaaaagtgtgttggttgcaagaaaacagtgtacccaattgaaaagcttttcactaactttgcttatgatctcatcattagttctaagctcgggtaa

SEQ ID NO: 24975 - DNA, 1119 bp, Glycine max
  Peptide Sequence Number=SeqID_116660
atgtcgctcaagcgcccccccgatgatgggaaaactccagacgacaagcgtagaaagcctcctcctttctccagtgtggtgcgtgacgtgatgaagttacaagcactcgggcatttgctggagccaattctagagcccttggttcgtaaagtggttaaggaagaagttgaagccgccctaaagaggcatttaaccagcatgaaacagacctgtggaaaggagtttcatactactgaattaagaaatttgcagctgcagtttgaaaacagcatttgtcttcctgtctttacaggagctcgaattgaaggagaggatggctccaacttaagaataagtttagttgatgccctaacagggaaggttgttagtacaggacctgaatcgtcagctaaggtggaaattgtagtccttgagggtgattttgaagaggaaagtgaaacttggatgcctgaagagttcaagagcaatattgtgagagagagggaaggaaaaaagcctcttcttacaggagatgtaattttatatcttaaagatgggattggtatggtgggtgaaatttcatatacagataattcaagctggacaaggagccgtaggttcagacttggagcaagagttgtggacaactttgatggtgttggaataagagaagcaaagacagaatcattcattgtcagggatcacagaggagaattgtacaagaagcaccatcctcctagtctgtctgatgaagtttggagattggaaaaaataggcaaggatggagctttccacaagcgcttgagtcgggaaaagatccttactgttagagagtttctcacacttctcaatctggatccagcaaagctgcgcagtatactgggcactggtatgtctgcaaagatgtgggaagtaactgtggagcatgctcgaacttgtgtacttgatacaacgaggcacgtgtacttcccttctaattctcaagaacctggtgtggtcttcaatgctgtgggacaagtgacaggactgctttctgaatgcgagtatgtcacagtagaaaagctgactgaaactgaaaaggcatttatccctcatcacctattactttccttactctttccttccttctcttctctttaa

SEQ ID NO: 24976 - DNA, 969 bp, Glycine max
  Peptide Sequence Number=SeqID_116661
atggaaaagaagcggaagaggaagcagcaggtgaagcgcgacggagagccaaagcccaaatcggttcgtgcgggttcaacccgaaccgacaatgtgaaagatccatttccatctcacgctcgacccaccccacaggaatgcgaagccgtgcgtgacactctcttagccctacacggcattcccccggaactcgccaagtaccgcaaactcccaccgtccgatgaaccggtccaactgcagccacccgaaccggttctcgacggtcttgtccgaaccgtcctctcgcagaacaccaccgaggccaattcccaaaaggctttcgcttccctcaaatcctcctttcccagttgggaacaagttctctgggccgagtccaaggacgtggagaatgccattcggtgcggaggtctagctccgactaaggcttcctgcattaagaacgtgttgcgttgtttgcgcgagagaagaggtgaattgtgtttggagtatttgcgggacttgtcagttgatgaagttaaggctgagctttctcttttcaaaggaattggtcccaaaacgcatgatgagcttaagcctatctctaaaactttcaccaactctctaagtgagttgggaaatttgaagcttgaacacttgcctcaagactacaacggctctgcccttacgcttattgaatcactgtctagccttgttattatgggaaattatactgaattcgagagggcagtgctctggctttcagaaaatctgacatttgatgttgatgcgcgcataaatctttttgagtgcaacataagagttcttggaggacttgtctctgctcatttacttgcatctgattcttcaaagaagttttttcaaggagcttacaaaaatcagttgctagctcttgctgaagatttagggaaacgctttctaccagcattcaatacgcctactggattgccgtatgcatggattaacttaaag

SEQ ID NO: 24977 - DNA, 1140 bp, Glycine max
  Peptide Sequence Number=SeqID_116662
atggaagaagaaaaagcagcggcgtactacgacgagctggcccgtaagggcgagggagctgcgaggttcaagcaaggtctaggcttttcctcttcagcaccaaacgacgacgttccaaaaccctcctcctccttcctctccaaattcgtcaaagcctcctccgagtcggagaagcaagcgcagctccaatccatccacgacaagcttaagaaaaatccctcttccgagtctagggtttcgagcagcgacagaagcaggagcagagaaaaacgtaggaaaaggagcagaagcggagatagatacagggaaacgcggaggcgaagcaggagtagagagagacatagggatagtgaaagagggagacggaggagtagaagcgtttctcctcgcaagcaacgcaggtcggagaaagacgcgaattatagagggaaagtcagtgaaacgaagaaagggaagaatgctgagattgattattccaagcttattcaagatgaagatgatgttttaatgttatgccatagggctagttggtgcatgattgatatgagattcaggatatgccaagctagtagtgtcttcaaagttgaaaccctctactggatctctaacttggtgactttaggatatgttagtcaaaaaatgtcagcaacatgcttttttctaaactctctttactattggctgaaatttgtgtcaagattcatggacatctgttgttgctattgtctacagtcatctgctgaaagagtcaaagccaagatgaagcttcagctttctgaaactgttgcacaggattcagaaaagggtgtgggctgggagcgatttgagtttaacaaggatgcccctcttgatgatgaagaagttgaagttgctgaagatgacgcatccttagtcaagcacattggccaaagtttcagattttctgcagttgaggcaagaagggaggagcaaatacaagctgctcatgaggaagctatgtttggtgctacagcacttctgcctcccaccagtacagacagtgagcctgaaagggagaatgagaaggaggctgataaaaaagaactggttgcaagccttttaagtgaaacagtgctggccaagcaaaaggggtcttggcgtgatcgggttcgtcaagcttag

SEQ ID NO: 24978 - DNA, 645 bp, Glycine max
  Peptide Sequence Number=SeqID_116663
atggaagcaagaatgaagatccctgtgttctcagtattcaagattgttaaaattaggaggtttcaaccatccatgatccagaaccttgatgaaatctttttggatttgactgaggaagaggtgaggacaaggctgaagctgccctctagtggatcactatcagcagtgacagacttggtgcaactcatagatgaaggacctttgatgcaagaagacaaaagaatggaagggaaaatgatccaagcaggtggctgcataaacaagcagaggtcgaaagaacaagtgacagcagcggaggttaggggtttaatgatcaacacatcatcactgatagagccacaatattcagaaccaccataccttggggcttggacagtggctgatgttatgttggagttagagacaagaatgaaaattggcagatcaggccagctgcaaaaggaaagggaggccaagatccgaacactgtgggtgaggaaagggaaagggctggaattacagaaggcagcacaaattcagaggcataagcactgtttcaaggtcaaaagggcagcagaaaacagagcacctgaagagaacaagcgcatttacatttttgtgtttgacccaggaggaatcagagctattttcagtattttgggatga

SEQ ID NO: 24979 - DNA, 168 bp, Glycine max
  Peptide Sequence Number=SeqID_116664
atgaagcaaagaagcttggcaaacaaagctaatcgaagcaagcaagaaataaaatcaattattggcacaaaatcaatcgtgcaaaagaaaaaagattcaatatctggtgaatggtcagatgctatgaaagtttggaaggctactcacatgagatctaatggagcttga

SEQ ID NO: 24980 - DNA, 1515 bp, Glycine max
  Peptide Sequence Number=SeqID_116665
atggaaggctctgaatccgattctgtgtcactttccatttccaatggcgaagagccccaattggggcgaccttcttcccccgccgctcctcctgagccgtcagatctcaatcatgcggcggaggaagagacactctccggggagcttcagagcaagttggatttgaaggatgtggatgaaagtgaggagaaagtttcggactttaacgatggtggaggagtttgtgatgaagaaactggtaagggtgatggagatagtaagggttgggagaccaatagttggaatgaggaagtgggtgttgatgttgatgttgatggtgatggtgatggtgatggtgatgatgatgttgatggtgatgttgatggtgatgatgaagtggagaagaaggaagggagaaacagtggtggaactcaccactaccctttgaggcctgaagctgaggattgtgcattttatatgaaaactgggaattgcaagtttgggtttaattgcaagttcaatcaccccattaagaggaaaagtcaggctgttaaagagaaggcaggagaaagagaagaaaccacagaaagatcaggcatgacagaatgcaagtattatcaaaggtctgggggttgtaaatttggtaaatcttgtaaatataaccacacaagaggaaaaatttcaacagcaccagcaccacttttggaacttaactttcttggcctgcctattcgtccgggggaaagagagtgcccctattacatgcgcactggctcttgcaagtttggagcaaactgcaagttcaaccatcctgatcctacagctgttggaggaggaggaggtaatcctccttcagggtatggtaatggagggtctatttcattacaaggtgtatcacaaacatctgtaccctcctggtcttctccaagaacattaaatgaagcatctccttttgtgccaatgatgctttcacctactcaaggagtttctacccaaagttctgattggaatggatatcaggtacattggaactgtagcaaaatgagtattagaatatttgaggcatctgtctacttacctgagaggagcattcatccaccttctacatttgtcatgaacaacccagcaattgatacaaatgtttacatgcaccatcaaaagcagatgcctgttgatgagtttccagaaaggcctggtgaacctgaatgcagcttcttcttaaaaactggggattgcaagttcaaatctaattgtaaatttcaccatcccaagaatcgggttacaagattacctccatgcaacctcagtgacaagggtctacctttgagacctgaccaaagtgtctgctcacattacagtcgctatggaatttgcaaatttggaccagcttgtaagtttgaccacccgataaacttgcagcccgtgatgattcctggacttgagcaacaatcctactcaaactcagctagtgctggggtggctgggataggtggaagtacaggcgtaactgatgcgacaattcagcaatctgtgtaa

SEQ ID NO: 24981 - DNA, 2940 bp, Glycine max
  Peptide Sequence Number=SeqID_116666
atggatggtaggaggcattctgttgatattcctatttccaaaactcttgtggcactgaagagagtaagatcattgagggatccatctactaatggtgttagcagactctctcctttggttgatgatggagattgggaagatggttctagtaatggggtttctctgagtttgaggttcctgaatggttctcatgtatgtgattctaatggtaatggtcttttaagatcaagtagtttagattttaagggacaaaaagagcaggacactgctgagtttgaattagaaatgtggaactctaagatgaactattgtgggatctcatgtcaggaagggctacaagatgatggactagtttactctaatcctaagcaacaaggtatttctggagataaatcaccgaatgaaagctgttgtagcaaccatgaaggtagaggattggatttggtttccatcatgccttcatctaatcatttgaaggatggagagtcatgctatttgtcaattgcaacaagagtagaacactcaaagtcagcaagaaaatccctatgcaagaatcaagtgaaaccatcggaagtgattggtgatattgcaagccatgtaggaagtcaacaatgcctttctgtttttgatgcttgctcagctcgtagtgcctcggaacatattgctcaagaggttgatgttttagatagtcaccatggatgtggattaaggagttgtttgtcaaagtcaccaaggtttagagaatcaaatcgatattctgaaatagaaagccttccgttgatattgcagcatgtaaatgagacggatctcaatggacatagaagcatgagacacattggtgttgaaattagtccaacttcagaaactcctagaagtttatctatgaaattcaggccaaaatctttcagtgatttggttgggcaaaatgtgataggaaagtctcttttgggtgctatctctacaggaaggatatcatcattttatatcttccatggaccacgcggcacaggcaagacctctgcgtctaggatatttgccgctgcaatgaattgcctctcccctctggagcaaaagccgtgtggtctgtgtagagaatgtgttttgttctttttgggaagaagtaaaaatgtcaaggaagttgattctttgagaatcaaccgtgcagacaaggttaagtcccttgttaagagtgcatgcattcctccagcttcctcaagttttaaggtgttcattgttgatgagtgccaggtgttgcatggagaaacatgggcgtgtcttttgaattgcctagagaatgtttctccacgtgtggtttttgtgatgatcactcctgatttggataagcttcctcggagtgcagtttcccgggctcagaggtatcactttgcaaagattaaagatgctgacatagcaagaagattgaaaaagatttgtgttgaagaaggtcttgaatctgaacaagttgctttggacttcattgctgctagatcctgtggttctcttagggatgctgaaactatgctggatcaactgagtctgcttggtaaaaaaattactattagcttagtccacgagcttactggggtcatttctgatgacgaattgctggatttgctggatttggctttatcatctgacacttcaaatacagttataagagcccgcaaacttgtcagaacaaggatagatcctttgcaacttatatcacagttggcaaatcttattatggacattcttgcagggaaatgtgaacttggtgcttctgaaaccagaacaagattttgtaatagatatacctcggaagcagacatgcagaaactaagtcatgcattaagaatactgtctgaaacagagaagcagttgagaatttccaagaatcaaacaacatggttcactgctgctcttctacagttgagctccgtagaatattcatctgtggatacaaatgatgcaaagttgtgtgcacgagctgtgtccaatggagatggtgatatctgcagcacacctcctaaaggggacagcttggagcatcttgctacaacaggtcaatgtgatgacaagccatatacattaggattaggagtacaggaggatcacaaaggaacattggattctatatggtataaagccactgagatgtgtcaatctagcaggctcaaaacttttctcaggaaacaggggaagttgtcttcagtttgtattagtcaaggagctgcaggccgtgcagttgctgagttagagttccaccaccgtgactatgtaagtagggctgagaagtcatggaagctgattgcaagttctctgcagttcatattgggttgtaaccttgagctcagaatcaactatgtaccttcctgtacttcagattctatatatgctaaattgaagaggacatctttcaatttcttcggttgttctcgtagaattcgttggaaatctttgccatctaatgaacaaggaagtgaatcagactatgctgattacacttctcaaaagcccatgatgaaggatcaaactcaaacttgttcctctgattgtgaacctccggtgccaccatttgagtcctataatggaatgcaggtcatgacaactttgagaagtagtgaaggaaatttgctaagctcagggaaaatgttattgaataggcaagatcaagagactccaagaatttcttgttctagagttgattctctcaaggaagagggatgcaattatgagcatctagctccatcaacccttgatttagataatcagactgactgttttccccgaacccgctggcttcataaaaagttctcttcttcatatgcatcacaacagaagaattttgttttatctatccccaagttcaaatgttctgagacttatagatatgatctggaaccctgtatcttttcccacagctctaacaactgcaccaaagccattgaggaaaagtag

SEQ ID NO: 24982 - DNA, 504 bp, Glycine max
  Peptide Sequence Number=SeqID_116667
atgggagaggagccaaaccatattttctttagagctaatttgcaaaaggacaggttggaacagagccaacatgttgttagacaggttcgaacaatgccaatctgtggtaagagcagggctggaacagaattctacagttcgaaatgtagctggaacagagtgataaaagcttattgtgactgtttatggttccaggagcattacaaggacctaaaacaaaagtcattcttccccaagctgattgactatattacttcaggtcctgttgtgtgtatggcttgggagggtgttggggtagtcgcatcggcccgtaagcttataggggctacagatcctcttcaagctgaaccaggcacaataagaggagaccttgctgttcagacaggaaggaatgttgttcatggcagtgacagtcctgagaatggcaagcgtgaaataggtaaggcctcttatgctatccagtttaacccaaatacatgcaacaaacatagatgtgaattgtga

SEQ ID NO: 24983 - DNA, 792 bp, Glycine max
  Peptide Sequence Number=SeqID_116668
atggaccttcagaacactgtcaaagaagccctaaatgcactgtaccatcaccccgatgatgcggtgcgcatgcaagccgatcgctatctccaggatttccagcgaactttggacgcgtggcaggtgggtgataatttacttcatgatcccagtagcaatctagaaactttgatattttgttctcagaccttgagaagcaaggtacaaagggactttgaggagctcccttccacagcttttcggccgttgcgtgactcattgaataccttactgaaaaagttccacaagggtcctccaaaagtcagaacacagattagcattgcagtggctgccttggctgtgcacgtgcctgcagaagactggggggatggtggtatagttaaatggcttagggatgagatggattcccatccggaatatataccgggattcttggagttacttacagttctacctgaggaagtattaaattataagatagcagctcgcccagaaaggcgacgtcaatttgaaaaagagcttacatctcaaatggaagtttctcttaatatcttgacagcgtgtttgagtatttctgaacttaaggagcaggttcttgaggcatttgcttcatggcttcgcctaaagcatgggattcctggatcagttcttagttctcatccgctagttctcacggcattgtcaagcttgaattctgagttactttcagaggcatctgtaaatgctattttcttgctcactcaagtccatttaagtaatattgacattgctaagccagcaaatcctcattaa

SEQ ID NO: 24984 - DNA, 705 bp, Glycine max
  Peptide Sequence Number=SeqID_116669
atggcacaccactcctcacaacgtcggaatctagcagctccagaatctaaccctacaaccccaaactcaaacccagatctcattcaaacctataaaccctctttcttggcaaaagccatggcaacctctgccatacaagagaaagagagtaccgtgcctgtgaagagaacccacaaagagaagccccaaaggcactgtttggaattggaaaggaggaaacttggtgatcctaatgacaagggtatggtggaggatgctaaggttgtaaaaggaaaacctaggaatcctcatttggagaaacatgatgttgttgttgctgctgctgagagaatgtccgtgtctttggctccgggtgggggtgggggtagaaggagatccttctgtgggacacaggctgatttaagagatgtctttgcaatcaatggtgcgaaaatggtttcggttgatatgccaccctttatgcagatccatgctgtggattgtgctagaaaggccatagatagcatggagaagttcacatccaagacccttgcactctccctcaagaaggaatttgatggggtgtatgggccggcatggcactgtattgtggggactagttttgggtcttttgtgacccattctgttggaggatttctatatttctccatggataaaaaattatacatcctcttatttaagaccgctgtacataaagcagcttga

SEQ ID NO: 24985 - DNA, 327 bp, Glycine max
  Peptide Sequence Number=SeqID_116670
atgaacattgtgggggaagaagatgaacaacagtgcaacaacatgaataggaagatacaaaaaattcagaaccacaagtccacaacacctccatgtcatctctgtggttgcagatttgagtcgcaacgaagctccctctttttgtgccgccgcaactcccgctcggatccacaaaacttgaccactgtgggcgtcggaggaggaaacacagaggcgaggaaaagagcgcagagaggcagagaggaagacgaagagacgtggaggcaaagaaagacgctcgaggaagatgctacggaggaagatggctacggaaattttgaaaaatga

SEQ ID NO: 24986 - DNA, 4749 bp, Glycine max
  Peptide Sequence Number=SeqID_116671
atggggcacaaaaagcgaaaccctgcgccgcgctcgaaacaatccctcgcggccgccaccgccaacggtggtgccacctcgccggacgccgacaccgcctgcaatgtttccgatcacaaccctaggaagatcgaattggccacgctccaatccgagggttccgattactccacaatcaagctcgaatgcgagcgcgcactcaccacgctccgccgcgggaaccacaccaaggcaatgaagcagttgaaggagatttgcgccagagaggagggctcgcctcacgccgcgttcgtcaaccgagtccacagcctaatgtgcttcaagacggcgacggtcatcaccgacccgagctcaaagcagcggcatttgaggaacgcgctcgagtcggctcggcgcgcggtggagctcatgccgaattccgtcgagtacgcgcatttccgcgccacggtgatgttggaggctgcgagtgaagggaaggattatgaggaggtggtgcacgagtgtgagagggggctcgccattgagaaccctagtgatcctgcgaaggagacattgcaggatgagagcgagcagaaagcttcttctcttgaggaacggattgcgcacgtgcagaatgaattgaggcagcttattcagaagtcgaatatagcatcgttgtcgtcttggatgaagaatttgagcaatggggaggagaggtttcggttgattccgataaggaggaccccggaggatcctatggaggtgaggctggttcaaacaaggaggcctaatgagatcagaaggctgattcagaaaaattcagagtcgccacaatcggcgaatgagggagatagggatgataggcagttggattcatctgcaggatctggtcagaggattggcgataggaggaggcatggaaacgttaggaagagtggcttttcagctgagaggatgaagtgggtgcactcatattggaattcggttagtatggatatgaagaaggactttcttagggttaaaatttatgatcttaagtcgcactatgggtcttcaaaggatactttgccaaatgatatcttgtcagaagctttgttttatgctggggccaataaaacatggaaattctggccttgctgcaactgtgaagagaaacattccaacccggattctcacaggcatcatgttgtgcaggaacacatggggagtctttcgccacaaatgcagagacttctgccccacaatgttgatagtgaatggattgagatgattcttaattgttcttggaagcctctggatatcctagctgcagttagaatgctttataataaagcaaagttcaaaagttcttcacttcctgaggatttgtacttggatcatcatgctctggactataatgattgttttaaagatgcaagcagctcttacattgagaaggaaagttcgggggacagtcttcctaattgttcagtagaatgcaacaaccattataaaattatagaaaatgatgtaagagaaggtgttgaagaccaactttctatggctaatcccattattgactgttggccggtatctgatgaccctgagcgtgcaaaactcctggggaaaattcatgccatttttgagactcttattaagcacaaatgtcttgccgctagtcatcttaacaaggtcatacagttcactatgggtgagatacagggtcttgctgctggttctcaacttctgaatcatggtgtggaccaaacaccaatgtgcatgtgctttctaggagctacacagcttaagacaattttccaatttctgcaggaaatatctcatgcttgtgggttggccagaaatgctgataaaggtggtagtcccacaaatgatttgctcaatatcagtcaaggtcctgagattaaagacaagattgtacttgatggagatgcatcatgcctcctactggatgagtgtttattgcaaacacaagtcactgctggtacagttcaggggactgtcttggatgatgtgaccaccccaagctctcctgatggaatttcatgctataacgatgctttgctatcctggatattttcatgttcacctatcggggatcagttgacatcatggctacggaccagagaagataaactaaataaaggaaaggaaattgtacagttgcttgagaaggagttttatcatctacagggcctatgtgagaagaagggtgagcgtgtaagttatgaggaagctctgcaaacagtggaggatctttgtcttgaagaaggtaagaagagggaaactgttggtgagtttgtccagcgaagctatgaatctgtcttaagaaagcgaagagaagagctcattgagagtgagaatgacatgatgtatgtcagcaataggtttgagttggatgctatatcaaatgttttgcaagaagcagaagcaagaaatgttaatcaatttggctatgaagaaacttatgctggtgtgacttctcagttatgtgacttggaatctggtgaagaagatgaatggagaatgaaggattacttgcatcaaatggatggttgtatagaaaatgctattcagaaactgaaagagcatttatccatagagcttagcaaaattgatgcccgaataattagaagtgttacagagatgcagcaactggaattcaagcttgggcctatttctgctaatgactatcgagcaatattagtgcctctagtgaagtcgtaccttagggctcttttggatgatttggctgagaaggatgcaagagagaagtctgatgctgtaagtgaagcacttttggctgaaattgctcttgattccaagaaggctgttaaggggggaagtgagagcacaaggcatgtcgagaaaacaaaagataagaagaagaataaagatcacagaaaagcaagagatttgaaggtcgctagtggtcatgcacagttctcacttggatcaacaactcctgattccaatctagttgcacctgaaagtgacttcccagataatgaggttgttgctatgaacgatgatgacttggaacaacttgaagaggaatttaggcgtaagattgagttagaagaggaggaaaaaaagcttgaagaaactttggaatttcagcgaaggatagaaaatgaagccaaacagaagcaccttgcagagcaacaaaaaaaatcatctgggttatacttggaaggagtggtagacaaacttcaagattctgaaacaaaggtggatgctgatccaccagatgctcatgaacatgttggagtacttgtgcaggaccagctggtaaaggagaatggatcccgaagcaatttggatgcaggtttgcctaatggagttgttccagagaatggtctagatcgccgtgcaggaaaaaaacataaacggaaaaattcttccagacaagttgatggaaagtttgaacctgtttcatcaggacaagagaatattgaagatacacatactgattatcacctgagagagcaattcaaacttaatagcaatcaagatgttaataatgtgtggcaaaacaatggatcaaaggtgatgggagagttgcaagtagaagatgcagaggaggaaagatttcaagctgatcttaaaatggctatactcttatcagacacgtatcaagctcgtggaaatttgcattcagtttccagtttaagaatgccacagagagcttcttcacaggaagatagtgtggattgtctgcctgtggaagactcaactgataatgtgaatggggctacattgcttggtactggactgaagaatgaagtgggtgaatataattgttttctcaatgttattatacagtcactatggcatttaagacgctttcgggtggaatttcttggcagatcaagatcagagcatgatcatgtgggtaatccttgtgttgtctgtgcattgtatgaaatctttactgcactggacactgcatcaaaggattcaaggagagaagcagttgcacctacatccctccggatagctctaagcaatctgtatcctcacagtaatttcttccaggaggctcagatgaacgatgcttctgaggtactgtcagtgatatttgactgcctccatcggtcatttatttgtggttcaagtgtttctgatgcagaatcagctgaaagcaactgcatgggatcttgggattgtgcaaatggtagttgtatagcacattcactttttggaatgaacattttcgaacaaatgaactgctatcactgtggtcttgaatccagacatatgaaatatacttccttctttcacaatataaatgccagtgccctccggacaatgaaggatacgtttgctgaaagttccttcgataagcttttgaatcttgtggagatgaatcatcagttggcttgtgatctagaagctggtggctgtggcaagctcaaccacatccatcactttctctcaactccaccccatgtttttatgacagttctaggttggcaaaatacaagtgagagtgccgatgatataacagagactctggctgccctaagcaccaagatagataccagtgtcctttattgtggtttagatcctaaatgcgtccataacttggtgtcagtggtttgctactatggccagcattatcattgctttgcttatagccatgaccatgaacagtggattatgtatgatgacaagactgtcaaggtaattggtggatgggcggatgttcttacaatgtgtgaaagagggcatctacaacctcaggttcttttctttgaagctgtaaactaa

SEQ ID NO: 24987 - DNA, 1815 bp, Glycine max
  Peptide Sequence Number=SeqID_116672
atgacaaagagagagacatcggagaatgatgaggaggaaagtttattgaagaatgagaatagcggaacagatgatgactctaagattaactacagagggtggaaggtcatgcccttcattataggaaatgagatttttgagaagctaggagccattggcactttatccaatctcttggtctatctcactacggtattcaacttggaaaacatcatggctacaaatattatcaacatctttaatggcagcaccaactttgctacattgctaggagcttttctctctgatgccttttttggtcgctacaagatactggcattctgcacaatggcttcctttgtgggtttgtttgcaatacaactgacagcagcagttgagaagctgcatccacctcactgtgaagagtccaccatatgccaggggccaacagaggggcagatgacatttctaaagacaggtttaggtttattgatggtaggagctgcagggatccgaccatgtaacttagcatttggtgctgatcaatttaatcctaacacagattctggaaaaaaggggatcgctagcttctttaattggtactttttcactttcactgttgctcagatgatatccttaacaattattgtctatatacagtcaaatgtaagttgggcagtgggtctgggaattccttctgctttgatgtttgtatcttctataatcttcttcatggggtccaaactgtatgtgaaagttaaaccaagtggtagccctataactagtatagtacaagttatagtggttgcaacaaagaaaaggaggctgaagcttcctgaatatcaatatccttccctcttcaactatgtggctcccaagtcagtgaattctaaacttccctatacatatcaattcaggttccttgacaaagcagcaatcatgactccccaagatcaaataaatcccaatggatctgctactgatccctggaatctttgcagtatgcagcaagtggaagaggttaaatgcttgttgagagtgttacccatatgggtttcaggcattttgtactttgttgttatagtccaacagcacactattttagtgttccaagcccttctatctgacaggcgtattgggcaaagcgggttcttgatcccaggagcatcatactacgtctttctgatgattagtgtggcaatttggttacccgtctacgaccgaaaagtcgtgcctttactccaaaagctcaccagaaaagagggtggcatcacactccttcagaggatgggcattggcatatttttctctatactcagcatgctagtgtctgctagggttgaacagcaccgtagaactctggctctgattaatcctctaggagtggaaacaagaaaaggtgcaatctcatcaatgtcaggtctgtggctgattcctcagctgtcattagctggacttgctgaagcattcatgtctgttgcccaagttgagttttactacaaacaatttcctgagaacatgagaagcattgcaggttctctttactactgtggccatgcagggtcaagttatttgagtagtgtgcttattgcagttatccaccaaatcactgccaaatctgaaactgggaattggttaccggaggatctgaacaaggggagattggataacttctattcgctcattgctgctctagaaattattaatttaggctactttgtgttatgtgcaaggtggtttaggtacaaaggcacaggcagcagttccattgaactcgaaaaagctacaaaacaatcggaaagaagtgctaatggtgttaatgattcgaatctatag

SEQ ID NO: 24988 - DNA, 1683 bp, Glycine max
  Peptide Sequence Number=SeqID_116673
atggctatcactctgaatgtattgtcttcactttcagtgcaaggtaaatgggcaggatcttcaaattggaatacagttgtggatcctttaaatggagattcatttattaaagttgctgaagttgatgaaacaggcattcagccctttgtggaaagcttgtccagctgtcccaaacatggtgtacacaatccttttaaggcaccagagagaacattaggtgattttcagatgattagtttgctaggtgtgaatggaacggaagtgcttatccttttcggatatctcatgtttggagagatatctgctaaggcagctcacatgttatcacttcctaaggtttcagatttctttacgaggttaatacaaagagtttctccaaagagttaccagcaggcttttggggaagtctatgtgacacaaaaatttctagagaatttttgtggagatcaggttcgtttcctggcaaggtcttttggtgtacctggaaatcatcttggacaacaaagccatggttttcgttggccatatggtcctgtggattgtggtaattatgctaattcagatgcatctatagttctatacatcaagccaatgtacattgatgaccttgattggagcggctcattgccctttggttctatagtggcaattattactccttttaattttcccttggagattcctgtccttcaattgatgggtgcactctatatgggcaacaagccagtccttaaagttgatagcaaggtgagcattgttatggaccaaatgttgcgcctgcttcataactgtggtttacctctagaagatgtagacttcataaattctgacgggaagacaatgaacaaactgttactggaggcaaatccacggatgacgctttttactggtagttcaagagtggcagagaagttggctgttgatttgaagggccgcgttaaattggaagatgctggatttgactggaaaatactgggccctgatgtccttcaggaagattacatagcctgggtctgtgatcaggatgcatatgcatgcagtggtcagaaatgctcggcacagtcattgttatttatgcatgagaactggtctaaaacttccttgctatctaagttgaaagatcttgctgacagaagaaaattggcagacttgacagtcggcccagttctcacagttacgactgattcaatgcttgaacacatcaataagttgcttgagataccaggatcaaagttgctatttgggggtcaacctttagaggatcattcaattccacctatttatggtgctatgaaaccaacagctgtctatgttcctcttgaggaaattatgaaggctaagaattttgagcttgtgacaagagaaatatttggaccatttcagattgttacggattacaaaagcagtcaactatcagttgtattggatgctttggaaagaatgcataaccatttaacagctgctgaagtcattggccaatcagtaaatggtactgcttatgctggtttaagagcaaggacaaccggagctccacagaatcactggtttggacccgctggtgatgctagaggtgcaggaattggaacaccagaggctataaaacttgtatggtcttgccacagagaaataatctatgattttgggcctgtgccaaagaattgggaagttcctccttctacttga

SEQ ID NO: 24989 - DNA, 444 bp, Glycine max
  Peptide Sequence Number=SeqID_116674
atgattaacaagtttgagagacaaaaatcactagagacaaaaattgaaggacgaattattatgggttacattaataatgtggatcaagttaggcgttcgtttattggtctcggatgcaattgggcaattacttcctgcacctacagaaaagacggaatggacacaactacccctctcagccatcaaattctcccagtccaaccagcgcccccacccacaacaatttccacttctaccaccactaacacaacaacaccaagaccaacaacagtgatcaactcccagctcccacacgccatcctctgccctcatggagctgccggtggcgttgttggggctgcgtgtgcttgcccatcttcagaaaccgccccatcacaattcaattttaaagctccatcgttgggaggctcccatctagttgggaagctcgtttattctgcataa

SEQ ID NO: 24990 - DNA, 1557 bp, Glycine max
  Peptide Sequence Number=SeqID_116675
atggttcaatcgaagggtgaggaaaaaggaagtgggtgtgatttaaaaggggttgtttctgggggagtcccagtgcagttacttcaaaaccaagtgtttccagtttctttaatctttattccgaagcataccgaaaagacgcttacgcgttcacgcgcgaaatcgcgtttggggaagttgagccgttggtggaatgagatggacggcggagatggaagcgcgtggcgagaggtatgggagccacgctggcaggatagtgtggtcgattgcgtcgagtgtgcgacaaagagaaacatggaggatgtaggcgacggtagtgtagtgcagttactgaccccaccttattactctcccgtatttgtgccgcaaacccttgaggattggcaagtttctaagccaaaacgaggcacgattgttgctcagttaactgatgttgttgtggttaagtggaaggctcctcaagatggaatcgctaaatgcagcatagatattcagaaggagacgatggaagaacccgtgaaggaacagcagcccctctctgctgggaactctgcgagacccaagcttcagagatacgcgcttcgttcctcctctaaatccaaggaaaacaagccagacgcacctgatcgctccatttcttctgaatctaaacggtttggtgttcaatcttcggcttgggtatggagtcacagcgggagggggttaagtactccccgtctaagcagaagtgtatgtggtcttgatttctctggcaacaaggacaagtctactagtgctaaaccaccaagaaggctctccaatcctgtgaaagcatctcccactccaaacctaaagttggttggtaacattaccccaatctcagagagcagaacaatgaggtctggtaatgtccaagggtctcaaagcagaagccagacacccgcttctgaaatttcaagaacatcaagccgaatgaagttcaatctcttatcttcctcttcatattggctaaaccagatcaagctctctgagtctgctgacaagcactcagtttcacttggattcttcaaacttgcctcggaggcaagatgtgagaagatgaaagatgagctaaagtcttatgtgcaacgacatcagcttgctgaacttggagaagtgaaagaactgcttcaaagctatgacattgcagaaaatatagagcagccacaagtgtctgaaagcattacacaggtgccagaggaaggaactggatcctccgatgatgaagaagtgcactgcagttcttcgtccaccatggacactgcaaaactgaagcctgaacccttggacactgaatccactgaacctgctcctgttaaaatagagtcaaccaagaaggaaactagccaaaagaataaccaccccggatccaggttgagagaaaatctcaagaactctgcaaattcaagacctgcttctgacagtgggagttctagattggttaaaaaatcagaaaagccaactacgcaacaaactaataaggaaaaaagcgaggatgttcagacccctgatgagatgattttgacagaagtcgcgtaa

SEQ ID NO: 24991 - DNA, 306 bp, Glycine max
  Peptide Sequence Number=SeqID_116676
atgaaaaagaggcaggtggtcgtgaagcgagattacgccacgtcatcaccagcggtggggaatattcgatacggggagtgccagaagaatcatgcggcgaacacgggaggttatgctgtggatggctgcagggaattcatggccagtgccggtgaaggaacaaatgcggcgcttacgtgtgcggcttgcggctgccacaggaactttcacaagagggaagtgggaatcttagacaatggactaagtggtgattacgcgttaattaagactgcatctgttaaaagaataaagaaaaacgtgacttaa

SEQ ID NO: 24992 - DNA, 183 bp, Glycine max
  Peptide Sequence Number=SeqID_116677
atggcggtaatgaatgcaggcactggagcgaagggaagaggttctgtggaggagggcagaataagtgcagaggtggttggtggtgaccatgatcacaatcaaaccagcaacacaagcccaggcatgagagggtttggcaaggtctttgcatcccgagtaggtttgccatggcaagatacataa

SEQ ID NO: 24993 - DNA, 138 bp, Glycine max
  Peptide Sequence Number=SeqID_116678
atggagatcgaagcaaggatcgtctttgatgaaagacaaaagcatgaccttaacttgccaattaactcatatctgaacaaggatggcgactatgagatggttgttgcgttaggtgaggtggcaattccaatcatgtag

SEQ ID NO: 24994 - DNA, 420 bp, Glycine max
  Peptide Sequence Number=SeqID_116679
atggcttacaggcaacagctaatcgttcaaagggtaatcgaacagatatctccaaagctgaacttattcagaagagttcttattgcagggtttcagatcgtgatatggattttctggaactgtcggcctatggcaatgtccggcatggaccagattctaggggttggtgtattcaagtgtagctacattactctctccttccctaaaactctacggttttctcttgagcagaatgatttggaaggtacgtgcattatagaacacttaggtggagtgaatcttggtgatcagggtctgctggttggtgttgatttggtggagcttttgatttcgtgcattaactgccattgtatgggggaggcaatcttgatgggggagatgggtgcattaattgctgttaaatggggaattgatgggtag

SEQ ID NO: 24995 - DNA, 1269 bp, Glycine max
  Peptide Sequence Number=SeqID_116680
atggagatgaagatccagcatgacattagaagcgctgcagaaggcagcccaattgaccaaattggccctctctgcatcaaagatgaaagcttggaacgcaatatgtggaaggagatactaatccagccgcgaagacgagaatcgaagggttggggtgaaggaggtgagggaggggtttgtgacgcaatttggagattttcgtggtcgattgggggaaataggaaatcatttggactcggtggaagaaccttcaaatctgatcgtgaaaccacttctctcctatctacaactgaagatttacaaatatcactcgactcatatctctccccttctgttccttcttcatcatcacttcctttgcatcaaaccgcaagagtttttcaagaggaatccacgtactccttttacatctacaaaagtgggagactttgggttcgtctttacttcttccctctccctgacccttcctataacctaacaagtgcggttttctctgtccaaaccaatcagcacgtgctcttgcatgagttctctgtgaggaacaatgacacatctgttttcaaggaataccttgttaatgtttctgatagtagattctctcttaaattcaagcctaagaaaaactcatttgcgttcatcaatgccattgaggttgtctcagcccctgacactctaatatcagattcagcaactgcactttccccacatggagaattcaaagggtgggaccagccaatctacaacaaggcatggaccgatgcaattgtgaatagaattgaggtgatgaagatgagcaacgatgcagacagcttggatggttttttctctgttgatgggaaatacgaaggggccaagccagttatttaccctacactgccaagagaggagattaatttggctgattgggcaatgaaacaacataaaagaggagtgctcagggaagtaattgatccacgtattgttaagattatcagtcctcaatcgttcaatgtttttgtgcaaactgctgagagatgtttagctgattgtggtgttgaaaggcctagtatggaggatgtgttgtggcatttggaatatgctttgcgcctacaaaaagatgccacaaggattaaagaacttgaagaaaaaagtgcaagtatattcacaaatgaatgtaatgataatgataatatagcaggtcactcgggtgatccagcaagtgatgtgtctgacagcacagatgctaattctgctttgttttctcagatagccaactttcaaggaaggtaa

SEQ ID NO: 24996 - DNA, 297 bp, Glycine max
  Peptide Sequence Number=SeqID_116681
atggagaatgtctgtcgaagagctgcctcgtcattcaacttgttccgggtctcacaagcgtatatcgaggctcgatcgatgctcacacttaaggaagccgaatcgacaatggtggctgcctcacaatccatttatgactcaaatttctctcattcagaccaacaacaacgtgggaagccgtctggatatcacaagaattctggaaaaaaaaaattagtggcggtagtcctgggtccagttcgagacagtcttagtgttcgtgttcgtcgacctctcgcttcgactgcgggggtgtga

SEQ ID NO: 24997 - DNA, 1236 bp, Glycine max
  Peptide Sequence Number=SeqID_116682
atgggtagtgagatagatactaaatctattgaaccggtccggaatgccgtctctttgtttggagataaaagtgatcagaagaaatatctagctgcgaggagtaagagtgattgtgaaaaagaatttgaggtgttgaccaaggaattggccgattgcaaggtacaattagaagcaaagcatgctgctcacttgcaagcacttcttaagctggagcacaaccaaaagatgattaatgagttgtctaccctgctgaagaaatctgacatcgaaagaaacaagaacgtgaatgaatgttcagagtgcaaagctctcaaagatgaacttgaatccaagatgaaagagatggctgatcaaaatttggagactactgcaaaggctgaaaaggaacagaaagaagaactcctgcagcaagtgaaggagctcaatgaagttatttacgattcaaaactagatgctattaaatctgagcaagagaagttagctatattgggctcattgtctgagaaggaagagaaaattgagttagcaacaaaagccacttctcaagtacaacagcagctagaagatatgacaaaacatgcagaaatgctacaaggattacaaaatcaaccaatggataagtctacacgggttgaaacacttgttttatctgaggattctgctcccaaattcgtaaatgactcaggccaattaagcattgacatggagctaaaggagagaaagatcatggaccaatatgtgtacattgagacactagaaatggaattgagtcatgacattgaagcacaggtggaaattgcattgctgaaatctcagtttcaggaacataggttggctcacaagaatggacaagttactgaagtttccaaagttgatcactcaaaggcagaagctgaggagagaaatagtgagaataacaatgaccatgtcacaagcagaaatggagctcaaggatcagtaggtgaagttaaaagattttcagagttagcattgatggaaaaggagctagagaatgcatcagggaagatttctgagttgagggcacgtggagaacaggctctaagcaaggctgagtttgctgagaatgctaaagcagcgttagaggacaaaataaggagacatagggaacatatgcagagaaggagggctgctcttactgcactgcacttagggaggaatctacccctaaaccatttagtccttcctcatcatatggaacacctggaacctatgtag

SEQ ID NO: 24998 - DNA, 1710 bp, Glycine max
  Peptide Sequence Number=SeqID_116683
atggaaggagatcatcgaattcatcaagaattgaaacacgcgtgcaagttctgcggcaagtgcttcccttgtggcagatccttggggggtcacatgaggtctcatataaccaacttttcatctgagatgaatgaaaaagaaaagctttcatcttcacacaacaatggtggagacaaggattctgaagctgctgctgcagctaacactgctggctatggtctcagagagaaacccaagaagacttggagaatctcagattattcaagcgaagaccctttggtgtttgacaagttctgcaaagagtgtggcaaagggttccagtcttggaaggccttgtttggccacatgaaatgccattctgagaaagagagagtttccaacagcttggaagatcaagattcttggactaatgctaaggtggttatggatagccaatctgataacgaagcaactgctccgaataagagaagaaggtccaagagaagaacaaggtacacggtggttgcttcttctgcagcagcagcagcagcaacaacaacttcttctgttgtatcttttgccaatccttcttcttctctctctgaggctgagcaagagcaagaagaggttgctatgagcttgatgatgcttagtagggatgtgagtccttggagtggtcctcattctgttgccgagtcctctgacaataactctgcttatttcgaagctcgatcttcggttcgaactaatttgatcaccaaatttgatcaagcaaaactgatcaagcaaagtgataacaagtgggaggttggcaattcagaaaatcccaactcaaccagaggtaagagttcacaacttttgacgactactactgctactactattactactgagattcctgaaaatggatttagagtgaacaaaaatggagtttccaataaagggtacgaaaaggcctacaagtctgagcttgagtatgtatcggcattggaggattctgaaggtgaacataggaggagcagaagagtcaatggaacagaatcagctttatcaaagtcggttacaactactggcaaaaagtacagctcaatcaagacaaagttttcaggttctgaattgaagtcaaataagaactggatggacaaggcttcagaagctgaatctagcaagaactctaacaagagaggcaagtttgagtgtaccacttgcaacaaaattttccactcataccaagcacttggaggccatagagctagccacaagaagatcaaaggatgctttgcttcaaggaatgagagcagtgagaacagcattgaaactgatctctctcctgacccaataataactgaaaacaagctcatgaagaacggtgacagtgagtgtgtggtggaacatcaacatggtgctagttttcataatgaggtggaaacagttaatgagtccaagaagagcaaggggcatgagtgcccaatttgcctcaaggtttttccatctggccaagccttgggtggccataagagatctcatatggttggtgggtctgagagtagaagctttcaaacaattgtgcttcaggaaccagtggcagaaattagggacttccttgatcttaatcttcctgctgctactgaggaagaaagcaatagccatgctgactctaacagtaacagaccctggtggatagtagaagacaaccacaaacaggaggcactggtaggccttatctcatag

SEQ ID NO: 24999 - DNA, 1212 bp, Glycine max
  Peptide Sequence Number=SeqID_116684
atgtcaaatagctgcagaagtgatcatcttactcccttaaacggggaggaacttagtacaaggcgtaggagagaggaagagtatccaaaagagagtgttgctggcactcctcatatcaatgttcagcatagaaaagagaaggacgttttacaaagttctcaatcccaaagcattcaaccaatccagatgctagaacaatgtgagaagtcaaaatcagaagctcatgcagaagataagaaacacattcagaggttggaaaaagagcttctgaactgttctcaagaaatagattatcttcaggatcaactcagtgcaaggaatgcagaggtgaactatctggaagagcatattcacaaccttgaattgaaattagaggggatggaagatttacaagaggaggttttcagattaagggaggagctgaaaagatctgagtcaaagcaattttccttgatccaggaactagatactaaagaaaaagaattagagaagtcagctttgtccatagagaaactagaggaatcattttcatccataacattagagtctcagtttgaagtagagagcatgaagcttgatatgatggtcttggaacagagtcttttcgaggccaagaaaatccaggatgaaactctagatgaaaataatagaatgagtagatcaattgaggagctccaggtagcattgcaggatgcccaaaaaattatcatcactctaaatgaagaaattagggaacttgaagagaagcttgatactgccaaccaaaactctagaatttcttctcaaaaggatgaatactggctggaaaacaaggacagatcacaactcgagactcaatcttccttgaatgtgcgaggcaacaactctaccatgcaggaggacataagcacttatgaagtatgtggtccacatgttggaagattggcaatgatcttagatccagctgcagatttaaaagggaagatggagatgtcacaacagatccaagaatatgaatgtcttatcaagaaacttaaggaagaattaagagaggaaaagttgaaggcaaaagaagaagcagaggacttagttcaggaaatggcagagctaagataccaatttaccggttccctagaggaagaatgtaagcgccgtgcttgctttgaacatgcatccttgcaaagaattgccgagttagaggctcagcttaaaagagagcataaaaacccgtaa

SEQ ID NO: 25000 - DNA, 1983 bp, Glycine max
  Peptide Sequence Number=SeqID_116685
atggatgatgaaagagattttgagttgttattttacagttggaataccaagaatccgactgatcagcttttcattatatcttttcttgttgctgctcttgttggaatgttgaccatagcctacacggcctttcaatggaggagaaacatcaatctaagttggatgaaagcaatagctagatctaagaaaaacccaaaggcaaggcacaaaattcctgcggcccctcatacatgggatttagaatctgcatctcgtgcaaagaatttaaactgctgtgtatgctttaagtccgtgtcaccctctcaaactctaggacctattgtagcttctgaaggtttcatccaccgttgctgtacttgtggtgcagtagctcatctgagctgttcctctagtgcacacaaggactgcaagtgtgtttctatgattggatatgagcatgtcacacaccaatggactgtttgttggacagatgtagctgaccaacctgacgaaactgctctctgtagttactgtgaagagctatgtggtgggacgttcctcagtggttcccctatatggtcttgtttgtggtgccaacgtttagtacatgttgattgtcatagtacaatgtctaatgaaacaggtgatatttgcgatttgggccaatttagaagattgatactatcaccactgtatgtgaaggaattgaactggaacttgccaggtggatttttgagctcaattactcatggggcaaatgaaatagcatcatcagttcgggcaagtattaggaaccagagcaaaaagtacaagcatggaaatgaactatctgttgaatctgggaatagtgagagcattggtgaagtgtccacagaaagcactggtgattctcatcaaatacagaatggtcatcatgaagtgggtgaaaaaagtagctcgaataagggggttcaacatcaagataatgaagtagataataaattggataggaaacccagtcttagacggaattcatcaatcaaccagaaggatgaatcccactcattaggagtgaagcagaaatatgatttgattgatttgcctctggatgcaagaccattgttagtttttataaacaagaagagtggtgcccagcgtggagactcacttagaatgcgtctgaatatccttttaaatcctgttcaggtgtttgaattgagctcaacacaggggccagagatgggactttatttgtttagaaaggtgtctcacttcagagttcttgtatgtgggggagatggtactgttggttgggttctgaatgcaatagacaagcaaaattttgtttcccctcccccagttgctattcttcctgctggtacaggaaatgatctcgctagagttctctcctggggaggtggcttgggtccagtggagaggcaagggggtcttactacatttttgcatcacatagaacatgctgctgttacagttcttgaccgttggaagggggttgggtgggttatagatggagagaaagatgtctttaggagtctggagcatggtctggaattggttgtgatgcaaaggttgctttggacattcataatctgcgtgaagagaatccagataagttttataaccagcttgtctagtagtgatcttgatctgtctgacacccttccatgggagatgaatgacctttcctttcaatttatgaataaagttctatatgcaagagaaggtgctaaaagtattatggataggacatttgcagatttaccttggcagattcgagttgaggttgatggagttgaaattgaggtccctgaggatgcggaaggtgtgcttgttgcaaatattggaagctacatgggaggtgtagatttgtggcaaaatgaggatgaaaattatgataattttgatcaacaatccatgcatgataagatacttgaagttgtgagcatatctggaacatggcacctcgggaaacttcagctaaagggtctactgcttgagttttga

SEQ ID NO: 25001 - DNA, 1992 bp, Glycine max
  Peptide Sequence Number=SeqID_116686
atggaacgtgaaaacgacaacagcgccaaaagcagtgtcaacggtcagcgccgcgtgggtttactctacgacgagaggatgtgcaagcaccacacaccagacgacgaggaccatcccgagacccccaatcgcatcagagctatttggaacaaactccaaagcaccggcgttccccaacgatgcgtgattttggaggccaaagaagctgaggacaaacatctactgttagtgcattctgaaaatcatgttaatctgattaagaacatcagctcaaagcagttcaattcgcggaggcataagattgcctcaaaattggattccatatattttaatgaaggttcatcggaagctgcgtaccttgctgctggctctgcagtagaggttgttgaaagagtggcaagcagggaattggattctgctgttgccattgttaggcctccaggtcatcatgcagaacaaaatgaagctatgggattctgtctgttcaacaatgtggcagttgctgcaagatatctcttagatgaaagaccagaattaggtgtgaagaaaatattaattgttgattgggatgtccatcatggaaatggtactcagaaaatgttctggaatgattctcgagttttattcttttccgttcacaggcatgagtttgggagtttttatccagctaatgatgatggattttataccatgattggagaaggagcaggtgctggatataatataaatgtcccctgggagaatgggcgatgtggtgatgcagattactttgcagtgtgggaccacatcttgcttcctgttgctaaagaatttaatccagacataattatagtttctgctggatttgatgcagctgttggtgaccctctgggaggatgccgtgtcacaccatttggttattctgttctgttagagaagttgatgaattttgctgaaggtaggattgtactgattttagaaggaggatataaccttgattccatcgcaaaatcaatgcatgcctgcttggaagttttgctagaggacaagcctgttattggatcctcagaggcctatccatttgaatctacgtggcgtgtgattaaagcggttctcctggagttaagtcccttttggcctacacttgcatgtgaattaccgcaaaagttaatctcacaaatggcaccacctccgcatactcttgtctcaagctctgactctgaggctgaggatgataagggtgcaccaagttcagaaaattttgttgaacttcttgaggatgtcataaaaccactttccaaactgaaagttgatgctgatgaagatactgatgtttctagtacttggcgatctgaattgtcaaatgtttatatatggtatgcctcatatggatcaaatatgtggaaggcaagattaaattgctacctagcaggtggacagattttgagaaatgacattcaggtggaaggtatgcagaaggggtgttctggttcagtgaatagaactctgccaaaagagatcctgtggaagactttcccttgtcatatattttttggtcgtgattcatcacattcatggggtatgggaggcgttgcatttcttaatcctgagaaaagttttcagcacaacacctatatgtgcctgtacaaaatttcgctagagcagttcaatgatattttgtttcaggaaaatggtttaagccttgatgcgggctctcctttatttgatataactactctgaatgctatctcttacaaggagttccactctctggaggttgtcaagggtgcttggtatggcaatgttgtctacttaggaaaggagctggatattccagtaattaccatgacgtgttctcttcttgatattgaacgtttcaaatctgggaagctaccattgcgtgcccctaataaagcgtatgcaaacaccttaataaaagggttggtagatggagaacagctttcagaggtggaagccatcgcttacatagaaggtgctgctaaatcattgtag

SEQ ID NO: 25002 - DNA, 444 bp, Glycine max
  Peptide Sequence Number=SeqID_116687
atggcttatgcgactgacaaccaggtggtctttgaggatgaaaaaaccatttatggccgaattactcttctcttcagagatttggaatcacagtatgaggcaaatttaaagtgtaaggagcaaagtgagaaggagttagagtgcttaaccaaattaaaggccgaaaaggcaaatctcttgacccaattcaagacagtggaagaaattagggagaccaatatgaacctcaagccgaaaaacgaagaggctaagataattggcgatataccgacccatggaagattgcatgagaattcagttgagtatattttgataaaaaacaaaaacaccggagaaccgagcccaaaaactgtagaagctggatcgcagcggctccgtcgtgcaagtagaagatgggactttgatgaaggagaaacctggaaaaagacaagattgggaaactaa

SEQ ID NO: 25003 - DNA, 348 bp, Glycine max
  Peptide Sequence Number=SeqID_116688
atgggagtactaaacttttggatcaagaagatcgagacttcgccgccgaggaatagcagcacgatgaaagtggagaaagccatgaccaagacgaaggttgcgaaggtgacgaggatgacgaaggctaaggagttcagaagggctcctaggaacttgtcccaggtggagtccgaggttgtttcgttgtacgcgatggtgaccatgctcatcgatgcgtcgaagagagaagaatcggtgttgagagttgagaccaggattacgaccaggaacatgcatattgaaacgggtgcgatgattctcacgatttcttcccccagagaatcgaggacgcttgaacagggtctctgg

SEQ ID NO: 25004 - DNA, 714 bp, Glycine max
  Peptide Sequence Number=SeqID_116689
atgaatagaggagctagtgcatcctacgtggaagagaaggatagcatgggaattatggggaacacacatgcagtgacaaaggaaaataacataattgccgatgtggcagatagagcagagggagaattgagagtggaggaagcatttaactttgagctgggaatgaggaatgatttggagaggggacacaatgaaaaaattatgcttgattacagaacaagtttaaaacattcacaaattgggaatcaggctggttttgcaaatgacttctttatagcttccacaggagctggttccaacttccagacaccacccaagaaggaaaatgattccatgctttcatcagtagcaattcaggaaatgacaccgtggccctctgatactatgatagagaggccagccaaaaagcctaagcatgttaattcctatcaggaaagtgaggcaacggacattgtgagacaaatgccttgtgtgattacaactggaggtggcacaactgggaagagaacagaagggcttttgtacaagtataagagaggccaagtttgtattgtatgtgtctgccatggcagcttcctctccccaacggaattcgtgatgcatgctggtggtaaggaagtggcagatcccatgaaacacatcactgtttgttctgatttagtttatatcaatggagatggggctggtttatcaccagggccgtggaaaccataa

SEQ ID NO: 25005 - DNA, 294 bp, Glycine max
  Peptide Sequence Number=SeqID_116690
atgaaattcaagaagaaagctctgttacatgagcaagatctctgcaagtgtattgctccccaaacagggctagagcaacaacaaaaatcaaattttgggaagattggaagaggtttgaagcacccttcattcttcgaagaaggatgcactatgttgcactgtttgcatcttccaacattggctgctgatgcgtcttctggtgaaagccttgcttcttcagcagctcaattcaaggcgtcatctcagtcacatccagcccaggtgcccagcggagcacctgatcctctgcattag

SEQ ID NO: 25006 - DNA, 96 bp, Glycine max
  Peptide Sequence Number=SeqID_116691
atggtggtgagcaaggttgtggattcaggcatcaggaaggaaggggatcttgaggtgggcaacctaatgaagactgcaagggactgtgatggctga

SEQ ID NO: 25007 - DNA, 618 bp, Glycine max
  Peptide Sequence Number=SeqID_116692
atgttgtctctgtggtttccaaccgctggatctgttgtcccccgtggtgacttctttgccatcttactgctgccactgctcttgtgcactacattcacttctacagaagcccatgatgcacttgatccaactggcaatattacaatcaaatgggatgtcataagctggactccagacggctatattctagaactccatgttccagcaagctatgctgttgttacaacgtacaattttcaacagtatcgccatattcaggctcctggatggatactagggtggacatgggcaaaaaaggaagacccaactgtagtggatttactgcccggaactccttacaaccagcagatagcaaattgttgctcagggggagtcttgacctcatgggcccaggaccctcaaaatgcaataagttcatttcaactaagtgttggtttagctggaacaactaacgaaactgtcaaactgccaaaaaaatttaccctcaaagcaccagggcctgatgatgctggtatgctgtggggagtcaagttatacaatgatttactcacttcagcaggaccccttgggaatgtgcagtctgaggtcatattccgaaaggacaaatcatttatttga

SEQ ID NO: 25008 - DNA, 1770 bp, Glycine max
  Peptide Sequence Number=SeqID_116693
atggatcacaggagtcgacttcttgttttaattttattctcattcttattaagaggtgagtcatggggttggttttcatcatctaaggagactccctctggtgacaagactcaagcaggcaattttaaaggttctagtgctgagttctctgttgattccttcaacgaccataagggagtgaagttaatacaaaatgctaagaagaaaatgattagctcaaactcgtgttggcaaaatgcttaccaacatctttttgctggatgttctgaaatcttggctattgatgagaagaggtctagattggcttggcacctaagtgattgctttcagagggattctggcaggtctccttttccccattgtgaacccaaatcttccattgctgtttgctcaagatccttagatgaccttgcccataaggtttaccttgaattctacctcgaaaccaacaccatttgttatcagttgcaggcacacgcattcaaatatgaaactgagagacttgtgactgaattaaaaacttcagcccagtatgtcgaggacaagctagatagcattgaagagaaatcagaacatctattacaaggctcaagacagattcatgattctcttaattcacttgatagccacacaaaacaagtagctcaaactgctaaaaatctggaaggtcacattgattctgtattaacacattcgaggagtgtttacgagcaaactacaaaaattgcactatcacagatacaattaaaagaagggcaagagaatatgaagagaagcttggaggatggggtagcaatgctcaaagactcttacaattatttgggcaaagaaattgaaaaattaagaaatgaagccattgagattgagaatgaggtaattaaagttggagatgctatgtcatcaaggatggacaacctgcaaagcaaagctgaagatattgggaatatggctgggatttccttagataagcagcaacaactcttagacggacaatccacagcgcttgagggcctaaactcattgactgagtttcaatccaaagcactagaagagagcaggaaaaccctacaatattttgctgaatatgggcatagacaacatgaagagcttattcagcgtcaacaacaaattcaaggatttcatgatcgtttaatggaaaactcaagggaaatattgtcttctcaggaatcttttgaatcaaagcaggcttccatgaattatgagaccttgaaccatcaaatgctgttaactctgataaacaaggttaacagcatgcaaaaagaaaaggagttgtcatgggacttggatactactgattatgaggattggtctgaatggatagatgccgatttacccgatgatgtgaattaccttgatgatcctgactatatgcttccacaagtagttgcagagaattcaatcacagagcttattggcctcatgaacttcctccggtctcacattccacccgatgtaaagatcaacaaacttagcaccgtatgggactatgaagtccctgagatgcagagagccattggaaccacacatggccaggtccatggaagtgtgggaaagaaaggagcagttaatggttgcaacaaagaggctgtgatggacatgttgactccggcgtcgtttctcgtggaatcaggaagagcagtgacagagattgctagtttgtatccctttgcccacaaggaagcaccaatgcagtaccatgccaagtcaccaagtgcaccaagaccatccaactctggctttgctctctag

SEQ ID NO: 25009 - DNA, 819 bp, Glycine max
  Peptide Sequence Number=SeqID_116694
atggcaactggtccggctgattcttatactgaaaccaaatgtggtgtttgtcatgctggaacagatgagcatcttctactactttgtgatctatgtgatactgcttcgcacacatactgtgttggcctgggctatactgtttctgatgctgagccaagtgtaaccatcaatatctttgatattgtgagggaaacaggcagccgggtggttaatagaccaagggcatctcctttacaacagaacctgtcatctcctgttattcctttacctgataggttaagttacttaagtagattaaaaggaaaaggtcctgtcacaggcatggaaaatgatggacagggcaaagaggatacaacgcctcatcatagaacaggcagcattctacagggagtagataaaccctcatgcagtggaggagctagaaaaatatcattggcacattatatcttctccgaacagaaagatcaacatttcaaagcattagtcttgaggaacactaaaatggagaagcagtgtgactattctagtctcaaccagaatttggaaaatcgctctactctaaatttggaagagaaaaagcaaagtgttgataccttcaaggtagttgcaaggcaggccactcataccatcttggctacttgcagttctgatcagcaaaagtctagtacatcctcctctagctcagtatgcagccatgccgacaatactcctcagtttcagaaatctactttaatgcctaattgttgcaggcaatgcttttatgactttgtaaacaatgttgtcaactctaccatattggagaaagtgggttgcgcttga

SEQ ID NO: 25010 - DNA, 1071 bp, Glycine max
  Peptide Sequence Number=SeqID_116695
atgttaaaggttgcagttgcagttgcagcgcaaggatatttgtttctcactctctccctcaaaccccattcgcatttcgcatcgcaattctcacctctctctctctccgtacgctctcatgttcactccaacaacacactcactgacataaacactagtttcaggtgctatctcgtcattctcatccaccaaatgcaggaaatacacaccatgggcggagggaggtttttctccggcgaccggaggctccgaccccaccatcagagccagcaggccctgaagtgccctcgctgcgactccctcaacaccaagttctgctactacaacaactacaacctctcacagccccgtcacttctgcaaaaactgccgccgctactggaccaaaggcggcgtcctccgcaacgtccccgtcggcggcggttgccgcaaatccaaacgctcctccaaacccaccaaaacatcctcccaaaccgcgtcaccggaccccgaccaccacaacaacaacaccaactctcactccagcagcgggagctccagcctcaccgccgcggccgccaccgccaccaccaccaccaccaccgaggccgtgtcggcgccggagactctaaacttggattccaacaacaacaacaacaacatgcaagagtcaaagttgttgatccctgctttggaaacaaatcctctggagcacggaacaggggactgcggtggtatcttctctgaaatcggtcctttcaccagtttgatcactactactacttccactaacgagccattggcgttcgggttcggtaactccactctccccgatgcgtcgtcgtttcagtggctccaccagaaagttagcagcagcagcaacgaagagttgaagttacccgagagttccttgctcgatcacaccgttgattttcatagtaaaatcagccacgggggaggattcggatcgttggattggcagggcggtgcagatcaaggtttgtttgatcttcctaacaccgttgatcacgcttactggagtcacactcactggtctgaccacgacaattctactctctttcatcttccctga

SEQ ID NO: 25011 - DNA, 1062 bp, Glycine max
  Peptide Sequence Number=SeqID_116696
atgcagcatttcgtggatttgcaagagaattcggagttgggtgagtcgaattcatggctttcagcgaaagagcagtccggtgcggcacccaacaccaatttggatcgcgtcctcttcaacgacctcgtcgagattgtccctctcgttcagtcactcatcgatcgtaaagcaagccgttcattcacgcggcgtggttccatgatctacaccaagacacccacaagagaatcattgtccaaaagaacaacagattcaaaaagtaggaatgttgcccaatctattcttgccaaaaagaaaagggaccatggagaaaaagaacaaggaaaaaatggcagcaatgatgctgataactattccatgttttctacaagaactttggcttcagaaaaggacatagaagagttaggtatgttgaaggagcaggtagaggaacttcagaggaaattgttggagaaagatgaacttttaaagtcagcggaaaactcaagagaccagatgaatgcttttaatgcaaaacttgatgaacttaaacaccaggcttcagaaaaggaatctttactgaagtatactcaacagcagctctctgatgctaagattaagcttgcagacaagcaagctgctcttgaaaaaatacaatgggaagcaatgacatccaacaagaaagttgataaacttctagatgagctaggttccatgcaggcagatattacatcattcacgttattactggaaggattgtcaaaaactgacactgctaagtataccaatgattatgatgtcaaaccttatgatttcagtcacctgcctagtattgatgatttggacgaggtggaattgcagaaaatggatgaagcaagaaaagcctatatggctgctgtttcgatttccaaggaaaaacgagatgaggaatctattgctgctgctgccaatgctagacctgtggcatcgggtttttcaaaagcagaagagttaatcattagtttctctttgaagtggcattcagcaagtttccttctagcagctgattctgattggcagaggttatatacttggtattattga

SEQ ID NO: 25012 - DNA, 1191 bp, Glycine max
  Peptide Sequence Number=SeqID_116697
atggcacaagatactgtttctggagttgactcgcctcggggacgtctattacgagatcaggttcaagtggttaaaaaaaaggattctgatcgctatgaaattgttcctatccaagattctttgtcatttgagaaaggattcttcatatttatccgtgcatgccagttgttggctcaaaagaatgatggaatcatattagtaggagttgcaggtccatctggagcagggaaaactgttttcaccgagaaggtcctcaattttatgccaagcatagctgtcataacaatggacaattataatgattctagtagaattattgatggaaacttcgatgaccctcggttgacagattatgataccctgctcgaaaatatacagggtcttaaagcagggaagcctgttcaagttccaatatacgatttcaagtctagttctcgcataggttacaggactgttgaagtccctggctctcgtattgtaatcatagaaggcatctatgccttaagtgaaaaattacgacctttgcttgatcttcgtgtttctgtcactggtggagttcattttgatcttgtcaagcgtgttttgcgggacattcatcgtgccggtcaagagcctgaagaaataattcatcaaatctctgaaacggtgtatcctatgtataaagcttttatcgagccagatctccaaacagcccatttaaaaattattaacaagtttaatccattctctggatttcagaatcccacctacatattgaagtcagcaagaactgtgacagttgatcaaataaaggcagttattgctgcagagcatactgaaactaaagaggaaacatatgacatatttcttctaccccctggggaagaccccgaagcttgtcaatcatatttgagaatgagaaaccgtgatggaaagtacaatctcatgtttgaggaatgggtgacagatagtccattcataatatcacctagaattacttttgaagtcagcgtgcgccttcttggagggctgatggccttgggatacacaattgcagctattctgaaaagaagcagccatgtctttcatgatgataaagtgaccataaaaactgattggctagaacaacttaatcgcacatatgttcagctggtgcttatgaagtacatatggaagaaggaccgaatgcctgtcaaacatatttgttggtag

SEQ ID NO: 25013 - DNA, 282 bp, Glycine max
  Peptide Sequence Number=SeqID_116698
atgaagaatgctacgttctgggaagtgccaaagaagggtccagcagtgaataataatagtgactgcaacacttggaacaataggcgggagaaactgtgctacgattgcaattcatgcaagggaggagtgctggccaacataaggaaccagtggaagcgtctcaccgtattcaatgcatgtgtgcttctgctcgtcaccgccatatacgccttgggctgctacgccatcaagaacaacagatcccactcccactgcaaccaccgcaaaacacccatcccttga

SEQ ID NO: 25014 - DNA, 357 bp, Glycine max
  Peptide Sequence Number=SeqID_116699
atgcagaaggattcggcctttgaaaagtcactgtggtggatctgtgactcaaaacagagagagagagagagagagagagcgatacacacacttgcggcaatggtgactccacagattcctgcttcctattactcatatttccccccggtgtatcgagatgaggtgaagtcactggaggcagcggttcatcgatctcttcctgaatttggttgtggaagaacacaaagcaagaatcggtcgataaacctctgcatccagcgctcactttgcctctctttaccagcaatttcctttctctttcttctcttaaataacattgtttttatgcttcctcttgttttcatatggaaaaattag

SEQ ID NO: 25015 - DNA, 2955 bp, Glycine max
  Peptide Sequence Number=SeqID_116700
atggagtcagatgaagacgattttgttttctacggaacgccgatagagcgtgaggatgattcaatcagtcgcaagaagaaggccattgccgagtcctccggtcagctccgaactctccccgcttggaagcaagaggttagagatgaggaagggcggagaagattccatggagcgtttacaggaggctattctgcgggttactataatacagtgggctcaaaggaagggtgggcacctcagtcatttaaatcatcaaggaagaacagggctgaattcaaagagcagaacatactgaattttctagatgaagatgagaaaactgaattggaaggtcgttttttggggacaacctcacagtttgacacatttggtttcacagctgctgaaattgctcgcaaacaagctgagaaggaacagaaacagaggccatccataattcctggacctgctcctgatgaaatagttgttccagccactgaatctgttggggtaaaactgctcttgaagatgggatggagtcatggtcgctcaatcaaggattcacattctgaggcactgtatgatgccagaagacaggcccgtagagctttcttagcattttcttctgatgatccaaaagtgaagattactgagactgaacccatcgagggtgatactgaaaattttcctgaggaacctgtgaatgacgatgtttggttttctaagagcacacctgtttacgtacttaacccaaagcaagacctgcatggattaggttttgatccttataagcatgctcctgagtttagagagaaaaaaagatcacgcttagccagcaaggggggacctggcttctccactagagatggtctttttggtttgaagtcaggaaaggctgcccccggttttggtattggagctcttgaggagcttgatgcagaggatgaggatgtctatgccactggttacgaatttgaagatgcttatgttcaagaagttgaagaacctttgacattgagattagaaaaccagagaaaagaagttgaagaaccttcgacgctgagattagaaagccatagaaaaaaagagcagaaggaccagggtgatctgcctggttttagagttgcatccaattctgactataaaatggaaagatttgaggctcctctgatccctaaggattttgtgccccaccatgaattttctggacctctcgacattaaccgcaagagctatgaagtcaatccaccagatgttcctcctccagaggatggaaatttaaaactattaattgagggggttgcaaatctggtagctaaatgtggaactggccatgaatattatgcaaggaaattgtgggaggcacaacagaaacacaataatcagactagtcggcaattggatagaaaaatgcctcccagtgtgcagaggctaacagctgagagtcgaggccagatcttaggggaaaaacctctagaaaaaagctcccaagatctatcctcgtctgttgcttctacagatattcatctccaatttaatcttactgatacatttatcgagtctgcatcacttagtgagttaatgaatgtggaaaagcctttcaaagatgatcctgcaaagcaagaaagatttgagcagtttcttaaggagaaatataaagggggattacgctctgctagttctagtttagctggtgatatgtcagaagttgctcgtgctcaagagagactaagttttgaggctgcagctgaggcaatagaaaagggacgacaggtcaggggaagcaagcctttaattccatcttccgtggattttatcccaggtggtgttatgcagtttacttctggtgaagtaaagcccaagaaagatctgcaagctgaagatattttgaagaagaaaatgtaccctaagagggaagagtttcaatggcgcccttcacctcttctgtgcaaacgctttgatcttattgatccttatatggggaagccaccacctgctccacggattaggagtaagatggataccttgatttttacatcagattcggtcaaaggtgccaaagtggacgagcctgttacttcaaagaaagacatctcacctttgcagctatctactaataaagacataaccataagtattactgaaaatgaaatggaaggggacgtggaagtggaaaatattgaaaggccagttgacctatacaaggctattttctccgatgattcagatgatgaaggccctagtaataggagagtggagaatcaagaaaagaaagctgaagtagctaatacagcactgagccgtttgattgctggtgattttctggaatcattgggcaaggaactaggaattgaggttcctcctgatatgccttacgctatgcaaaagtccaggaatgttgcacctcagaaagacatctttaatgaagatgcaagaaccgatatcctgaagagtgaaaacaacggtgtgatgtccttaaatcatgatttgccaaatgatcagcagcacattgctcatgagggtgggccatcaaaaggtgatgacaccattgatggaaatatgcttgagagcagtattaacaaaaccaagggaaccagcagccaagacaatgacagctgttcagaagaaaggagcaaaaagcaatctaatagggaaaaatacaatgagtacaggaaagataaaacccctaggaaaggagcagaaaatgttccagacatcatcggcataagaagcgccatgcaggaagtcattcatctagtgacgatgacagaagagatagacacagttcaaggtcaaaagggagaaggaaaggttcttcccaagaaaaaagcaggagtgaaaaacactcaaaacatcacaagcacagaaagcatgaatctccaaatagatcctctcgttatagcaaagagaaagacaattcacattccagaaaagagaaaaggcggggagaatgagcgagagacttgtttcctttga

SEQ ID NO: 25016 - DNA, 2142 bp, Glycine max
  Peptide Sequence Number=SeqID_116701
atgccggtttcaacgcggtctcagatcagcgtcagcaacaacaacggcgaaagcgaaccgaatccatcatcggcagcgacaaggctgagaaacccacaccatgggctgaaggagaagctgaagacactcactctcttatacgagcagcagaagcaagcctctgcatctctcagaaatgcgtctttcactttcaggcctcctcctccagagaaggccgtgatgcgagagaacacaatgcctaacaccacaataaccagaaccttcgtcttaccccagcccccctcaaacgacaatgacgatgcaaaggaaaacgtaatcatgggagcagatcgaattgtggcgttctcgtgtccgagaaagacaatgaaagcaaataataatgttttggcttcgcagtctgccagcgtggcacggaaactgtcgatggggccggtgagagtggaggcggtttcggagaagcatgggaaattagggagcaggattctggtgtttgtgagggtgagacctatgaataagaaggaaaaggaagcggcttcacggtgctgcgtcagagtcgttaatcgccgtgacgtttatctaacggagtttgctattgaaaatgattacctcagactcaataggctccgcggacgccactttaccttcgacgctgcatttccagactccgcttctcagcaggaagtttattccacctcgacttcagagcttgtggaagcggttttgcaagggaggaatggttcagttttctgttatggtgcaacaggagctgggaagacttacacaatgcttgggacggtggagaatcctggggttatggttttggcgattaaggatcttttcagtaaaattaagcagaggagttgtgatggaaaccatgtggttcatttgtcctatcttgaggtttataatgaaactgttagggatttgctttcacctggaaggcctctcgttcttagagaagataaacaggggattgtggctgcaggacttacacaatatagagcttattcaacggatgaagtgatggcattgcttcaacaaggaaatcagaaccgaactacagaaccaacccgtgcaaatgaaacatcttcgcgttcccatgcaattttgcaggttgtggtagaataccgagttagagatgctgcaatgaatattattaaccgagtggagagagctcttgctacggatcaaagaacacttagatctcttgagggggccaatataaaccgatctcttcttgcactaagcagctgtattaatgctctggtagaaggcaagaaacacataccataccgaaactcaaaactcactcaacttctcaaggattcactaggaggaacttgtaacactgttatgattgcaaacataagcccaagtaacctctcatttggtgaaactcagaacacagttcattgggctgatagagccaaggagattcgggcaaaggtaagcgatgcaaatgaggatcaattgccagtacctgagatagaaactgaccaggcaaagcttgtacttgagctgcaaaaagagaatcgtgaattaagaatacaactagcacaacatcaacagaagttgttgactctccaagcacaatccttagcttcccaatcctccccaacaccaccaccttcagctggacctctttccactcctccaacgtctgcccaaccaattgaaaaacgaaggactagatcctctttcttggctggaacttgtttcactccagaagccaagaaaaagggagctgaactagccatcaagacacttcaacagacggtgaaaacactagaggcagagatagagaaaatgaagaagaatcatagcttgcagctaaagcaaaaagatgatcttattcacgagctttcgcaaaagggtggaaaacaggcattaacaactggagaactggggaagggagtggtgaccaggtctagcctacggccaaaggaaccaaacaatagtgagatgaagagtccaagccaacgttttagatcaccagccccaactgccaagaaacgaagcttttgggacataaccacaactaatagtccatcagttactacattaaatggtagaaaaactagaagtcatgttcttgctgaacctgctgcacctcctccatcgatgcttcttcaggtacagtga

SEQ ID NO: 25017 - DNA, 2085 bp, Glycine max
  Peptide Sequence Number=SeqID_116702
atggcccaggattctgagaagagattccattccatcatggacaagctcttccatcctcccaaacccccttcagcctccagttcatctggagtgcagttaccagggagtagtaagaaacgtccttaccagtcagggataatggagttgaattggagaggtgacgttgctgagggacagcagtcctcctcagctgcgaccatggcactgcagggatcgctctgccgaccgtgggatcgtggtgattttatgaggagattagccacattcaaatctatgtcatggtttgctaaaccaaagaatgacactagttctgttgaagtaaaaacttattcttctttgacaatatctggcaaggaatatagcatctcctttggtaaagaaagcttcttgcctcatggtctactgccgaccatgaggcaagaagctttcttctttgacactagttctgttgaagtagttagtgctgtaaattgtgctagtagaggttggatcaatgtggatattgacaccatatcttgtgaagcatgtggggcacgtcttcttttctctactccagcatcttggaatcagcaacaggtggagaaggcagcattggtctttagcttaaagttggataatggacataaattactttgcccatggattgataatgcctgcgatgaaacactggcacgatttcctcctgcaactcctccagtattagttgacaatttcagagaacactgttttgctctcttgcaactatcagctcttccacgtatttcgccttcagcaatagactacatgcaaagccaaagcacacttctggaagactttcttggacaatctttaatgctggaatatggaaatggatctgctgaaaattctgggattggggatgttagtagtcaggaggaactgaaattgtattatcaggctcaaaagcttataagtttatgcggttggaaactacgtcctctaccttatgtagttgattggaaggatatgtcagatcagtctcttaataatacaactaatctagttgtccattctgctggaaccaatgaacatttgaaaacagatgaaagttccaaggattctatcggggaacaaatggatcccaattctgcagtattagattgctccctatgtggagccactattggattgtgggcattctgtacagttccgcgacccgtggagtcaatcagattagttggatatgctgaagtgaacggtgaaaatgctgatcttgaaaataggcagggtgtaaataataccatgcctgatgttgcaaattcatcaaaggatacttcttcaagtctaaatatgacaattgcagggggtcctcccccaacaaagcaaaactttaaagcaataatatctctgcctattattggtcagaatttaagggctcgcctttcttatgattctgattttagggatcatgtttttgttgacagaggtggtattcaatcagatttacaggagaaaactgataatattgttaatgcttttattggacaacttgttcctgtgtcatctgaaatcagggagatatcaaattttgaaactggctctcaatctagtcttcatgattcagatgttttagcgggacaatcatctgctcttaaggataagatgcctgtacacacagatgctgataaattgaatagttcagcagcaggatatcctagtagttctcagtgcacattaactaaagatattgttgcacagaaagactctacagaaggtgaagcaccttcggtttcacacaagactttggatggccaagttggtagtcttgaaaattatggggtcaaagacagagaagagaatcctattagcagggacaatgtactttatagtttagggaagttgaagaatcccccagtgtccgataaagcaatggaatttgatccaatcaggcagcatagacatttctgcccctggattgcatcaataaatgatggggaacctgggtggaagcaaacattatctgctctgtatcatcagaaaaatcatttgccacattcgccaaatagatctccatcatctatgcccattgttaaggtatttcttgcagatattattactcttatttaa

SEQ ID NO: 25018 - DNA, 696 bp, Glycine max
  Peptide Sequence Number=SeqID_116703
atggatgtgagaaacattgctgtggtggtggaagacgtggatgctgcgagaactgcactgcaatgggcacttcacaacatcattcgctatggtgacataatcacactgctccatgtctaccctttaacaagatccaaaagcaaaaacaaagctcgtgttcttcgcctcaggggcttccagttagcactttccttccaagacatttgcaacaacttctccaatacaaaggttgagattgttgtcacggaagagaacaaagaaggaatgaaaattgtggctatggtgcggcagattggagcttcaatgctagtggttgggcttcatgatcagagttttctttacagccagtttagtgtttggatgttgattaaattcaaggtccacttggttttgtttggggcaaagacaaaggttgtgatcaaaggtattggggatttcactctatcacacacggaaaaggatactggttctgaaaattactattactattcatttttagttcttcctagaatcactctacgacatgggatttataggacctgggttgatttatctaatctggattctgctcaacatgaaaatgagagtgctgttgccagtgagcttcagaaattggtcactgaaaaccttggcacttgcacgtgccttcttaatggtgataaaaaaatgccaaaggcttttgggctccacttttga

SEQ ID NO: 25019 - DNA, 231 bp, Glycine max
  Peptide Sequence Number=SeqID_116704
atggcagcggaatggagaaggaagagagagaggagatgccacttcaaggagaagatgagtctagaagaagctcaccaccataggaggccatggataagaggtcggaggaagaaggagatgaatgaaaggagaggaagagaagagcacgaaattttatgctctaaaagagctctgaaatctgaacccactaatccaagatcaattccaagattctccactaagtgtgcttag

SEQ ID NO: 25020 - DNA, 306 bp, Glycine max
  Peptide Sequence Number=SeqID_116705
atggcaattcaggctgatgaaggtagagctgaagagaaggtggagggatataaacaacagtcggtagctgagccggcactggaactagtttctgatcttattgaacttgaggaagttttggaagacgaagatgaccaacaggagagagagacaccaataaaagagagtgaaataggaataaagatgaaggaagaacgagaaaaagaaaaagaaaaagaagaaatagaaaaagaaaaaaatcagaaaaatgaaaaagaaaaagaaaaggttgatgaggagaaaaagaagagcaagagtgaggtttaa

SEQ ID NO: 25021 - DNA, 294 bp, Glycine max
  Peptide Sequence Number=SeqID_116706
atgagtatggatgagtttcttgcacaggtggcttggccaggagtccagccttctccttctggaggggaggatgagcttgttcctcctgggcaatttatttttgagactgatccagttgctcaggaggaagcagcagttcaggagcctacttcttcagctcctatatctccagcacccatatctgaggacaccaagccatcagcaccagccatggagccagagcagcctattcttcaggatgtagcagctgctctagtgctggatttaaatgaagatcagccacaggatgagtaa

SEQ ID NO: 25022 - DNA, 1476 bp, Glycine max
  Peptide Sequence Number=SeqID_116707
atggaatcagcggcaagaacaacaacaacaacaactcatatagcccttgtttctatcccagctttcagccaccaagtctcaatcctcgagttcgcaaaacgtctccttaatctccacaacaacaccttcaacatcacatgcatcattccaacacttaactcctcttacaataacattgccaccaaacccttctttgattccctccctccgaacattcactgcattttcctcccctcagtgtacttcgaggacctaaacaacaatggagtctctgtggagatccaaatccagctctcggtttctcgcgccatgccctccgttagggaaaccctaagatcactctttgatgccaccaacaacgtcgtcgccatcgttgccgatgccatggtcccggaggcgctcgattttggtaaggaactcggcatcttatcctacatctacttcccttgttccacaatgttgctatccctatgccttcattcttcaaatttggatgaacaagtttcttgtgagtatagagatcacccaaacctaatagagattccaggttgcatctctatttatggcagggatcttccaaatagtgtccaaaataggtctagtttggagtacaagttgttccttcaacgttgccaaagataccgtagtgctcatgatggtatattggtcaatagcttcatggaattggaagaagaagcaacaaaagcaataacccaacatgctaaagggaatgggaattgtagctaccctcctgtgtatccaattgggcctattacacacactgggcctagtgatccaaaaagtgggtgtgaatgtttattgtggttggataaacaaccacctaattcagttctttatgtgtcatttggaagtggtggcacactctgccaagagcagatcaatgaacttgctttagggttggaattgagtaggcacaagtttttgtgggttaatttgagggcaccaaatgatagagcaagtgccacttattttagtgatggcggtttggtggatgatcctttgcattttctaccattagggttcatagagagaaccaaagggcagggtttggttatgtgtggctgggccccacaagttgaggtcctaggtcacaagtcaattggtgcatttttgactcattgtggttggaattcggttttggagagtgtggtgcatggagtgccaatgatggcttggcctttgtttgctgaacaaagaaccaatgcggctttggtaaccgatggattgaaagttgctgtgagaccaaacgttgacactagtggcaatagtgtggtggtgaaggaggaaattgttaagctcataaagagcctcatggaggggttggtgggtgaagaaattcgtaggagaatgaaggaactgcaaaagtttgctgaatgtgctgtgatgaaagatgggtcgtcaacaaggacaatatgcaagttggcacacaagtggaaaagtttgggaagaccttaa

SEQ ID NO: 25023 - DNA, 327 bp, Glycine max
  Peptide Sequence Number=SeqID_116708
atggtgacaattggaagacccaaaaatgctgttatttggggttgcttaatattatgtgagcttatagaatcaattagcatagtttcataccctaatttcatccggggactatcgttcattgatcttttgatccttgctagtcgacttacagtgcgtgacggggagctgaggaaggggttccaaggttcagaaggtgaggaaattgagagaagagagaaagaagaagaagaaagaagaggaaacgaagtcgaggcgttgccaaatcgcgactgtgatcaatctctacgttgttccttgttcggtgttcttcgtgcgaccatcgattag

SEQ ID NO: 25024 - DNA, 153 bp, Glycine max
  Peptide Sequence Number=SeqID_116709
atgatgcagcagcctcaagctcttcctcaaggcgatccctgtgaagggaagggaccagtcactagagccatgagcatgaggctccaagaggattgggctagagctgctgaagaaggccctagggttctcatcaacctcagggtagatttctga

SEQ ID NO: 25025 - DNA, 1068 bp, Glycine max
  Peptide Sequence Number=SeqID_116710
atgccgccacgccattcacgtttccacgatagagatccatcgcatcgagatgacgatgctcatgaacaacctgaagaagcagttgttaatgatgcagttattgatgccaagggttttccaagcggaccccacgacacatcagttttgatggactatgtttatcatgtggcaacaaaagaacgtcctaagctgaagttatcctcccatggaaggaaggttgagaaatttgggaggcctgctccagagatcgaaggcttagtggttgccataagattaagtcctataatcgcacgttcgcttgacatgggtgatcgaggacttatgtctgcttttgggggagaggtgactatcaccttggatgatgtggcatcgttgatgcatctgcctattacaagcgtgttccatagctttgagcctctttgtgtggatgatgtcatgtttctcttactcaaattgcttgaattcagtgctgaagaggcaagagctgacatagtacaataccatggggcagatgatgagaagaaaccatatgcatgtcgttggaagtttgggaaggcattaccagtatcgacgtatcataagcgtttggatagattgacatctgatgttgtgtgttggattctgtacggggaccatcttgcattcagagagtttgagaccattccttcataccctgctgctccttctctatgcatagaagacattgacgatagatggattcagttttctaaatacattgcactacctggggatcctgctagacatctgcttgtgcagcactatgacacatttgttgaaccaaatgttgctcagcacccgatggcgacaacgactatggacgaagcacctgaagatgcacatgctgatgtagaccagtttcgacatgtagtggaggcttgccaagcaataactgaaaggttggaaaggctgcttaacctaagcatagtgactgaaggaataaaagcatacactatcaccgaagaatgcccgaggatcgcaagaggtgtcactacgcaacagaatgtctacattagatcgagacgaagacgacgtatagaagacacatga

SEQ ID NO: 25026 - DNA, 915 bp, Glycine max
  Peptide Sequence Number=SeqID_116711
atggcgatgttggtggttggccctcacatgggcagactcacgggtgcgtcttccatgggaggaaaatgcacggagtcgccaccaacgtttattcgaggaaaacgtcgaaaaaaccggaaaggtggagactttggttcgtattcacagtttggtagttgccaaactcggactgcaaagacaataagtgtttatgagggatccactgttgttcataacactcctttgttgcctgtccaagtaaaggtgggtgtggaggaggttaaagatccagatgcttcagttcttgtacccacttatgagctttccttagtggggcgggcaattcacatcatccttgcttggccgacacatctggtccagtctttatcacagcaggatccgaaggttgatgatccgctttatctgatggcattgaccatcccagagcttttcttgaggccttaccaggttccatgggatgccaccgtgttcggggtctttaatccagacttcccgctctacataaagcacgaagacctctctgaaattgcacacgatggtcaatgtctcagcatatcagtgttacagttgcatctgactgaaacaagtatgcgagcggggaatttcgatatctatggattcctcgagccacagtccattcagagcggacactggcagatggtggtcatcatgcccaaggaacacctagttgtctggttttgttcattgcataataggccagacaactaccttaaggggataattaacagtgctttaaaaggtcttgatgatgctctacaacctaaatcaaaggctcctactaggtggattatcgtcaagtattttaacgatcctagaccattggagccagagagattaaaggcactgcgaatccagtgggcacagtattatcttcgagttagagctcagagctag

SEQ ID NO: 25027 - DNA, 183 bp, Glycine max
  Peptide Sequence Number=SeqID_116712
atggaaaaaggaggagcaggggataatggaaaaagaaagaagtgtggaattcatgctaagcgcgcctttgggtttcttcgtgggccttcttcacctaagcgtgagctggccgctaagcgaggagacacattgggcatgtcttgtgtgctaagcgagttgtcccaatgtccaacttttctttaa

SEQ ID NO: 25028 - DNA, 1131 bp, Glycine max
  Peptide Sequence Number=SeqID_116713
atgttgaaaattgaagaacctaatctgattgctttggagttatggtcatcttttgggaagcaaagacatacctttcaaaggatagacgaagccacaaagtctaatttgagtctggaaatctgctttagtctagtggaacattcccccagactttttggtgcttctgacactcgtgcaccagagcttgtggattttccttcttctgaaactaatgcatcttcatctactgaaattgagcatattgcttcaaacagaacccatttaacctgtgttgaatcatcaagcgcctcaacttctgctcctccacatatgcatgatgaaatcactggtagttctggttctagtgcacttattgaatcaaatcgtactggacaaagtggcatttccattttacaaagttattatacagactatggtatgtggactgttctttctcagttagttaaaagaatggaattagccatactaggtagcatagatattatcatactggagaacctaattgatcgtgctcgaaggactgtgcgtggatctgccgatgatataggatggcttcaacgtgatcctggaatgccgtcagttgaagatggaacagtgaggttcctggaaattctggacaacatcaagcatggtgttcacaggttaccaaattcggtggtttatttgttaattccaggtcttttcagtaatcatggtccactttactttgtcagtacaaaagtcagtttttcaaaaatgggtttggcctgtcatatcgcaaagattcatagtgaggcttcagttgagaaaaatgccaaagagctaaaagagtacattgaggaaatttattggggttcaaataaacgtgttatgcttcttggacacagcaaaggaggagtagatgcagcagctgctttatcattgtattggtctgatttgaaagataaagttgctgggttggcattagcacaaagtccctatggtggaactcctatagcttcagatcttctacgagaaggacaacttggtgattatgtaaatttacggaaacttacagagattcttatctgtaaagtaattaagaaaaacagtggaaagagttcagagtcttgcggcatgctgggtatgcagagttgtggtttaagggaatag

SEQ ID NO: 25029 - DNA, 198 bp, Glycine max
  Peptide Sequence Number=SeqID_116714
atgaccacaacacatttggcagtaagcatgaatggacgacccaaaattaagggaatgtttggatcctcctctatgtccatgatcacaaagtccataggaaagattaaacaagtaaataacacaagagaattgttaacccagttcggtgcaacgtcacctacatctgggggctaccaagccagggaggaaatccactaa

SEQ ID NO: 25030 - DNA, 330 bp, Glycine max
  Peptide Sequence Number=SeqID_116715
atggaggctagaaaaggaataccaattttacctatactagtgatcttctctttactcatgcctccaaaggcaaatactcctccttcatttggctttaggttgagtaacatagacttttcctctgtcatgtgtcatgagcagtcactgccagatgctttgatgcaatcctaccccccaagggtattggatagaagactcaaagaggcttgggctagagctactaaagaaggccctagggttctcatgaaccttaggcttctcaaggaagttttctcaaagaagcttttcaaggaagttttctcaagaaagcttctcaaggaagctacctag

SEQ ID NO: 25031 - DNA, 739 bp, Glycine max
  Peptide Sequence Number=SeqID_116716
tattttcgggccagatgtcctggacatcgtatccgacatcgtggatcctgcagcttcaatgcttttagcaattccagatgtcctggacattgtatccgacatcgtgaatcctgcagcttcaattcttcatttgacatttcatcttgccttgtgcattgtgcagcccgatcttatcgttgacataacgttggacatcatagttattggaagagtcatggggagtgaaaataatcgtgactcagatgaagctccacagcagcgaagacccacaacatccgcacgttggcaacgagaagctgcccctattgttgaggatgctcatcatgtggatgaacatgatgaacatcccggggatccagtccctattgctgaggaagaccttgaatgtcctaaattgaagttatcctccaatggaaggaagattcagaaattcgagagacctgttgtagagattgaagggttagttgttgccataaaattaagttctctggtcacatgttcattggacactgacgatcggggactcatatcaacttttacgaagatgttgcataaagaaactagtagtttccatcttcctgtaggagaggttaccatcaccctcgatgatgtggtctctttgcttcatctgcccattacaggcaccttccatagctttgagactctgcatgttgacgaagcggtgttgttgttagtgaaattacttgaagtcaatgcagatgaagccaaagttgagaca

SEQ ID NO: 25032 - DNA, 197 bp, Glycine max
  Peptide Sequence Number=SeqID_116717
atggaaatcatatccaagcgatttgaagagcttgatgtttgtggcaaagttactctaaagagtaaactctgggaaattgtctaccctgatctaaactatatgtgtcctcctccagaaaaggtcaacaacaaaggtgatcaaaagaaatcgatgaccaaacatcaaagatcaacaaagtgtgatccatcatactggga

SEQ ID NO: 25033 - DNA, 633 bp, Glycine max
  Peptide Sequence Number=SeqID_116718
atggggacaaatcaaatcggaaaaagattctatcaagtcaagattaagggcctagatgtcaccagccttaaggagttaggacagttgatgggtcagctccagcggcaaacttttcgcaaaacttacggtaaaatctgggacctagccatgatagaagtctccacagaggccatttcctccctcacccagtattatgatcagccgttgagatgctttacctttggggacttccagctgtcacccatggtggaagaatttgaagagatcttaggatgtcctctagagggaaggagaccatacctcttctcagggttctatccctcattagctagaatttcaaagatagcaaaagcaagaaccttggcatgtagaggcgaatgggccccgttcatagacattctcgcactgttgaccttcggaggagtcctatttccaaatgtggatgggttggtggatctagcagcgattaatgcttttctcgcctatcatgaccacaaggaaagtccagttgtccctatgctagccgacctatatgacaccttcgaccgaagatgtgtgaagagcagtacgaggattgtttgttgtattccatctctttatgtatggttggtttcgcacctttttcgccaagag

SEQ ID NO: 25034 - DNA, 633 bp, Glycine max
  Peptide Sequence Number=SeqID_116719
atggctgcggagtttgggcaacaaacggtggacctatccaccctcgtcacaccggacttatcattagcagcacgtgtgacgagggtggatagctccaccgtctgttgccctaacttggcaaccattgatttcttgtttggttacatccccagggacagtgctactaataaagggtcctatgagcagagaccatcatcatttgcccccaaagcctatgagatggaaggctcttgcaaatccaagattaacaacaccaaaaacgacaccaacttgatgtccaattcttccaacaaagacatgttcctagacagctacaccactaggaatggttctgatgatttctatgatggacttgggtgctgtcatgttcggggcaaagctgattctattgcttcagctccaatagggggttttaatgcagctaggaaaggcaggggaaaggacattgaaagtcatgatatgctaagacaaggtttcactcatgttttcttgatggcattcaatgggaaggacgagttcaacgcatttcaaactcacccgtatgaccttgagtttactggagtattttcacctgctattaagaagattgtggtgctggatttcccatctaaccttgtgaaagcactagcatga

SEQ ID NO: 25035 - DNA, 500 bp, Glycine max
  Peptide Sequence Number=SeqID_116720
tcgcaggatcgacgtggaccgtcggtctctctaccccaggtggtctagtggccaaggatcataatcgtgtgactttgcgtgtccgcttcaaggtagacagagactgtgatgctactgcgggaggaggaggaggaggaggagaaggaggaggaggaggaggcgagccaagtggagtagccatgggcctgctagcagctggtgtctcgctaaacgaggcttgttcccttagcgagaatcatgcgctaagcgaggcactcagcccgcttagtgagttgggagaatctggaggaaattctgataagcatctgtgcgctcaacgcatcatcagcttgctcagcgaggcatttgtcttttcccgcgctaagcttggaaaaatcaagcattattcatctggggaggctaattcagagtgtagagagcagaacagaggcaaaaaccagaacaaggaagccaaaaacctcagctttcaagaggatcttaggtttaggagtaatttccag

SEQ ID NO: 25036 - DNA, 318 bp, Glycine max
  Peptide Sequence Number=SeqID_116721
atgcaatacggtgaagataacagaagaactcctactcatgggttcagtgagcctatccagttgaacatattcattgatggcttacgaccccattccaagcagcttcttgatgcttccaccggtggtaagattaaattgaatccccctgatgaagctatggagctaatagagaatatggcagcaagtgaccatgtcattcttcctgatagagcttacacacctacgaagaagagtcttcttgagcttatgtctcaagatgcattgttagctcaaagcaagctcttagccaaaaagattgaaaccctcacagagacttga

SEQ ID NO: 25037 - DNA, 477 bp, Glycine max
  Peptide Sequence Number=SeqID_116722
atgtctaggcccaatactgaactgaaagaaacaattaacgtagagataatacatcatctcagcactgatgcagggacaactttcacttcatattatagaggaattttagataattgcccaatcttgttgagatcatccaatgtggattggggcctgaagccttttcgggttttggattgttggtttcaagacaaaaaattcagaaaagtgaaaaagattagcagaattgagtcggagattaactctctggaatctgatggtgatggaagacaactagatgatcaagaaatacaactgagaaagaagttgcaggaggacctatgggtgacagccacctcctatgaatctttgctaagacaaaaggcaaggtcaaaatggattaaggaagaggactgcaactctaagttcttccatatcatagtcaatgggaaccgcagatacaactcacttagagcattacatgttgaaaaatgctag

SEQ ID NO: 25038 - DNA, 474 bp, Glycine max
  Peptide Sequence Number=SeqID_116723
atggtggtggcaatgctcaacgggacaaaacacaagacacacctggtagaggagtcatgttatagcccttgtaggtacaaatgccatttggggaatatgttcgggtcctctggcaagataatcttaggcgacagtgaagtggaatcaatggtgttgtctgagccaaaatcgccaaaggatgggaaagcaatgacaatccggcaacaagacgatgaccataacagatggaacaacatcacacaaaggattgatgggcaaagcaatgaggctagacccatgggtagtaaccattggtctctgtcgctaagccaaatcaacattgttatcggtcaaattgcagcaatggagtcaaacaaagtggaaagccaaccaagggtacaacagtcactcactaagaagcactttacacaaaaaccagcaggttttaaccacgagttggtgaaaaaagtggatttggcaaaaatggcaatctaa

SEQ ID NO: 25039 - DNA, 180 bp, Glycine max
  Peptide Sequence Number=SeqID_116724
atgtataaggtggatcaagttgggtcggcgacaaacgaggtatgtatttctgcatctctgttgggtgttcgtgagtgggctgatccgtacagcatacagatcaagttgattcgtaagactggtacgaatcaagttgatctgtatgttgatattaaccatatggatcaacttgatccgtaa

SEQ ID NO: 25040 - DNA, 600 bp, Glycine max
  Peptide Sequence Number=SeqID_116725
atggacaaaaaatgtgcagtgagttcaagtggaggtgtatcattgggaaaaactgatgattcatgggacacttcaatcttttttatcccatttaaagtagggttattggcagagctttggggagagaggatcgtcatgattctgatgatgctcccccagtggcgaaggcctaccgcatcagcacgcaggcaacaaggagatgtccctgttgctgaggataagcctgtgctacctacggacaagcctgtggtacttgcggttgaccctgtggtagatgccgatgagcctatggtagatgcagacgtacaggacactggtgtagacactggtgcagaggctgctgcagataagcctaagggctttccaagtggaccgcgtgacacatcggtgcttaccaagtatgttgaccatgttacagtcagcgaatggagcggagagaaattaggtaggcttgttcctgcaattgaggggttagttgctggcacaggactaagtcctctgatcgcgtgttcagtaaacactggcgatcggggacttatatcctcatttgtggaaaggtggcacagggagactagtagtttccatcttcccgtgggggag

SEQ ID NO: 25041 - DNA, 375 bp, Glycine max
  Peptide Sequence Number=SeqID_116726
atgggaaacaaatggagaaaattgaagttggctcttggtttggattcatgtgttcacactcctagagcctttgatgattcctctgccgctacagcaagtgtttccagcggcgtctcacccaccatcatttcgtcgacctgcaacacctctggctaccgtccttccattcccacaccattgtcttatggttacccaaatcccctaaggcatagatggatgagtagatacagggctcccttgtgggacaatagtagtagaagagaggggcaaaatcgcaaaggaaagcaaggaggttatgataaagaagaaaaagcagctagagtgtatgatttggtagcattgaaagtattgcattacataattccaatagattga

SEQ ID NO: 25042 - DNA, 465 bp, Glycine max
  Peptide Sequence Number=SeqID_116727
caaacccctaaattcccaacagatgcgaaacgcatcgatgttagggtttttataatgcacggcgctgacggcgataacgggcacgacggaggagtgccagaagctggcatggcagtgcatggatatgtcctacaacggaaagcttcttatgcctttggccatgctctggacccaaaccctaaccttctcctagatcaagggcttccccttgggaagcatggtgtccttaatcctcttcccaattggtccctcatcgttaacggtaaccctaacctcaagatcctcgtctatgttctcgtcagaggtgtagggaatctcaatggtgttgtcaactttaagaagcgaggtttcctaagaatctttggcttcgccctgccaattgagcttgaggttgatctcatagccgaggatgattttccccttgcggacaatgacgtaggcctcactgtcgagggagtggagtaa

SEQ ID NO: 25043 - DNA, 51 bp, Glycine max
  Peptide Sequence Number=SeqID_116728
atggacacccgtcttcatgtgattggtgatcccatgaatggagttcaacgg

SEQ ID NO: 25044 - DNA, 330 bp, Glycine max
  Peptide Sequence Number=SeqID_116729
atggggggtgagccctctcaggtcaaagataccactgaagccggagctggggatgacatcattgtagatttggcggctaattgggacccatggcaaacgtcagttcaagtagtggagtatgaatcacaacaaagagaggaaaagggtttaacaaagcataaggattttagtcatgatatgcccctaatttgggggagggttaaggtaaaaactgtctcaggaaggccacattacaagccaataaaagtcgttagtgatccaccaagtgtaagcaggataactttaactgagatgaagtgcaaaactaggaacattaattgcaggtcgtag

SEQ ID NO: 25045 - DNA, 189 bp, Glycine max
  Peptide Sequence Number=SeqID_116730
atgcagttctgtgatcttctgagaggtgttcattcagttatttctttgattcttgctttcattttggaccgtgctgctcatcatcacagattcccgtttgagattggatacaatgattcttgcggacagtttgcattaatcattgtattcaatcttgaattgtccgtttggacagtttggggagactga

SEQ ID NO: 25046 - DNA, 462 bp, Glycine max
  Peptide Sequence Number=SeqID_116731
atgaaggaggaggtggtgccaaagaaaggcgatatgaagatgatctgtaatgataagaatgatcttattcctacacggacaatcactgggtggcgaatttttattgactaccgcaagttgaatgatgtcattttcctctgccattcatggaccaaatgttggaaagggtcttattctgagcgttttgatatacatatatatattgcctattttcggaaacgggccccgacgggtgcagagaaacacgagaaactggaaccagagaggtggcacgcaaaccgaggcatgaattcagcatccgaaagcttcaaaattcctcctcatttctactccaagccattttcggagtcttggagcacacctctacattgtggggcttcgaatttcagaaaactggtagaaaaatgtgagattttgagggttagaaagccaaatttggggttagtggaaattggagtctaa

SEQ ID NO: 25047 - DNA, 228 bp, Glycine max
  Peptide Sequence Number=SeqID_116732
atggcctttggtaatcgattaccaatggtgtgtaatcgattacacagggtgatatggcctctgatcgcgatggcagcgcagttgatccatgatcgcgtggtgatggagtgcctagagggtgtttgggagaccctcgaaggcaatgagaggtgccaattccgtggcacaattcgacttactgctacttcattagtacatccggaggaacccgcacgcacacttcagtaa

SEQ ID NO: 25048 - DNA, 360 bp, Glycine max
  Peptide Sequence Number=SeqID_116733
atggtgggtcccacttctgcaatgtgcaattgtagaaagtcttgggacaccataatgtcagacataaggttgcttctcccagccatcctcagacaaatgttggaagagataaggttcaatgcttatgagtcctccaaaatctacaagcaaaaggtaagagcctgtcatgatagaaagcttgtgaagaagaacttccaaccgaaacagcaggatgtgaagccttatggagcaattgagttgatggacccctcatctaccgacctggaacacagctggatcgtgaatggtcaaatgctggaggtttacaatggtggtgacattgagagattgaccaccatcatcaaactccgtgacctgtga

SEQ ID NO: 25049 - DNA, 696 bp, Glycine max
  Peptide Sequence Number=SeqID_116734
atgacagaaccaagggtttttctttgtgcacccagcaaaattgttggtgcacccaacaataatattgaagtgacaaaaatgcccttcagtaagaatttaaaaaagctctctccctcactccctcttcaacgtgctgttgttgctactattcatctcttcctttgtgcatccagagttccaccgttgggctgtgaatcaatccttgtcattgtctctgtcataagtgtcacgctccctacccctctagtgattatggttagaaccagaggtttgggtcaggctttaggaagggttataggaagagccccggggagagaagtaaatcgtgatttagatgaagcttcccaacgacgaaggcccacaacatctgcatgtaggcaatgggaagctgcacttgttgctgaggatgttcagcaggtggatcatgtagctaacgagatccacgaacagcccgaagaagcagctgttgatgatgtagttcctgatgctaagggttttctaggtgggccccacgacacatcagttttgattgactatgttgatcatgttgcaatgattgtttggaatggagaggaatgtcctgagttgaagttatcctcccatggaaggaagataaagcaagagctaagacagtacaatgccatgggcatatgtttgactatcatggctgcgagacatttatcgcagcaaatgtga

SEQ ID NO: 25050 - DNA, 753 bp, Glycine max
  Peptide Sequence Number=SeqID_116735
atgggtttatacaaccctgggaaaattgttgaagcggctagaaggggaataagctcatggcgccattgctggcctttagagaaagaggagaagggacagagagagataaaggtagagactagagagtgtgagaaagagcgagagaggagggagaaacccttaactcctccaatgattttcaaaccggcgagtaccttgagaaagagcaacgaccaaaaccggcgcctcagcatcaacgatgtttcctttgtcgacgtttcgtttctcgatggaaaccctcttagccaccaacattcaggagttgagactggtataattgaaggtgttgagaaggatgagaagcacatattactgcctattcaagaggatgtatacaagtcgtgtgagtctatatctacgttagcgagtgatttatttgaggatgtaagagcttcaattcagaaatctagcaagaagtccaccccatcaacttcaaacatcaaagtgtcatcttccccttcggttccattgttccaaactcatgattggtacatcctttgtggcacaagtagagggtacatctacttgggttgttatacagagaacaagatagggtacatctcttgtggatcagttcaagtggagggtacatccacttggttgttcaaagagaacaagggagggtacatcccttgtggatctttggcttgtaaaggattttacaaggttgaaagaaatctcaagaaccgttggttgcttggggattggatgtag

SEQ ID NO: 25051 - DNA, 159 bp, Glycine max
  Peptide Sequence Number=SeqID_116736
atgtcagtgaaaaacctcgtcgggtgcctaggagtacatgacaagacaaaccacacactagcaagtcaagtcactctcactaggtttaaaggagcactcaaaccgtgtgatccccaaggcctacactccgaagagtccatcagggcctctcccacctga

SEQ ID NO: 25052 - DNA, 270 bp, Glycine max
  Peptide Sequence Number=SeqID_116737
atgaccactctggctcagagatggagcttcctctcttatttcaaccttgctcccacctcccacacctccgacctcaacatggacaaagctcgactaatatacgggattatcatgaagatggacatggattcggggaagcatccaacaacttggtttctcactctagcaactgatcatgtcgatagacgaattcttgcatcgagtatcggagttgatgttgttgagatttcctctgtcatgggaatcggccttcctctatcagaggggtga

SEQ ID NO: 25053 - DNA, 375 bp, Glycine max
  Peptide Sequence Number=SeqID_116738
atggagaggtttttgggcttagcgtgtcatgagtgcttagtgagatttggcgagcaagtattcgcgcttagcctgcatgtgcccattaagcccgattctaaaaattttccaaatagagaagtgtttgagcttagagccacaagggtgcttagcacgagtgggaaatttgatggtggcggtcaatctctcaatgtcaccaccattgtaaaccttcagcctttggccattcatgatccagctatgatccaagttggtaaaggaagggtccatctactcaactgttacataaggcttcacatccttgatggtgaaggggctagaccacttggatctaagctttccaggaaagagcttaaggcaagacctactgtctag

SEQ ID NO: 25054 - DNA, 153 bp, Glycine max
  Peptide Sequence Number=SeqID_116739
atggcttcatatctacaagatgcattgtggcaagcgcaacaccctcaaggagccgtagaagcagaacaacaatcgcatgacggcatgagtccagagagtgtgaggagagcattggaagaacctcataaggattttgaagggtcttctatatga

SEQ ID NO: 25055 - DNA, 852 bp, Glycine max
  Peptide Sequence Number=SeqID_116740
atgaacaatttcaacaccactcttgagtccgatgattttgctcttctagaatccattcaacgttacctcctcgacgacaacgaagacttcaactctctaacggaggttttggcaacacctaataataacgtcaatgccgttaactctccattatcttcgttggggcatgcaacaacggctgctacagaggggcgtggggcttcgtctgcagaggcgcgtggtggccacgtgcgtaaccaaaattacaaaggagtgagacgcaggccttggggcaagtttgcggctgagataagggacccaaataggaacggcgcgagagtgtggcttgggacttacaattcggctgaggatgcagctttggcttacgatcgagccgcttttgaaatgcgtggctcgaaagctaagctcaattttcctcatttaattgggtgcagtgatgctgagccaagccgaagaattaaagaagaaaccctctgtctctcctcctcatcttctttgatgattatttatctgtcactttccatccgctgcggcgccaaagttgtcaacccgaattcatcgctaatctcctacgactctatgatgtgctctttacactgtcaccagatctcccatggcggccagatctccaccaacgtcgccggtctcgtcgctttgggccgtacagccgaagagcttgtacatctgaaaccagacctgaaatttgtgaggctgaatgtggtggctttgctttatgggggaaatggtgggtttcagtttgaggttgggaaggtgattgagagggaaagtgtggagcttggcgtgagaacaagaatgaatggttccgatctgccacaacaagttcatctttaa

SEQ ID NO: 25056 - DNA, 168 bp, Glycine max
  Peptide Sequence Number=SeqID_116741
atgcctatatgcgttagaccaatgaaatttgagagaatgaaatcagtgatggaatttgcggtcacgttactagcagaggtgtgggcagaggagatcatgatgattctgatgatgctccgtagcgtcgacggtctaccgcatccgcatggaggcaacgagtacctatga

SEQ ID NO: 25057 - DNA, 342 bp, Glycine max
  Peptide Sequence Number=SeqID_116742
atggataaaggtgggatctcgagttctaagggcagagtcggcctaatgaatcctaaggacactaaaaatagattggaggcccaaaggaaaaataaaaaaggagaagttgtccatgaggttgtattcttattgcaaccgttagtttcaaaagggaaagttgtgttgtcatcgtcgtccgggtttgtggaaaagaacgagtggtatatggtcttatgggattcatctaaatggcatattggtgtagtgaaggatgatgaacaattcatacacttagaggtacaaaatgttgggagaaaatggtttatgacaatggtgtatgccaatcctcatcctcttatgtag

SEQ ID NO: 25058 - DNA, 824 bp, Glycine max
  Peptide Sequence Number=SeqID_116743
ctgaggttgcatccaaggggatgagtatgataacaggaacactctatgatcggattattaagaagagaaatatccgagacttcaatgaatttcaaattgtcattcttgatatttgggagttgctaggtgcacccagcaataatgttggtgtacccagcactaaaccatcaatccgcgaggcatttcttcttcttccaccagcttctggttcgtctttcttccgcgaggtgcatcttcgttccctgcaagtggctctccttcttccgcgcattcccgttcttccgcgagctttcgttgtttcgttcttcatcgaggttttcagtggtttattactttattacttcattgatgaaatagatgttgtagggaggctcaaaggtacaggtataggtggaggaaatgatgaaagagagcaaacactgaatcagttgctcactgaaatgaagaagcttgacaaggatgtctctcttagtgtcatttccatgagaacttcagaattcagtggtgcagacctagcaaacctcatgaatcaacaaaattctggtggcttaacatggttcataccaggtgaagatccatctctcatctctaagaaccaactacttgctagaatagttggaggcttaagggaaagagcagaagaggaagtcatatttagtgaaactgagataaccactggagctgcagtggacttgcaacaaattacacaaatagcaagacagatggtaacaaagtttggtatgtcagagattggaccatgggctttgattgatcctacagtgcaaggtcatcatgtggtactaaggatgctggctaggaactaa

SEQ ID NO: 25059 - DNA, 183 bp, Glycine max
  Peptide Sequence Number=SeqID_116744
atgagttgtgtcaggtcagtgtgcgcccgactacagacatcagatcctcctcgagatgtatctgcgacacagcccagacatatccctcaggagccagcaccagcatcgacacatgtggattctgatgcgaacaagcccagacatgcagtggttgatccacaaaagacttgcagatcaagttga

SEQ ID NO: 25060 - DNA, 1167 bp, Glycine max
  Peptide Sequence Number=SeqID_116745
atgaagcaacttcagtctcaagcacgtaaatatgagaaagagcttgcagcatacaattacacaaagcagcttgattttgcacactttacatcagaagactctaatatcaaatctatccctatatctgatcggatgcatagaaataaagttatgaagaggaacaaaagaaaaagagttgaagaacagtgtgatatagaattatacatgtctaaccatagtttattctcctattacgagaaaacagattgtactgctgttttgaaagatgtttgtgatgttggtataggaggcgtcaatgatagggacaaagaattcaagctgaataatgagtggtcttttggagagtatggaaatgttgataaatccttgaatgacatcattcagaagattgaagctatacagtcacaagttcagcaattaaaaactagaatcgacatggtgataagtgaaagtggtggaaagttttgttctataattcaattgagcatacatggcccatctgatggatttaatcattttgattctactttcaccagtaatggaaacaaattaccatttagttttcctcatttctcatctcagcttcagtctgagtttcacatgggagatctacttatgcctggaaatgcatcagctagtcgtgaagtgatgattccctgtattgaaaccactgatgggcctgagcttgatgatccattgaaagatgctttcgacagccaacgtaaaactttgtcgaatctctatgacatggatcaattacgtaataatgtgaatgctaggtcgttgcccggaagcaacgcgctgtatggctcgagtacagtgtcaaaagagcaagggccgctgcatcgccgcccggatgtagtgaaaagtaagcaagggttcccacattttcgtgaacgggtgtgggtaaagaagctagttcatgacaggaggattcgctttggtacatggaatataggcacacttactggaaaatctatggaaatagtggatgttatggtgaggaggaagatcaattttatgtgcctacaagaaactaagtggacaggtgaaaaagcgaaagaattagacaactcgggatttaagctgtggtatacgggaaaaatcagatcaagaaatggggtagggattattgtggacaaggagtggaagaaggatgtcgtagat

SEQ ID NO: 25061 - DNA, 304 bp, Glycine max
  Peptide Sequence Number=SeqID_116746
atggcatctaactcccttgtcttgttgcccagccaaatcctcaaaactccaatctcttctcattccactgctccttaccaacctcggtccaacattcccttcactattggtgcgtctatgatgctcttgtgtcttaaccttcgccaatggtccactacgtgcacatttgggtgggacattcatcatccctatcggaatttaccctttgaagaatttggccacaggcaaggcaattcaaactcatggtggtgttacgttagtgccaagcaacccgacctcaaaagggtaggttgtggtggggaag

SEQ ID NO: 25062 - DNA, 315 bp, Glycine max
  Peptide Sequence Number=SeqID_116747
atggccagaggtggcagcgagactcagttagtgattgtgttgaacgtccccagcaagatatgtaccgtcacattgaggcaaattgaccaaagcaggttccttttagaaacttattcccaaaagggggctgtttcgaaactttttccagaggggctctatttttggagggaactcgccaatggagttggcgagttggacacatggcagcatctggtggaactcgctagtggagatggcgagacactgtccacgtggcgggtcccaccattcgtaatggcgaaatgctttttttacgaatttttttttaaaacttga

SEQ ID NO: 25063 - DNA, 1275 bp, Glycine max
  Peptide Sequence Number=SeqID_116748
atggaggaagcgcaggctaagggggagctgccagcattcgtgggggaagacccaattggttggattgctagtctttggatcaaaagacttagagatcgttatggtaaccacttctttaaaagattcagtatcttgatgcaagaagagcaaacagagacagaaatctgcattgaagaaggggggacttccacaatgttcttgaaagagaggaccaacgatgtacctaagccaaagaaaatgttacagcagttggtgaagaaacaagaaattaaaccagaacaggatgggtcttggaaggagaaggcgttccagaaggaggaacccaaatcttatgggttgcaccatcattcttgcaaagtcagcatttcagagttgaagcatgggctactaaaaagttcagaaaaagttcttgagaaaaagggcataaatcttgaggccaagggggtagaggaaatcagggtggaagaggataagaatctgcagcagaaaatgcaggaacaaaatagtggttttgcaattgtcatcaaagaatttcattcttgggtagtaaacgtcatagaagttgaaggtgataatggtttctttatgaagcccacagccatggaaattgtgattatatggagatggattgcacctacaccaccacccgaccccctagacgcaaactcaaatacgatccttaatgggttgtcatcagcaagccacaacctcccatggagagggatggccaaaccacgagataccaacccacttgctagtaaatcattatctgggatgctaagggaaacagagtcactatgggtgggcacaacagagatgcaccactcttccactaatttgttcctggagaaagaaaaaggaacaaaggtaaaatttacattctgcatggtggatctgattatggatgtaatgggccaagatgagtgtggagatagcaccactgtttgtggcttctacaatgcagtttcagttgagttggtgacagtcgaggagaaacataaatcaacattgagacctttggacatccatggaaaacagaacagacatgaaaccagaatggtgttacaaactgagagttcaaactgggtggcaggatttataccgctaaacttggatgattgtgtagctgattacatgttaaaagagcagaggtggaaagagattgcagcatcacacatggaggtccaaattattcagaatttgcttccatcccgacctccaccggagccacagaactcaaccccacatgcaggggagtggatgattcctagttaa

SEQ ID NO: 25064 - DNA, 279 bp, Glycine max
  Peptide Sequence Number=SeqID_116749
atgtatattaaactcattattagagtattttgcatcatgcagaatttctttcaactcgcatttttcacatggatttcgatccgattcgacatcagatcatgctttcatcaagaaactgagaatattatcataagggatgttcctccaaggactattgttgtcgggaacccagcaaagctggtaggagggaagaacagctctgttaagttggataagatttctatcttcaccatggaccatacttcacatattgctgacttttatgattattgtgtttag

SEQ ID NO: 25065 - DNA, 294 bp, Glycine max
  Peptide Sequence Number=SeqID_116750
atgattagaaaagttaaggtaatcaggttaggggaggtcaatgtccaaccaattgtcaggatcttcatgttgattttccaaatcatcatgattgtggaagcaatgccttccaagattattttgatgatgccaaagaatcaagagtcaagcaagttccaaagaatcaaaagtcaagcaagtttcaagaatcaagatcaagattcaagattcaataataatcaagatcaagattcaagattcaagattcaagtaaataatcaagactcaagattcaagaatcaagagaagacttaa

SEQ ID NO: 25066 - DNA, 567 bp, Glycine max
  Peptide Sequence Number=SeqID_116751
atggagtgttcttggaagcttgaatcctttgtccgacatgtaaagcttagtagccatcttcttgtgatccttggttctgttcaaccactaataagaaggagtgaggagagcatcagtatcgagcataggttagaggttcatcggggtcttcaagaagttgttcagggtgcgaacatcaaatttcacagtcttgtcccacaccttgaccttggtaggataggttccctccgtgtcataggcgttggtataaaacttcatcatcaacgcctcatcaatgttgtccttggccagggtggtcaacatttgatcccacttataaggccgaacactagagcattgcaagtgggatcggatgttgaccatcctgtcaaagacaacgttgatgaggtgttggtgatgtacttttataccaacgcctatgatataaaggggatctatcctatcaaggtcaaggtgtggggcaagactttgaaatttgatgcctgcaccttgaacactttcctgaagacccgagtgaacctccaacctatgcccgggaatgatgctttcctcaccccttatgattag

SEQ ID NO: 25067 - DNA, 513 bp, Glycine max
  Peptide Sequence Number=SeqID_116752
atgaaggatgaagattgggctcttcttaatagacaagccctcgaagttatccaattgacgttatctcgcaatgttgctttcaacattgcaaaagaaacaaccatggtggatcttatggaggctatttccaatatgtatgaaaagttgtcagcctcaaacaaagttcatttgatgaggaggttgcttaatttacgaatgttagaaggcgcatcagcaacgcaacatctcaatgaactcaatatagtcacagcccaattaagttcagttagaattgaattcgatgaagacagtcaagaggaagaaattcaaccagaggatatggatgtggaaaataaaaagaccataggaggtccaaatccaggaatcatcgaagttcccacaactcgaagtctatcgagtattggaattgtggaaacaccgggcattacaaaaaccagtgcaagattgcatcaaagattcaagaggagaatgttgaggcaaatgttactgttggatcaagtgacctcggaataa

SEQ ID NO: 25068 - DNA, 63 bp, Glycine max
  Peptide Sequence Number=SeqID_116753
atggtggcgattttcgttggagaagaggagaaagggaagaaggagaaggggaagaaggtttaa

SEQ ID NO: 25069 - DNA, 207 bp, Glycine max
  Peptide Sequence Number=SeqID_116754
cataaagactcaatgtatgatgaggacaaagcaaggaataagggcaatgaacctttagaaggacttggaggacctatggcaagggctagaacaaagaaagccaaggaagctcttcaacaagtgttaaccaagctatttgaatttaggcctaagttacaagtggagaagcttcagattgttaatttcaccatgttccaagaagagtag

SEQ ID NO: 25070 - DNA, 726 bp, Glycine max
  Peptide Sequence Number=SeqID_116755
atgaaggccagaaccttcaagatgcaaaagctcccaatgtgtcttcctcttgcgtggcgctcaccgacaacgttgccactgccgccaatgacagagactgtttttagggttttgtttcacaagaaaatacactttgtcccaaatcgccgaagaagctcagcactaccaaaagcaagagatgtcgacttagtggagtttgatatgaaggatgtgtttcttcacataaagttgatggagcaagcttcagagagtgaccagcctacgattttcactcaagaggagtgtgattatgaggttcaggggtctgctttgaggctcacgtttgcttgcaactcttcagtgcgatgtttggtgctttggatagttcctctatttgttttggtgaggatcagggttgaaagtactttgatgtttgccacgaagagaccaaaaactggtgctatgaagcttccctttgggctttgtgggtgccaagaggagaattctaaagggggagagcttgtggagattgaagaagaaaccagtgatggttatcgtgggaaggagtttcaggattcgggccaaaggattcagcttcaggtgcctttgccttcttcatcttttgttgtgttagtggatgaatggcagaccataaagtcaggtggggatgagattgagaaattgttgttgaacttaagatcattgattaatcaggaacaatctatgcctattggttcatgtccttga

SEQ ID NO: 25071 - DNA, 294 bp, Glycine max
  Peptide Sequence Number=SeqID_116756
atgaaattgtcgcttctgtgctcggcaacactgtccttattcggcaaccggaagagaaaatgtctgattcggtgtctggcatctttatctctggcggaggaagcacagcagaaggctcgacaaaacgaagaggaagttctgataagcgaagttctggttcgaaacaaagacgacgaggaattggagaggaaggaccttgaggcggaagcagcacaagctctcaaggcttgtcggagagattctggcaagaggatgtgcatcgccttgggttggagagattttggcaagccttag

SEQ ID NO: 25072 - DNA, 210 bp, Glycine max
  Peptide Sequence Number=SeqID_116757
atggaaagtgcaaagcacatggctacacctatgagtactggttgttacttagataaagatgaatccgatcagtctatagacatgaaacaatatcgagatccaaaacagatagaaagagcacaagtgggacatgtcaatttattggatctgctcttgtatcatggcatattgctatgcccaaattttatggatgaagcaacaactatctga

SEQ ID NO: 25073 - DNA, 789 bp, Glycine max
  Peptide Sequence Number=SeqID_116758
atggtagaacaagctaaacaagcatcttatgttcaagacccttgtgatgaaagcaagttagtggttctacacgggaaaacaattggtgttaatgttgaagatgatgattcagtaattgatacttatgtcagtcctttgtcaacacaaatctcacctaacatcgtcggagaagaagttgatgacgttcctgcaaatcataatgatcatgatgaaagagaattaattaatatcgtctattgtattttttatactatgcaaatggcgacaccacccaactctcctccttctccccttcctactaatgcaacatcacattccccttctaccttgaagcggacaagaaaagccatacgcctgagatcattggctactagaccagttgggacaaagagacccttggtccatgacaagattataagtcatgattccttggaggagcatacctcacatggaagctttgtcacccatggacgtcaggatgtactgattgtgaccattgggcgactagaacacttggtcgtgtttgtactgctggagctggtgtcacgatcaaacaatactttggaacgactccatagacctcctggactcacattgcctcttgagctggaggttggtccttcagctactcgtgtcagcacaaaggaaagttatgttgatccctcaggcaatgacccagacaccgatgagtcagagaaatgcgaattgtacaacgaagaaaatccttcccaactagtttccattggaagaatttatgagggttcttgtaccctttgggcaatgatctag

SEQ ID NO: 25074 - DNA, 366 bp, Glycine max
  Peptide Sequence Number=SeqID_116759
atgaggaagaaagacaatgaaatgaaaaatggaaaccatggagaggaaatgcaaacgggagagaattcagaggtcacaatggaaatggaaatcggaaaaatgcaaagacatgaacactgcagagccaagcctaactcgaaaagacaaaacaataactgtagcgttggtggaaatgaaaaaatgagggagcctgacattgcgacacgccccagctcgtccaggccagcatttggatcgcctgggccaccaaataacttcaaggctaagggactagcttgcctgggcgaggtcactgctttagggttaagtttcagcttgcctgggaaagttgcaactgccccaaggtggccttttgcctataaatag

SEQ ID NO: 25075 - DNA, 537 bp, Glycine max
  Peptide Sequence Number=SeqID_116760
atgatgattcaaccattgatacttgtctcagtcctttctccccacaaacgctgcctaatgtcaacgaagaagaagttgatgatgcacatggctacaccacccagctcccctcctattcttcctgagtcagtagcaccttcaccatctacatcgaagaagatagaaaaagtagcacgactcagatcattggctacaagaccagttggagcagagaacccaatgtttcatgtggatcctgtcactgggaaagtcgatgttccccatagaaagaaattaagaatatatttggggatcatctctcgcgataaggatgttcaaaactcattgttttacttttacaattttaacaaacccttctggaagtggaagcgcttcttctccacatcgatgcttaatcacccaaagaaaatgtttttcactgttcctaagagccctcgctatgctctccaattgtttagaaatgagcacaataatgctcccaaaggaaacatagataaccgaataaggaggttgctggttgagccactccatgcatga

SEQ ID NO: 25076 - DNA, 345 bp, Glycine max
  Peptide Sequence Number=SeqID_116761
atgtcgcgcttagtggactccaggaagagaagagcttctacctcccaacctcaagagccctacgatgccactagatttatatctgagatcatgcagtatgatgagttctgtcaggagcttgacaggcatagatggagcagagccttgaccaggcagcctgataaccacattgatgtggccctggtcaaggaattttatgctaatttgtatgacctagaggacaagtccacaaggcaggaactgatcgccagactatgcattccaaggcggggttttgtacttaatgttgagggggctccctggaagctccttaagaaggacctcactactcttgcacagacctag

SEQ ID NO: 25077 - DNA, 216 bp, Glycine max
  Peptide Sequence Number=SeqID_116762
atggccaaagaagagaaggttcaagtaactgatgactcgctcagcaaggtagatccgctcagcgagtggcatctgcttagagaggcatctagctcgcttagcgggttgagaaaccctagaagaggatcagtcagagatgtgctcgcccagcgtgcagccagcccacccagcgaggacgttgtctcttctcgcgctcagcacgcccagtcttggtaa

SEQ ID NO: 25078 - DNA, 375 bp, Glycine max
  Peptide Sequence Number=SeqID_116763
atgggtcgaaaagggaaaagggtagagggaggatgggggtggaaggaagaggcaagggaaagaaggtggactagagagaaaaagggaaaagaaagggagaagaaaggggagacagagggggagggtggggtgcaaatcagtagaaggggtctttcaccattgcaaaagtgcgttgcaacaattcatatattggcatacagatcacctgccgatagtgtcaatgagtacgttagcattgctgaatgcactgttattcaatgctttgaagcttttgttaaggatgcgaacgggatatttggggatgattgcttgagaaggacaacaacaataacatcaatcatctactacaaattggaaatacacatgggtttctaa

SEQ ID NO: 25079 - DNA, 285 bp, Glycine max
  Peptide Sequence Number=SeqID_116764
atggatagggcgaggttagtctacgatctggtgacgaagatggatatggactcccttagccctaccattaatttggcttatattagaatgaactgttggaacccaaatgatcccatgatcacctttccggggacccgcaagactagggctaggggacctgacacttctgctccttccttctctgctcctactacttcagcccctactctaacactaccagttctcgttccaacaccctccggcacctccgctcagagcacagagatcttagtgccgatgctatag

SEQ ID NO: 25080 - DNA, 456 bp, Glycine max
  Peptide Sequence Number=SeqID_116765
atgtcatctccgggattgacaattttacaagtcccaaaagcaatttacaggtgctcattgtttcatatgagacatttggaatgcattcgtcaagaggtttctgaactggtttttgccaaatttgggcccactatcattttattggctggacttcagggagttaggaagacaactgtttgtgcaaagttggcaaattatctcaagaaacagggaaaaagttgcatgctagttgctggggatgtttacaaacctgttgctattgaccagcttgctattttgggaaaacaggtggatgtgcctgtctatacaacaggtactgatgttaaaccttcagaaattgccaaacaaggtttagaagaggcaaaaaagaagaaaattgatgttgttattgttgatactgctgaagtattgctagttgtggatgcaatgacagggcaagaagccacatgtatttag

SEQ ID NO: 25081 - DNA, 426 bp, Glycine max
  Peptide Sequence Number=SeqID_116766
atgatgagcagggacgctatcagacttgaggtggctcctaaagatggaaattggggctttgatgtatcagagcgtgaggccatgcttccggctgggacagtggataagaatgtggaacgggtctataaagagttgcccaagtgggaagaagatcccaatttgcacacaaggcctagatataagcaaatagttaaagaccttgcagacaaatatcatactgagaacttgctgcttgtcacacacggggaaggtgttggggtggctctttcttcattcaaaaaggatgttacagtgtacgaagttgattactgtggatacgtccaacttagacgcccaattttcaagaaagaccagtcatttactgcaggagaatttgaagttcttaatcacaatggtcaaactggcgtaaatttcatcccaaattaa

SEQ ID NO: 25082 - DNA, 339 bp, Glycine max
  Peptide Sequence Number=SeqID_116767
atgacccctactcatgacgcgctcttgtattacaatgggagatggaacatgccaccccaaaacaaatttcaagttgcacctaaagggattccccctcacggaattcaagaatcaaaaacggtaagacgattgttttttcggcaaccagaacgttttgagtattcagataaagttataaaatatgaaattaatgagttgaaaatcaacgatgaagtgttgaaggtgctagtacagtctaactactggaaaaaatatgggccaatagaaattttagctatttttactaaacatggtatggaaatcgaagacgatgtggctgctacgtcgctaaacgactga

SEQ ID NO: 25083 - DNA, 246 bp, Glycine max
  Peptide Sequence Number=SeqID_116768
atgataacaaaagatgatgacaaaaagctcaaagatcaatcaaagaacaactcaagtgaaccaaagatcaatcaaagaacaactcaagtaaatcaagaagaattcaatactcaagaagaaagtttagagtcaagattcaaggttcaagatctcaagaatcaagattcaaggttcaagatctcaagaatcaagatcaagattcaagactcaagattcaagaatcaagagaaggttcaatcaagataa

SEQ ID NO: 25084 - DNA, 360 bp, Glycine max
  Peptide Sequence Number=SeqID_116769
atgaagaattcacatgaaacggagaaacctctagtaggattgaatgtagaggaaccaaaccagatcatggatgtcgacactgatggaattaatttccccaagcttcaagacgacaagaggttcagagttagactgcaaaatcaaggcaatggtattgaggataagcctggcatgctcaatggagatctatattgtgctcgaaggcctcgtgccttgggtgaatcatggtggttgggttcctcgccaatgaagatgacatggatgtctctgttggttctttcatggcaacgccgagaacaagtagaggaagaagagagagatacaagtgcgttctcgtggagtttactgagagaacaatga

SEQ ID NO: 25085 - DNA, 946 bp, Glycine max
  Peptide Sequence Number=SeqID_116770
gaacggggtagtcgaaataccaaggaagcatttggaggaaaaggcaaaggcattggcagatcaaggggaatgggcttcgtttattgacatcttgacactattgatatttggcttcgtcctctttccaaatgtggatggattagtggacctagaagcaattgatgccttccttgcttatcaccatagcaaggaaagcccgatcattgctattttggccgatgtctatgacatgcccacctatcaactgcaaggtcaccgcttatgtgccgagaaaggaaaggaaaattgggagcaactcttggctagtgtcgtaggggcatccattaattggttcccctgttggaaggaaggaataaccggggttttttcctcatgcgaaggatttccaaatgttcccttattgggaacaaggggttgtattatttataatcccgtccttgccataagacagcttggttaccccatgagaggagcgccgtcggaggaaaacatcacgcctttcatcgcatgggatttcagtgaccctaatgcgagggtacttcaaggagtctgcaaggcatgggatgcagtgcaaaggaaagataaaaagctttggggaagtagtaatgggatcatcgacgactctcataagtggctgagagcccagacaaaagagttggattggctcccaaagctaatggttgcaagagaggaagagactgaaactctagaggagatcaaagagaagttcaagtccacaaccatcaaagtccagaaagcatacgatgaactaagggacatcaatatggccaccgccgaagccttggaacgggaaaccaggagggcccaaaaggaagaacaagttgaacaaaaccaaagaaacatatgggccatcatcgaccagtacaaggaaaagctaaacctagcagcgactcatgaatggaggctagaggacgagtacgccaag

SEQ ID NO: 25086 - DNA, 444 bp, Glycine max
  Peptide Sequence Number=SeqID_116771
atgaagcacttcactgacaccctcatcagtgccaacataattaaaggaagggagaggggaggagaaggatcgaattcctgcagcccgggggatccactagttctagagcggccgccaccgcggtggagctccaattcgccctatagtgagtcgtattacaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatgggacgcgccctgtagcggcgcattaagcgcggcgggtgtggtggttacgcgcagcgtgaccgctacacttgccagcgctgatgtccggcggtgcttttgccgttacgcaccaccccgtcagtag

SEQ ID NO: 25087 - DNA, 105 bp, Glycine max
  Peptide Sequence Number=SeqID_116772
atggagtcttgagacttcaagataggatttgtgtttccaatgtgcctgaacttaggaaaatgatcctagaggaaggacataggagtaacttgagcatacatcctg

SEQ ID NO: 25088 - DNA, 325 bp, Glycine max
  Peptide Sequence Number=SeqID_116773
atggcgattccagaagaagatggcgagcctgcacctcaacaaccactccttgacgtgtttcagagattctcttttgacaacatctacagattctccttcgggttggaccctgactgtctaacaagacaatcggggttcacgcccgtgtttgtaaaaaacttcgacctgacattgaagcttttcgcagaaagggcgacaacaggatcgccctttgtctggaaactgaagaggttgttaaacctcggaagcaggaaacagctcaagaaagcagtcagagtgattaacgtgttggttagagaagttatacagcaaagatgcaaaaagg

SEQ ID NO: 25089 - DNA, 174 bp, Glycine max
  Peptide Sequence Number=SeqID_116774
atgaccaagagcaagggcaaggatccacttgaagaacttggagggcctatgacaagggctagagcaaggaaagccaaggaagctcttcaacaagtgttgtccatactatttgaatacaagcccaagtttcaaggagaaaattccaaggttgttaatggcattaagttattttaa

SEQ ID NO: 25090 - DNA, 345 bp, Glycine max
  Peptide Sequence Number=SeqID_116775
cttaagatcccagaagaagcaactgagctaattgagaatatgtatgccagttatcatgccattctaagcaacagaacccatcaacccacaaagaaaagcttgttacaggttataccatctatggtgaggctaggccaatgtattcccattgaagaaaacactcaagaaattcattatatgggaaatcaacagggacaagggtatacccaaggaagattttcaggcttccagcagggtccttataatcaacaaggacagtggaggtcacaccctggtaatcagttcaacaaagaccagggtggacctttgaacatgccaatccaacaagggcctaacatcttttag

SEQ ID NO: 25091 - DNA, 861 bp, Glycine max
  Peptide Sequence Number=SeqID_116776
atgttcatccgtccatctcattatgagctggaaaactttggagaacctgatttcactgttgtgaacggttctaaaacaacgaatccgaattgggaagctcagggactaaattccgagaattttgtaatgttcaaccttacggaaaaattacagatcattggaggaacctggtatggaggagaaatgaaaaaaggaatgttcgcaatgatgaactactaccttccgctaaaaggaatggcatctatgcactgttctgcaaacgtaggagaagaaggagatgttgctttgttcttcgggctttccggaacaggtaaaacaactttatccgctgatcctaaaagatatcttattggtgacgatgaacacggttgggataacaatggagttttcaactatgagggaggttgctatgcaaaagtaattgacttatcggaagaaaaagaaccggacattttcagagcaattaaaagagatgctcttcttgaaaatgttgttgtaaataatggtgtttctgattatactgataactcaatcactgaaaacacgagagtttcttatccgatttaccatattaacaaaattgtactgccttctaaagctgggcatgctaagaagatcgtttatctttcagctgatgcattcggagtattacctccggtttcaattttagatgaaaatcaggctcaataccactttttatgtggatatacttctaaattagcaggaactgaaagaggaattacttctccggaaccttcattctctccggcttttggtgaggcatttcttacgttacatcctaccatgtactctaaaaccttgattggtaaaatgaaagaacatggagcaaaagcttatttg

SEQ ID NO: 25092 - DNA, 81 bp, Glycine max
  Peptide Sequence Number=SeqID_116777
ggagtgatggctggacggaataatcgtgcgatagctaatgctcttcaagccttagctcaggctatagggaatccaaattag

SEQ ID NO: 25093 - DNA, 417 bp, Glycine max
  Peptide Sequence Number=SeqID_116778
atggatctagcaggaggtcagcctgctgccaatcctacagcggagcaaccctcaaacgtgccttcaggcgcatcgacctcgggctggagaagtttcgaagaaggtgttttgttagaatcttcaaacgaatccagcgaagcgagcgtgaatcagcagcctgtgattcccgaacttgaacctccgcttctcgatgacaacacccagggagcagagctcgctgttcgattgagggcgaattggggggggatcgcttataacgagcgaatcctcgactccttcgtccggagtcaacttgcaatcgaaaggcacatagaggccgcacttgtggcggacggatattcccctcaagtagtctttgaaagaagacatatgattcgtggctttcttttctatccggagggggcatgcgctgagtga

SEQ ID NO: 25094 - DNA, 723 bp, Glycine max
  Peptide Sequence Number=SeqID_116779
atgatcattgatcaatctttgttcttttatttgacaaaattacccagtcaaggtgcaccttttgagggcaccattgttgatgactggaaatttgattattctagtcatgatgctcaccatatggtttgtaatgaccaggctgaaatgaccggtagattgctggccggatcattgacctttaataatcgcatcatgcactacattattgttagaattttgcttcctcggtcttcaaatttggctcaagcctctgaggaggacttgattttgttgtgggatttccttaccggtcgtcagatcgactgggctcacttggtttggtatcgaatgcataaggcattacaggccaatgcacctctcccttaccctcaattggtcactgtgtttctccgtcattttcaaattccacttgatgatgaaccttttgttcaagtcaagcgttcctttgctataggtgttggtgcagtcacttcatttggataccaaagattcccttcctccacagatgagcgtactccttctcctcctcctcagcgagatgattcagcccttattactgaagttctttccgagttacggggtcttcgtacttatgttggtgaacgttttgattctttggataatcgctttgcaggaatggatatccgtctcacacagcttgaagaagatgtgggatatattcgtcagagcttcgatcttccaccaccaccaccaccttcttag

SEQ ID NO: 25095 - DNA, 390 bp, Glycine max
  Peptide Sequence Number=SeqID_116780
atggctactccacctgcctcgcctcctcctccttcacctcctcctcctccttctacagtatcatcagcgtctttgtctaccttgaagcggacacacaaagccacacgactacgatccttggccactagaacacctgaggcagagaaaccagtgccccgcccccacgtcgatcctacgaccaacaagactgatggtccccacaagaagaaattaagaacatatttggggattgtcgctcgtgataaggcggaatttgaaatccctgaagcttttgacagtaggacaaagaagaaagttcttcagactatcggcgagcggatgtgcggaaaaaggcacaggccattcagaagcaaaacaccacccccacgtgttgtctcgtgggggttatga

SEQ ID NO: 25096 - DNA, 516 bp, Glycine max
  Peptide Sequence Number=SeqID_116781
atggatgggactgataatcaagtctcacccttggaccttttggttggagcggaacatgtctcatcttatgatttaaaatctgccacagatgggtggccgattaatctacaaggagacattttggccttcttatttggatcagaagtggaagtgccattccgcagggcccctcaccgtaaaggtggtcggggtgatcctgtagaatatccgttcgctcgtggtagacccgttgtctcttttgagacagggcagccattgggttatctgtcgtcttggcctctcttcacactgagtcaccatttagtgcttcagtcttgtgcagagaaggtgtatccgggcagatattttgacaggtacgctatcctaggcgatgacatatgtatcgctgataggaaggttgcgtccgtatatcatcaggtcgtgacagatcttggtgtagatctttctatacctaagtctcttgtctccgattctggtggtgctgaattttcaaagcgttttagtgtcataatttga

SEQ ID NO: 25097 - DNA, 156 bp, Glycine max
  Peptide Sequence Number=SeqID_116782
atggcagaaatcaaccaagggacggatgcgagtggggctagggtcacgaccgaccaatcgttgccccttcccggtgctaaacaagcagagaacgtcgctgcagggcagcccaagatggccccgaggaaacttgcctcagagatccaggaaggataa

SEQ ID NO: 25098 - DNA, 804 bp, Glycine max
  Peptide Sequence Number=SeqID_116783
atgtctttaatattgcctgtttattctgatctagtcaaagccttctattcacacttagaaatccaagaaggcaccctaatgccagaagtttatgggattaagatggtcattgaccaatccctattctatgatttaacccaattgccaagtgaaggtgtaccatttgaaggtacactgattgacgattggaagtttgatttttttgtgcatgatgcccaccggttggtttgcaccaatcaagcggatatgaccggaaggcttcttgccggttcattggctttcgaaagtcgcatccttcattatctaattgttcgcatcttgcttccgagatcttcaaaccttgcacaggtttctgaagaagatctcattgttatgtgggcctttcataaaggtctacaaattgattgggcacatcttgttagatatcacatgcataaggcgttgcgattgaatgctccatttccatatccacatctagtcaccctcttccttcaacactttaacatccctcttgattctgaaccctatgttccaatcaagagatccttcctaataggcgcttcagtcattgctcgacatgttggtgaagaaggacatgatggagaagattcatctcttctttcaaagattttggataggtttgatggtcttcaaacctttgttggtgaaaggtttgacactttggaattacaagtggagatgcgcttcaatgagatagagtcaagaatcaccaaggttgaagaagatgtttcttatattcattcaagctttgatctaccaccgccaccgccaccatcatcttag

SEQ ID NO: 25099 - DNA, 414 bp, Glycine max
  Peptide Sequence Number=SeqID_116784
atgagaattgtcgaaactagaaatgcaaggtttaatgaaaatggtgaaatcagtgggagtatagttccacgagaagtggaaattaaagaagttagagtttgttgttacaaaattaatgaagaagagcaacacaatagtgaacctattatggaagaatcacaagaagtagcattaaggaggtctcaaagagaaaggagaccagctatttcgaataattatgtgaattaccaaaggattgtaagagaattagttgtaagtgggtcttcaagactaaaagtgactctcatggcaaccttgaatgttacaaggctagacttgttgctaagtgatttactcagaaagatgacattgattataaagagacattttcaccggtctcacgaaaggattcttttaggattatcatggcattag

SEQ ID NO: 25100 - DNA, 415 bp, Glycine max
  Peptide Sequence Number=SeqID_116785
atggcaaaaatagccaaagtggtcaaggtctcagtgcaagaattggaccgagtaaaacaaaatagaaatggggtggttgggataccaaagaagaacttggaagagaaagcgaagtttttggtagatcaaggagaatgggcttcattcattgatgttttagcgctattggtgtttgaggtcgtcctatttccaaatgtggatgggctagtggatctagcggcgatcgacgctttccttgcttatcaccatagcaaggaaagtccggtcgttactgttttggtcgatgcctatgacacatttgaccaaagatgcgagaagagcagcacaaggattgtctgttgcacaaccgctctttgtgtatggatggtctctcacatttttagtcctgaaagtagacccatctgtcccctacaag

SEQ ID NO: 25101 - DNA, 267 bp, Glycine max
  Peptide Sequence Number=SeqID_116786
atgggtttagctttttccgggatccacaaaattcagaagaagctcaatgaagtggaggatttagcatctaatagaagcctatctgatgatgagataaaggctaagagagaattacaacaagaattgtgggaggcctcaatagcttatgaatctttattaaggcagaaatctagagggagacaagtggagacatcaactcagatcaagaacaggagacaagtgcaggctctattcagacccaggaagctcttaaaatgtggaaaatga

SEQ ID NO: 25102 - DNA, 96 bp, Glycine max
  Peptide Sequence Number=SeqID_116787
atgacggcttccaagagtccaaaacaagcatcaaagcttgttggcaaaaactttggtgacgaaggacaagaaattgtaaccgacccactcgaagag

SEQ ID NO: 25103 - DNA, 60 bp, Glycine max
  Peptide Sequence Number=SeqID_116788
gcgaacagcgctaggcaatcaattcgctgggctccaaacgcgatggtggagaacacatga

SEQ ID NO: 25104 - DNA, 228 bp, Glycine max
  Peptide Sequence Number=SeqID_116789
atggcccacttgggccttcctaaagattccaaaagagggcaatggcttctggtggaagctaccaagctcgcctgggcgcgttgggcggcaaccacctccctcttttctcctataaataggggaaggagggaagaaggaaaagacgtttctgtaagtgatttcgtgatggttcttcatcgttcttcaccgttcttcgttcgttcttcgtcgttcttcggtcttcaatcg

SEQ ID NO: 25105 - DNA, 546 bp, Glycine max
  Peptide Sequence Number=SeqID_116790
atggcagagccatcgaagaagagaaagggatcatcctccaccgccgctgctgctgcccatcgccgccacggaccatctgaagcatccacagcacctattcatccatctttatcatctccaagatcatccacattgttttattctgatgatcagcgtctacgtgtttcaaattctggccttgttgatttcatgtcattaaaactgccacattatcctgaacttgtaaaggtcttctactgcaatttgaaaattcaggatgtcattatttcctctgaggtgcatggtattcctatgatcattgatcagtccttattcttttctttaactcatttacccagtcaaggtgcaccttttgagggcaccattgttgatgactggaaatttgattattctagtcatgatgctcgccgcatggtctgcaatgatcaggctgaaatgaccggtagattgctggccggatcattaacttttgataatcgcatcatgcactatatcattgttagaattttgctttcctcggtcttcaaatttagaataagcctctga

SEQ ID NO: 25106 - DNA, 126 bp, Glycine max
  Peptide Sequence Number=SeqID_116791
atgcaggttagctcgcctgggcaagctgagctcgcctgggcgagcaacccctgcacgaggatgcttaaaatgggggagggggaaggggttgtagggggtggccctaggcctatggtgcattcttag

SEQ ID NO: 25107 - DNA, 1255 bp, Glycine max
  Peptide Sequence Number=SeqID_116792
atggctacctcaccaaaagaaacttcagctcctggttcaccctctgcaccatcaaaccaggaacgacctgaattcaatatccagcccatacagatgattcctggtcaagctcctgttcctgaaaaactggttcccaaacgacaacagggagtaaagatttctgaaaaccctagcattgcaacaagtcctagggaagtagacccggagatggataagaagatccgcagtattgtgagtagcattttgaaagacgcctctgttcctgatgctggtgaagatgttccaacatcctccaccccgaatgtttctgtgcctgatgttgataaagatgttccaacatcctccgctccaaatgctgaagccctcccttcacccagtgaagaggaatcaacagaagaagaggatcaagcctcagaggagacccctgcaccacgggcaccagaacctgctccaggtgacctcattgaccttgaagaagtagaatctgatgaggaacccattgccaacaggttggcacctggcattgcagaaaggttacaaagcagaaaagggaaaacccccattaagaggtcaggacgaatcaagactatggcacagaagaagagcactccaatcactcctaccacatctagaaggagcaaagttgcaatcccctccaagaagaggaaagaaatttcctcatctgattctgatgatgatgtcgaactagatgtctcgacatctaaagagggccaagaaatctgggagaaagtgcctgaaaatgttcctgatgcaccattggacacatctctttccactccattggcaatgttgaaaagtggaaatatagaactgggaagagctgccatggattgcaaggagatcatggacctcatcaaggctgctggactgctgaagactgtcagcaagttgggagagtgctatgaaggcttagtcagggaattcattgtcaacattccctctgacatatcaaacagaaaaagtgatgattatcaaagagtgtttgtcagaggaaagtgtattagattctcccctgctgtgatcaacaaatatctgggcagacctactgatggagtgatagatattgatgtttctgagcatcaaattgccaaggaaatcactgccaaacgagtccagcattggccgaagaaagggaagctttcagcagggaagctaagtgtgaagtatgcaattctacacaggattggtgctgcaaactgggtacccaccaatcatacttccactattgccacag

SEQ ID NO: 25108 - DNA, 282 bp, Glycine max
  Peptide Sequence Number=SeqID_116793
atgagggacgacaagaggtcttcgtacgtcattgggatcggggtgaattctggagttggccttgggggaaagttcatcatcgcgttggaactggcgccaaagtgggcgttgccggccgggcgagtcgtggctggagctggagctggagcttggggggccttcctttggatgggtgcgggtgctctaggctgtgctgaagtgacgacatgggtatctccttccttcctttttgccccagttgctccgatcctcctagcattggtacttgtggatgagacgtaa
